United States Patent 11,096,956 (ANTISENSE OLIGOMERS AND USES THEREOF) - sequence listing, part 10

SEQ ID NO: 130136 - RNA, 18 nt, Artificial Sequence
  Description of Artificial Sequence: Synthetic oligonucleotide
ggaucucuugguggcucc

SEQ ID NO: 130137 - RNA, 18 nt, Artificial Sequence
  Description of Artificial Sequence: Synthetic oligonucleotide
accauggaucucuuggug

SEQ ID NO: 130138 - RNA, 18 nt, Artificial Sequence
  Description of Artificial Sequence: Synthetic oligonucleotide
ugaacaccauggaucucu

SEQ ID NO: 130139 - RNA, 18 nt, Artificial Sequence
  Description of Artificial Sequence: Synthetic oligonucleotide
guccuugaacaccaugga

SEQ ID NO: 130140 - RNA, 18 nt, Artificial Sequence
  Description of Artificial Sequence: Synthetic oligonucleotide
agcacguccuugaacacc

SEQ ID NO: 130141 - RNA, 18 nt, Artificial Sequence
  Description of Artificial Sequence: Synthetic oligonucleotide
ggagcagcacguccuuga

SEQ ID NO: 130142 - RNA, 18 nt, Artificial Sequence
  Description of Artificial Sequence: Synthetic oligonucleotide
gccagggcaggcagccgc

SEQ ID NO: 130143 - RNA, 18 nt, Artificial Sequence
  Description of Artificial Sequence: Synthetic oligonucleotide
cccuggccagggcaggca

SEQ ID NO: 130144 - RNA, 18 nt, Artificial Sequence
  Description of Artificial Sequence: Synthetic oligonucleotide
uggagcccuggccagggc

SEQ ID NO: 130145 - RNA, 18 nt, Artificial Sequence
  Description of Artificial Sequence: Synthetic oligonucleotide
cucccuggagcccuggcc

SEQ ID NO: 130146 - RNA, 18 nt, Artificial Sequence
  Description of Artificial Sequence: Synthetic oligonucleotide
auacccucccuggagccc

SEQ ID NO: 130147 - RNA, 18 nt, Artificial Sequence
  Description of Artificial Sequence: Synthetic oligonucleotide
uaggcauacccucccugg

SEQ ID NO: 130148 - RNA, 18 nt, Artificial Sequence
  Description of Artificial Sequence: Synthetic oligonucleotide
caugcuaggcauacccuc

SEQ ID NO: 130149 - RNA, 18 nt, Artificial Sequence
  Description of Artificial Sequence: Synthetic oligonucleotide
agugccaugcuaggcaua

SEQ ID NO: 130150 - RNA, 18 nt, Artificial Sequence
  Description of Artificial Sequence: Synthetic oligonucleotide
gggugagugccaugcuag

SEQ ID NO: 130151 - RNA, 18 nt, Artificial Sequence
  Description of Artificial Sequence: Synthetic oligonucleotide
ugccugggugagugccau

SEQ ID NO: 130152 - RNA, 18 nt, Artificial Sequence
  Description of Artificial Sequence: Synthetic oligonucleotide
cuccuugccugggugagu

SEQ ID NO: 130153 - RNA, 18 nt, Artificial Sequence
  Description of Artificial Sequence: Synthetic oligonucleotide
ugaaucuccuugccuggg

SEQ ID NO: 130154 - RNA, 18 nt, Artificial Sequence
  Description of Artificial Sequence: Synthetic oligonucleotide
ccaugugaaucuccuugc

SEQ ID NO: 130155 - RNA, 18 nt, Artificial Sequence
  Description of Artificial Sequence: Synthetic oligonucleotide
ugccaccaugugaaucuc

SEQ ID NO: 130156 - RNA, 18 nt, Artificial Sequence
  Description of Artificial Sequence: Synthetic oligonucleotide
uugcaugccaccauguga

SEQ ID NO: 130157 - RNA, 18 nt, Artificial Sequence
  Description of Artificial Sequence: Synthetic oligonucleotide
cacccuugcaugccacca

SEQ ID NO: 130158 - RNA, 18 nt, Artificial Sequence
  Description of Artificial Sequence: Synthetic oligonucleotide
ucccucacccuugcaugc

SEQ ID NO: 130159 - RNA, 18 nt, Artificial Sequence
  Description of Artificial Sequence: Synthetic oligonucleotide
uagucucccucacccuug

SEQ ID NO: 130160 - RNA, 18 nt, Artificial Sequence
  Description of Artificial Sequence: Synthetic oligonucleotide
cugacuagucucccucac

SEQ ID NO: 130161 - RNA, 18 nt, Artificial Sequence
  Description of Artificial Sequence: Synthetic oligonucleotide
cacuccugacuagucucc

SEQ ID NO: 130162 - RNA, 18 nt, Artificial Sequence
  Description of Artificial Sequence: Synthetic oligonucleotide
agggccacuccugacuag

SEQ ID NO: 130163 - RNA, 18 nt, Artificial Sequence
  Description of Artificial Sequence: Synthetic oligonucleotide
aggacagggccacuccug

SEQ ID NO: 130164 - RNA, 18 nt, Artificial Sequence
  Description of Artificial Sequence: Synthetic oligonucleotide
gccugaggacagggccac

SEQ ID NO: 130165 - RNA, 18 nt, Artificial Sequence
  Description of Artificial Sequence: Synthetic oligonucleotide
ugcaagccugaggacagg

SEQ ID NO: 130166 - RNA, 18 nt, Artificial Sequence
  Description of Artificial Sequence: Synthetic oligonucleotide
ucuaaugcaagccugagg

SEQ ID NO: 130167 - RNA, 18 nt, Artificial Sequence
  Description of Artificial Sequence: Synthetic oligonucleotide
agcccucuaaugcaagcc

SEQ ID NO: 130168 - RNA, 18 nt, Artificial Sequence
  Description of Artificial Sequence: Synthetic oligonucleotide
ccuggagcccucuaaugc

SEQ ID NO: 130169 - RNA, 18 nt, Artificial Sequence
  Description of Artificial Sequence: Synthetic oligonucleotide
ugaguccuggagcccucu

SEQ ID NO: 130170 - RNA, 18 nt, Artificial Sequence
  Description of Artificial Sequence: Synthetic oligonucleotide
aaaacugaguccuggagc

SEQ ID NO: 130171 - RNA, 18 nt, Artificial Sequence
  Description of Artificial Sequence: Synthetic oligonucleotide
aguugaaaacugaguccu

SEQ ID NO: 130172 - RNA, 18 nt, Artificial Sequence
  Description of Artificial Sequence: Synthetic oligonucleotide
uacccaguugaaaacuga

SEQ ID NO: 130173 - RNA, 18 nt, Artificial Sequence
  Description of Artificial Sequence: Synthetic oligonucleotide
ggguacccaguugaaaac

SEQ ID NO: 130174 - RNA, 18 nt, Artificial Sequence
  Description of Artificial Sequence: Synthetic oligonucleotide
uccuugcaucugaguggg

SEQ ID NO: 130175 - RNA, 18 nt, Artificial Sequence
  Description of Artificial Sequence: Synthetic oligonucleotide
acauuuccuugcaucuga

SEQ ID NO: 130176 - RNA, 18 nt, Artificial Sequence
  Description of Artificial Sequence: Synthetic oligonucleotide
cauccacauuuccuugca

SEQ ID NO: 130177 - RNA, 18 nt, Artificial Sequence
  Description of Artificial Sequence: Synthetic oligonucleotide
acuugcauccacauuucc

SEQ ID NO: 130178 - RNA, 18 nt, Artificial Sequence
  Description of Artificial Sequence: Synthetic oligonucleotide
uggugacuugcauccaca

SEQ ID NO: 130179 - RNA, 18 nt, Artificial Sequence
  Description of Artificial Sequence: Synthetic oligonucleotide
gaauuuggugacuugcau

SEQ ID NO: 130180 - RNA, 18 nt, Artificial Sequence
  Description of Artificial Sequence: Synthetic oligonucleotide
gcugggaauuuggugacu

SEQ ID NO: 130181 - RNA, 18 nt, Artificial Sequence
  Description of Artificial Sequence: Synthetic oligonucleotide
ucaaugcugggaauuugg

SEQ ID NO: 130182 - RNA, 18 nt, Artificial Sequence
  Description of Artificial Sequence: Synthetic oligonucleotide
ugacuucaaugcugggaa

SEQ ID NO: 130183 - RNA, 18 nt, Artificial Sequence
  Description of Artificial Sequence: Synthetic oligonucleotide
ugcucugacuucaaugcu

SEQ ID NO: 130184 - RNA, 18 nt, Artificial Sequence
  Description of Artificial Sequence: Synthetic oligonucleotide
gaucgugcucugacuuca

SEQ ID NO: 130185 - RNA, 18 nt, Artificial Sequence
  Description of Artificial Sequence: Synthetic oligonucleotide
acccugaucgugcucuga

SEQ ID NO: 130186 - RNA, 18 nt, Artificial Sequence
  Description of Artificial Sequence: Synthetic oligonucleotide
ggauaacccugaucgugc

SEQ ID NO: 130187 - RNA, 18 nt, Artificial Sequence
  Description of Artificial Sequence: Synthetic oligonucleotide
uccagggauaacccugau

SEQ ID NO: 130188 - RNA, 18 nt, Artificial Sequence
  Description of Artificial Sequence: Synthetic oligonucleotide
guaauuccagggauaacc

SEQ ID NO: 130189 - RNA, 18 nt, Artificial Sequence
  Description of Artificial Sequence: Synthetic oligonucleotide
cacagguaauuccaggga

SEQ ID NO: 130190 - RNA, 18 nt, Artificial Sequence
  Description of Artificial Sequence: Synthetic oligonucleotide
ggaugcacagguaauucc

SEQ ID NO: 130191 - RNA, 18 nt, Artificial Sequence
  Description of Artificial Sequence: Synthetic oligonucleotide
aaaaaggaugcacaggua

SEQ ID NO: 130192 - RNA, 18 nt, Artificial Sequence
  Description of Artificial Sequence: Synthetic oligonucleotide
aaagaaaaaaggaugcac

SEQ ID NO: 130193 - RNA, 18 nt, Artificial Sequence
  Description of Artificial Sequence: Synthetic oligonucleotide
ugucaaaagaaaaaagga

SEQ ID NO: 130194 - RNA, 18 nt, Artificial Sequence
  Description of Artificial Sequence: Synthetic oligonucleotide
gacucugucaaaagaaaa

SEQ ID NO: 130195 - RNA, 18 nt, Artificial Sequence
  Description of Artificial Sequence: Synthetic oligonucleotide
agcaagacucugucaaaa

SEQ ID NO: 130196 - RNA, 18 nt, Artificial Sequence
  Description of Artificial Sequence: Synthetic oligonucleotide
gacagagcaagacucugu

SEQ ID NO: 130197 - RNA, 18 nt, Artificial Sequence
  Description of Artificial Sequence: Synthetic oligonucleotide
ugagugacagagcaagac

SEQ ID NO: 130198 - RNA, 18 nt, Artificial Sequence
  Description of Artificial Sequence: Synthetic oligonucleotide
cagccugagugacagagc

SEQ ID NO: 130199 - RNA, 18 nt, Artificial Sequence
  Description of Artificial Sequence: Synthetic oligonucleotide
cacuccagccugagugac

SEQ ID NO: 130200 - RNA, 18 nt, Artificial Sequence
  Description of Artificial Sequence: Synthetic oligonucleotide
cauugcacuccagccuga

SEQ ID NO: 130201 - RNA, 18 nt, Artificial Sequence
  Description of Artificial Sequence: Synthetic oligonucleotide
cacaucauugcacuccag

SEQ ID NO: 130202 - RNA, 18 nt, Artificial Sequence
  Description of Artificial Sequence: Synthetic oligonucleotide
gagaucacaucauugcac

SEQ ID NO: 130203 - RNA, 18 nt, Artificial Sequence
  Description of Artificial Sequence: Synthetic oligonucleotide
gagccgagaucacaucau

SEQ ID NO: 130204 - RNA, 18 nt, Artificial Sequence
  Description of Artificial Sequence: Synthetic oligonucleotide
gaagugagccgagaucac

SEQ ID NO: 130205 - RNA, 18 nt, Artificial Sequence
  Description of Artificial Sequence: Synthetic oligonucleotide
aggcugaagugagccgag

SEQ ID NO: 130206 - RNA, 18 nt, Artificial Sequence
  Description of Artificial Sequence: Synthetic oligonucleotide
gguggaggcugaagugag

SEQ ID NO: 130207 - RNA, 18 nt, Artificial Sequence
  Description of Artificial Sequence: Synthetic oligonucleotide
uggcggguggaggcugaa

SEQ ID NO: 130208 - RNA, 18 nt, Artificial Sequence
  Description of Artificial Sequence: Synthetic oligonucleotide
gaacguggcggguggagg

SEQ ID NO: 130209 - RNA, 18 nt, Artificial Sequence
  Description of Artificial Sequence: Synthetic oligonucleotide
ugcuugaacguggcgggu

SEQ ID NO: 130210 - RNA, 18 nt, Artificial Sequence
  Description of Artificial Sequence: Synthetic oligonucleotide
agaauugcuugaacgugg

SEQ ID NO: 130211 - RNA, 18 nt, Artificial Sequence
  Description of Artificial Sequence: Synthetic oligonucleotide
gcaggagaauugcuugaa

SEQ ID NO: 130212 - RNA, 18 nt, Artificial Sequence
  Description of Artificial Sequence: Synthetic oligonucleotide
gugaggcaggagaauugc

SEQ ID NO: 130213 - RNA, 18 nt, Artificial Sequence
  Description of Artificial Sequence: Synthetic oligonucleotide
ggagggugaggcaggaga

SEQ ID NO: 130214 - RNA, 18 nt, Artificial Sequence
  Description of Artificial Sequence: Synthetic oligonucleotide
acucuggagggugaggca

SEQ ID NO: 130215 - RNA, 18 nt, Artificial Sequence
  Description of Artificial Sequence: Synthetic oligonucleotide
cagcaacucuggagggug

SEQ ID NO: 130216 - RNA, 18 nt, Artificial Sequence
  Description of Artificial Sequence: Synthetic oligonucleotide
ggucccagcaacucugga

SEQ ID NO: 130217 - RNA, 18 nt, Artificial Sequence
  Description of Artificial Sequence: Synthetic oligonucleotide
ccuguggucccagcaacu

SEQ ID NO: 130218 - RNA, 18 nt, Artificial Sequence
  Description of Artificial Sequence: Synthetic oligonucleotide
gcacgccuguggucccag

SEQ ID NO: 130219 - RNA, 18 nt, Artificial Sequence
  Description of Artificial Sequence: Synthetic oligonucleotide
guggugcacgccuguggu

SEQ ID NO: 130220 - RNA, 18 nt, Artificial Sequence
  Description of Artificial Sequence: Synthetic oligonucleotide
gugugguggugcacgccu

SEQ ID NO: 130221 - RNA, 18 nt, Artificial Sequence
  Description of Artificial Sequence: Synthetic oligonucleotide
gcugggugugguggugca

SEQ ID NO: 130222 - RNA, 18 nt, Artificial Sequence
  Description of Artificial Sequence: Synthetic oligonucleotide
aauuagcuggguguggug

SEQ ID NO: 130223 - RNA, 18 nt, Artificial Sequence
  Description of Artificial Sequence: Synthetic oligonucleotide
acaaaaauuagcugggug

SEQ ID NO: 130224 - RNA, 18 nt, Artificial Sequence
  Description of Artificial Sequence: Synthetic oligonucleotide
aaaauacaaaaauuagcu

SEQ ID NO: 130225 - RNA, 18 nt, Artificial Sequence
  Description of Artificial Sequence: Synthetic oligonucleotide
uacuaaaaauacaaaaau

SEQ ID NO: 130226 - RNA, 18 nt, Artificial Sequence
  Description of Artificial Sequence: Synthetic oligonucleotide
gucucuacuaaaaauaca

SEQ ID NO: 130227 - RNA, 18 nt, Artificial Sequence
  Description of Artificial Sequence: Synthetic oligonucleotide
acccugucucuacuaaaa

SEQ ID NO: 130228 - RNA, 18 nt, Artificial Sequence
  Description of Artificial Sequence: Synthetic oligonucleotide
gugaaacccugucucuac

SEQ ID NO: 130229 - RNA, 18 nt, Artificial Sequence
  Description of Artificial Sequence: Synthetic oligonucleotide
acauggugaaacccuguc

SEQ ID NO: 130230 - RNA, 18 nt, Artificial Sequence
  Description of Artificial Sequence: Synthetic oligonucleotide
ggucaacauggugaaacc

SEQ ID NO: 130231 - RNA, 18 nt, Artificial Sequence
  Description of Artificial Sequence: Synthetic oligonucleotide
agccuggucaacauggug

SEQ ID NO: 130232 - RNA, 18 nt, Artificial Sequence
  Description of Artificial Sequence: Synthetic oligonucleotide
agaccagccuggucaaca

SEQ ID NO: 130233 - RNA, 18 nt, Artificial Sequence
  Description of Artificial Sequence: Synthetic oligonucleotide
guuugagaccagccuggu

SEQ ID NO: 130234 - RNA, 18 nt, Artificial Sequence
  Description of Artificial Sequence: Synthetic oligonucleotide
caggaguuugagaccagc

SEQ ID NO: 130235 - RNA, 18 nt, Artificial Sequence
  Description of Artificial Sequence: Synthetic oligonucleotide
gaggccaggaguuugaga

SEQ ID NO: 130236 - RNA, 18 nt, Artificial Sequence
  Description of Artificial Sequence: Synthetic oligonucleotide
uauuugaggccaggaguu

SEQ ID NO: 130237 - RNA, 18 nt, Artificial Sequence
  Description of Artificial Sequence: Synthetic oligonucleotide
uggauuauuugaggccag

SEQ ID NO: 130238 - RNA, 18 nt, Artificial Sequence
  Description of Artificial Sequence: Synthetic oligonucleotide
gcggguggauuauuugag

SEQ ID NO: 130239 - RNA, 18 nt, Artificial Sequence
  Description of Artificial Sequence: Synthetic oligonucleotide
cugaggcggguggauuau

SEQ ID NO: 130240 - RNA, 18 nt, Artificial Sequence
  Description of Artificial Sequence: Synthetic oligonucleotide
gagcacagucccuggcac

SEQ ID NO: 130241 - RNA, 18 nt, Artificial Sequence
  Description of Artificial Sequence: Synthetic oligonucleotide
gcagugagcacagucccu

SEQ ID NO: 130242 - RNA, 18 nt, Artificial Sequence
  Description of Artificial Sequence: Synthetic oligonucleotide
gcaaagcagugagcacag

SEQ ID NO: 130243 - RNA, 18 nt, Artificial Sequence
  Description of Artificial Sequence: Synthetic oligonucleotide
uguuugcaaagcagugag

SEQ ID NO: 130244 - RNA, 18 nt, Artificial Sequence
  Description of Artificial Sequence: Synthetic oligonucleotide
gguaguguuugcaaagca

SEQ ID NO: 130245 - RNA, 18 nt, Artificial Sequence
  Description of Artificial Sequence: Synthetic oligonucleotide
aaauagguaguguuugca

SEQ ID NO: 130246 - RNA, 18 nt, Artificial Sequence
  Description of Artificial Sequence: Synthetic oligonucleotide
uauuaaaauagguagugu

SEQ ID NO: 130247 - RNA, 18 nt, Artificial Sequence
  Description of Artificial Sequence: Synthetic oligonucleotide
uguuauauuaaaauaggu

SEQ ID NO: 130248 - RNA, 18 nt, Artificial Sequence
  Description of Artificial Sequence: Synthetic oligonucleotide
agcauuguuauauuaaaa

SEQ ID NO: 130249 - RNA, 18 nt, Artificial Sequence
  Description of Artificial Sequence: Synthetic oligonucleotide
cucauagcauuguuauau

SEQ ID NO: 130250 - RNA, 18 nt, Artificial Sequence
  Description of Artificial Sequence: Synthetic oligonucleotide
cuucccucauagcauugu

SEQ ID NO: 130251 - RNA, 18 nt, Artificial Sequence
  Description of Artificial Sequence: Synthetic oligonucleotide
ucgagcuucccucauagc

SEQ ID NO: 130252 - RNA, 18 nt, Artificial Sequence
  Description of Artificial Sequence: Synthetic oligonucleotide
aauaaucgagcuucccuc

SEQ ID NO: 130253 - RNA, 18 nt, Artificial Sequence
  Description of Artificial Sequence: Synthetic oligonucleotide
ggauaaauaaucgagcuu

SEQ ID NO: 130254 - RNA, 18 nt, Artificial Sequence
  Description of Artificial Sequence: Synthetic oligonucleotide
gaugaggauaaauaaucg

SEQ ID NO: 130255 - RNA, 18 nt, Artificial Sequence
  Description of Artificial Sequence: Synthetic oligonucleotide
uauaagaugaggauaaau

SEQ ID NO: 130256 - RNA, 18 nt, Artificial Sequence
  Description of Artificial Sequence: Synthetic oligonucleotide
uuaucuauaagaugagga

SEQ ID NO: 130257 - RNA, 18 nt, Artificial Sequence
  Description of Artificial Sequence: Synthetic oligonucleotide
uuuucuuaucuauaagau

SEQ ID NO: 130258 - RNA, 18 nt, Artificial Sequence
  Description of Artificial Sequence: Synthetic oligonucleotide
cucaguuuucuuaucuau

SEQ ID NO: 130259 - RNA, 18 nt, Artificial Sequence
  Description of Artificial Sequence: Synthetic oligonucleotide
ugugccucaguuuucuua

SEQ ID NO: 130260 - RNA, 18 nt, Artificial Sequence
  Description of Artificial Sequence: Synthetic oligonucleotide
cucucugugccucaguuu

SEQ ID NO: 130261 - RNA, 18 nt, Artificial Sequence
  Description of Artificial Sequence: Synthetic oligonucleotide
uuaaccucucugugccuc

SEQ ID NO: 130262 - RNA, 18 nt, Artificial Sequence
  Description of Artificial Sequence: Synthetic oligonucleotide
guuacuuaaccucucugu

SEQ ID NO: 130263 - RNA, 18 nt, Artificial Sequence
  Description of Artificial Sequence: Synthetic oligonucleotide
gauaaguuacuuaaccuc

SEQ ID NO: 130264 - RNA, 18 nt, Artificial Sequence
  Description of Artificial Sequence: Synthetic oligonucleotide
aguuggauaaguuacuua

SEQ ID NO: 130265 - RNA, 18 nt, Artificial Sequence
  Description of Artificial Sequence: Synthetic oligonucleotide
guuauaguuggauaaguu

SEQ ID NO: 130266 - RNA, 18 nt, Artificial Sequence
  Description of Artificial Sequence: Synthetic oligonucleotide
agcugguuauaguuggau

SEQ ID NO: 130267 - RNA, 18 nt, Artificial Sequence
  Description of Artificial Sequence: Synthetic oligonucleotide
cugauagcugguuauagu

SEQ ID NO: 130268 - RNA, 18 nt, Artificial Sequence
  Description of Artificial Sequence: Synthetic oligonucleotide
ugccccugauagcugguu

SEQ ID NO: 130269 - RNA, 18 nt, Artificial Sequence
  Description of Artificial Sequence: Synthetic oligonucleotide
ggcucugccccugauagc

SEQ ID NO: 130270 - RNA, 18 nt, Artificial Sequence
  Description of Artificial Sequence: Synthetic oligonucleotide
uaaauggcucugccccug

SEQ ID NO: 130271 - RNA, 18 nt, Artificial Sequence
  Description of Artificial Sequence: Synthetic oligonucleotide
cugcuuaaauggcucugc

SEQ ID NO: 130272 - RNA, 18 nt, Artificial Sequence
  Description of Artificial Sequence: Synthetic oligonucleotide
cugcccugcuuaaauggc

SEQ ID NO: 130273 - RNA, 18 nt, Artificial Sequence
  Description of Artificial Sequence: Synthetic oligonucleotide
cugcacugcccugcuuaa

SEQ ID NO: 130274 - RNA, 18 nt, Artificial Sequence
  Description of Artificial Sequence: Synthetic oligonucleotide
uggaacugcacugcccug

SEQ ID NO: 130275 - RNA, 18 nt, Artificial Sequence
  Description of Artificial Sequence: Synthetic oligonucleotide
gauucuggaacugcacug

SEQ ID NO: 130276 - RNA, 18 nt, Artificial Sequence
  Description of Artificial Sequence: Synthetic oligonucleotide
gaccagauucuggaacug

SEQ ID NO: 130277 - RNA, 18 nt, Artificial Sequence
  Description of Artificial Sequence: Synthetic oligonucleotide
uaaaggaccagauucugg

SEQ ID NO: 130278 - RNA, 18 nt, Artificial Sequence
  Description of Artificial Sequence: Synthetic oligonucleotide
aagguuaaaggaccagau

SEQ ID NO: 130279 - RNA, 18 nt, Artificial Sequence
  Description of Artificial Sequence: Synthetic oligonucleotide
gcaucaagguuaaaggac

SEQ ID NO: 130280 - RNA, 18 nt, Artificial Sequence
  Description of Artificial Sequence: Synthetic oligonucleotide
ccaaagcaucaagguuaa

SEQ ID NO: 130281 - RNA, 18 nt, Artificial Sequence
  Description of Artificial Sequence: Synthetic oligonucleotide
aggcaccaaagcaucaag

SEQ ID NO: 130282 - RNA, 18 nt, Artificial Sequence
  Description of Artificial Sequence: Synthetic oligonucleotide
cugauaggcaccaaagca

SEQ ID NO: 130283 - RNA, 18 nt, Artificial Sequence
  Description of Artificial Sequence: Synthetic oligonucleotide
gucaccugauaggcacca

SEQ ID NO: 130284 - RNA, 18 nt, Artificial Sequence
  Description of Artificial Sequence: Synthetic oligonucleotide
caaaggucaccugauagg

SEQ ID NO: 130285 - RNA, 18 nt, Artificial Sequence
  Description of Artificial Sequence: Synthetic oligonucleotide
acauucaaaggucaccug

SEQ ID NO: 130286 - RNA, 18 nt, Artificial Sequence
  Description of Artificial Sequence: Synthetic oligonucleotide
cgaugacauucaaagguc

SEQ ID NO: 130287 - RNA, 18 nt, Artificial Sequence
  Description of Artificial Sequence: Synthetic oligonucleotide
aagaucgaugacauucaa

SEQ ID NO: 130288 - RNA, 18 nt, Artificial Sequence
  Description of Artificial Sequence: Synthetic oligonucleotide
cucacaagaucgaugaca

SEQ ID NO: 130289 - RNA, 18 nt, Artificial Sequence
  Description of Artificial Sequence: Synthetic oligonucleotide
caugacucacaagaucga

SEQ ID NO: 130290 - RNA, 18 nt, Artificial Sequence
  Description of Artificial Sequence: Synthetic oligonucleotide
accaacaugacucacaag

SEQ ID NO: 130291 - RNA, 18 nt, Artificial Sequence
  Description of Artificial Sequence: Synthetic oligonucleotide
cauuuaccaacaugacuc

SEQ ID NO: 130292 - RNA, 18 nt, Artificial Sequence
  Description of Artificial Sequence: Synthetic oligonucleotide
agcuccauuuaccaacau

SEQ ID NO: 130293 - RNA, 18 nt, Artificial Sequence
  Description of Artificial Sequence: Synthetic oligonucleotide
acccaagcuccauuuacc

SEQ ID NO: 130294 - RNA, 18 nt, Artificial Sequence
  Description of Artificial Sequence: Synthetic oligonucleotide
acaugacccaagcuccau

SEQ ID NO: 130295 - RNA, 18 nt, Artificial Sequence
  Description of Artificial Sequence: Synthetic oligonucleotide
cuuucacaugacccaagc

SEQ ID NO: 130296 - RNA, 18 nt, Artificial Sequence
  Description of Artificial Sequence: Synthetic oligonucleotide
gaccucuuucacaugacc

SEQ ID NO: 130297 - RNA, 18 nt, Artificial Sequence
  Description of Artificial Sequence: Synthetic oligonucleotide
ucuaggaccucuuucaca

SEQ ID NO: 130298 - RNA, 18 nt, Artificial Sequence
  Description of Artificial Sequence: Synthetic oligonucleotide
ggcuuucuaggaccucuu

SEQ ID NO: 130299 - RNA, 18 nt, Artificial Sequence
  Description of Artificial Sequence: Synthetic oligonucleotide
aacuuggcuuucuaggac

SEQ ID NO: 130300 - RNA, 18 nt, Artificial Sequence
  Description of Artificial Sequence: Synthetic oligonucleotide
cuuggaacuuggcuuucu

SEQ ID NO: 130301 - RNA, 18 nt, Artificial Sequence
  Description of Artificial Sequence: Synthetic oligonucleotide
cugagcuuggaacuuggc

SEQ ID NO: 130302 - RNA, 18 nt, Artificial Sequence
  Description of Artificial Sequence: Synthetic oligonucleotide
uccggcugagcuuggaac

SEQ ID NO: 130303 - RNA, 18 nt, Artificial Sequence
  Description of Artificial Sequence: Synthetic oligonucleotide
agucauccggcugagcuu

SEQ ID NO: 130304 - RNA, 18 nt, Artificial Sequence
  Description of Artificial Sequence: Synthetic oligonucleotide
ccuugagucauccggcug

SEQ ID NO: 130305 - RNA, 18 nt, Artificial Sequence
  Description of Artificial Sequence: Synthetic oligonucleotide
agcugccuugagucaucc

SEQ ID NO: 130306 - RNA, 18 nt, Artificial Sequence
  Description of Artificial Sequence: Synthetic oligonucleotide
agauaagcugccuugagu

SEQ ID NO: 130307 - RNA, 18 nt, Artificial Sequence
  Description of Artificial Sequence: Synthetic oligonucleotide
ucagaagauaagcugccu

SEQ ID NO: 130308 - RNA, 18 nt, Artificial Sequence
  Description of Artificial Sequence: Synthetic oligonucleotide
cagauucagaagauaagc

SEQ ID NO: 130309 - RNA, 18 nt, Artificial Sequence
  Description of Artificial Sequence: Synthetic oligonucleotide
aggcccagauucagaaga

SEQ ID NO: 130310 - RNA, 18 nt, Artificial Sequence
  Description of Artificial Sequence: Synthetic oligonucleotide
agcugaggcccagauuca

SEQ ID NO: 130311 - RNA, 18 nt, Artificial Sequence
  Description of Artificial Sequence: Synthetic oligonucleotide
aaggaagcugaggcccag

SEQ ID NO: 130312 - RNA, 18 nt, Artificial Sequence
  Description of Artificial Sequence: Synthetic oligonucleotide
cagguaaggaagcugagg

SEQ ID NO: 130313 - RNA, 18 nt, Artificial Sequence
  Description of Artificial Sequence: Synthetic oligonucleotide
uuucacagguaaggaagc

SEQ ID NO: 130314 - RNA, 18 nt, Artificial Sequence
  Description of Artificial Sequence: Synthetic oligonucleotide
ucccauuucacagguaag

SEQ ID NO: 130315 - RNA, 18 nt, Artificial Sequence
  Description of Artificial Sequence: Synthetic oligonucleotide
gugacucccauuucacag

SEQ ID NO: 130316 - RNA, 18 nt, Artificial Sequence
  Description of Artificial Sequence: Synthetic oligonucleotide
ggauggugacucccauuu

SEQ ID NO: 130317 - RNA, 18 nt, Artificial Sequence
  Description of Artificial Sequence: Synthetic oligonucleotide
ugcagggauggugacucc

SEQ ID NO: 130318 - RNA, 18 nt, Artificial Sequence
  Description of Artificial Sequence: Synthetic oligonucleotide
ggaccugcagggauggug

SEQ ID NO: 130319 - RNA, 18 nt, Artificial Sequence
  Description of Artificial Sequence: Synthetic oligonucleotide
gaggaggaccugcaggga

SEQ ID NO: 130320 - RNA, 18 nt, Artificial Sequence
  Description of Artificial Sequence: Synthetic oligonucleotide
ugugggaggaggaccugc

SEQ ID NO: 130321 - RNA, 18 nt, Artificial Sequence
  Description of Artificial Sequence: Synthetic oligonucleotide
gugccugugggaggagga

SEQ ID NO: 130322 - RNA, 18 nt, Artificial Sequence
  Description of Artificial Sequence: Synthetic oligonucleotide
agcuggugccugugggag

SEQ ID NO: 130323 - RNA, 18 nt, Artificial Sequence
  Description of Artificial Sequence: Synthetic oligonucleotide
aagauagcuggugccugu

SEQ ID NO: 130324 - RNA, 18 nt, Artificial Sequence
  Description of Artificial Sequence: Synthetic oligonucleotide
uuggcaagauagcuggug

SEQ ID NO: 130325 - RNA, 18 nt, Artificial Sequence
  Description of Artificial Sequence: Synthetic oligonucleotide
uuaaguuggcaagauagc

SEQ ID NO: 130326 - RNA, 18 nt, Artificial Sequence
  Description of Artificial Sequence: Synthetic oligonucleotide
ggcuuuuaaguuggcaag

SEQ ID NO: 130327 - RNA, 18 nt, Artificial Sequence
  Description of Artificial Sequence: Synthetic oligonucleotide
guuuuggcuuuuaaguug

SEQ ID NO: 130328 - RNA, 18 nt, Artificial Sequence
  Description of Artificial Sequence: Synthetic oligonucleotide
cucuaguuuuggcuuuua

SEQ ID NO: 130329 - RNA, 18 nt, Artificial Sequence
  Description of Artificial Sequence: Synthetic oligonucleotide
cucuccucuaguuuuggc

SEQ ID NO: 130330 - RNA, 18 nt, Artificial Sequence
  Description of Artificial Sequence: Synthetic oligonucleotide
gaccccucuccucuaguu

SEQ ID NO: 130331 - RNA, 18 nt, Artificial Sequence
  Description of Artificial Sequence: Synthetic oligonucleotide
ggguugaccccucuccuc

SEQ ID NO: 130332 - RNA, 18 nt, Artificial Sequence
  Description of Artificial Sequence: Synthetic oligonucleotide
accuuggguugaccccuc

SEQ ID NO: 130333 - RNA, 18 nt, Artificial Sequence
  Description of Artificial Sequence: Synthetic oligonucleotide
aagucaccuuggguugac

SEQ ID NO: 130334 - RNA, 18 nt, Artificial Sequence
  Description of Artificial Sequence: Synthetic oligonucleotide
augggaagucaccuuggg

SEQ ID NO: 130335 - RNA, 18 nt, Artificial Sequence
  Description of Artificial Sequence: Synthetic oligonucleotide
ggaggaugggaagucacc

SEQ ID NO: 130336 - RNA, 18 nt, Artificial Sequence
  Description of Artificial Sequence: Synthetic oligonucleotide
gggagggaggaugggaag

SEQ ID NO: 130337 - RNA, 18 nt, Artificial Sequence
  Description of Artificial Sequence: Synthetic oligonucleotide
gggacaauguagucauug

SEQ ID NO: 130338 - RNA, 18 nt, Artificial Sequence
  Description of Artificial Sequence: Synthetic oligonucleotide
gccgagggacaauguagu

SEQ ID NO: 130339 - RNA, 18 nt, Artificial Sequence
  Description of Artificial Sequence: Synthetic oligonucleotide
gcagugccgagggacaau

SEQ ID NO: 130340 - RNA, 18 nt, Artificial Sequence
  Description of Artificial Sequence: Synthetic oligonucleotide
uccgggcagugccgaggg

SEQ ID NO: 130341 - RNA, 18 nt, Artificial Sequence
  Description of Artificial Sequence: Synthetic oligonucleotide
ccagcuccgggcagugcc

SEQ ID NO: 130342 - RNA, 18 nt, Artificial Sequence
  Description of Artificial Sequence: Synthetic oligonucleotide
cuccgccagcuccgggca

SEQ ID NO: 130343 - RNA, 18 nt, Artificial Sequence
  Description of Artificial Sequence: Synthetic oligonucleotide
cucaucuccgccagcucc

SEQ ID NO: 130344 - RNA, 18 nt, Artificial Sequence
  Description of Artificial Sequence: Synthetic oligonucleotide
cccggcucaucuccgcca

SEQ ID NO: 130345 - RNA, 18 nt, Artificial Sequence
  Description of Artificial Sequence: Synthetic oligonucleotide
ggacacccggcucaucuc

SEQ ID NO: 130346 - RNA, 18 nt, Artificial Sequence
  Description of Artificial Sequence: Synthetic oligonucleotide
cguauggacacccggcuc

SEQ ID NO: 130347 - RNA, 18 nt, Artificial Sequence
  Description of Artificial Sequence: Synthetic oligonucleotide
ggaugcguauggacaccc

SEQ ID NO: 130348 - RNA, 18 nt, Artificial Sequence
  Description of Artificial Sequence: Synthetic oligonucleotide
gucaaggaugcguaugga

SEQ ID NO: 130349 - RNA, 18 nt, Artificial Sequence
  Description of Artificial Sequence: Synthetic oligonucleotide
agcucgucaaggaugcgu

SEQ ID NO: 130350 - RNA, 18 nt, Artificial Sequence
  Description of Artificial Sequence: Synthetic oligonucleotide
gcaccagcucgucaagga

SEQ ID NO: 130351 - RNA, 18 nt, Artificial Sequence
  Description of Artificial Sequence: Synthetic oligonucleotide
gggcagcaccagcucguc

SEQ ID NO: 130352 - RNA, 18 nt, Artificial Sequence
  Description of Artificial Sequence: Synthetic oligonucleotide
uggaagggcagcaccagc

SEQ ID NO: 130353 - RNA, 18 nt, Artificial Sequence
  Description of Artificial Sequence: Synthetic oligonucleotide
gcuccuggaagggcagca

SEQ ID NO: 130354 - RNA, 18 nt, Artificial Sequence
  Description of Artificial Sequence: Synthetic oligonucleotide
cugcagcuccuggaaggg

SEQ ID NO: 130355 - RNA, 18 nt, Artificial Sequence
  Description of Artificial Sequence: Synthetic oligonucleotide
ucgaucugcagcuccugg

SEQ ID NO: 130356 - RNA, 18 nt, Artificial Sequence
  Description of Artificial Sequence: Synthetic oligonucleotide
ugucaucgaucugcagcu

SEQ ID NO: 130357 - RNA, 18 nt, Artificial Sequence
  Description of Artificial Sequence: Synthetic oligonucleotide
cucauugucaucgaucug

SEQ ID NO: 130358 - RNA, 18 nt, Artificial Sequence
  Description of Artificial Sequence: Synthetic oligonucleotide
gcauacucauugucaucg

SEQ ID NO: 130359 - RNA, 18 nt, Artificial Sequence
  Description of Artificial Sequence: Synthetic oligonucleotide
gguaggcauacucauugu

SEQ ID NO: 130360 - RNA, 18 nt, Artificial Sequence
  Description of Artificial Sequence: Synthetic oligonucleotide
uuugagguaggcauacuc

SEQ ID NO: 130361 - RNA, 18 nt, Artificial Sequence
  Description of Artificial Sequence: Synthetic oligonucleotide
auggcuuugagguaggca

SEQ ID NO: 130362 - RNA, 18 nt, Artificial Sequence
  Description of Artificial Sequence: Synthetic oligonucleotide
agaugauggcuuugaggu

SEQ ID NO: 130363 - RNA, 18 nt, Artificial Sequence
  Description of Artificial Sequence: Synthetic oligonucleotide
aaagaagaugauggcuuu

SEQ ID NO: 130364 - RNA, 18 nt, Artificial Sequence
  Description of Artificial Sequence: Synthetic oligonucleotide
gggucaaagaagaugaug

SEQ ID NO: 130365 - RNA, 18 nt, Artificial Sequence
  Description of Artificial Sequence: Synthetic oligonucleotide
ggacaauguagucauugc

SEQ ID NO: 130366 - RNA, 18 nt, Artificial Sequence
  Description of Artificial Sequence: Synthetic oligonucleotide
ccgagggacaauguaguc

SEQ ID NO: 130367 - RNA, 18 nt, Artificial Sequence
  Description of Artificial Sequence: Synthetic oligonucleotide
cagugccgagggacaaug

SEQ ID NO: 130368 - RNA, 18 nt, Artificial Sequence
  Description of Artificial Sequence: Synthetic oligonucleotide
ccgggcagugccgaggga

SEQ ID NO: 130369 - RNA, 18 nt, Artificial Sequence
  Description of Artificial Sequence: Synthetic oligonucleotide
cagcuccgggcagugccg

SEQ ID NO: 130370 - RNA, 18 nt, Artificial Sequence
  Description of Artificial Sequence: Synthetic oligonucleotide
uccgccagcuccgggcag

SEQ ID NO: 130371 - RNA, 18 nt, Artificial Sequence
  Description of Artificial Sequence: Synthetic oligonucleotide
ucaucuccgccagcuccg

SEQ ID NO: 130372 - RNA, 18 nt, Artificial Sequence
  Description of Artificial Sequence: Synthetic oligonucleotide
ccggcucaucuccgccag

SEQ ID NO: 130373 - RNA, 18 nt, Artificial Sequence
  Description of Artificial Sequence: Synthetic oligonucleotide
gacacccggcucaucucc

SEQ ID NO: 130374 - RNA, 18 nt, Artificial Sequence
  Description of Artificial Sequence: Synthetic oligonucleotide
guauggacacccggcuca

SEQ ID NO: 130375 - RNA, 18 nt, Artificial Sequence
  Description of Artificial Sequence: Synthetic oligonucleotide
gaugcguauggacacccg

SEQ ID NO: 130376 - RNA, 18 nt, Artificial Sequence
  Description of Artificial Sequence: Synthetic oligonucleotide
ucaaggaugcguauggac

SEQ ID NO: 130377 - RNA, 18 nt, Artificial Sequence
  Description of Artificial Sequence: Synthetic oligonucleotide
gcucgucaaggaugcgua

SEQ ID NO: 130378 - RNA, 18 nt, Artificial Sequence
  Description of Artificial Sequence: Synthetic oligonucleotide
caccagcucgucaaggau

SEQ ID NO: 130379 - RNA, 18 nt, Artificial Sequence
  Description of Artificial Sequence: Synthetic oligonucleotide
ggcagcaccagcucguca

SEQ ID NO: 130380 - RNA, 18 nt, Artificial Sequence
  Description of Artificial Sequence: Synthetic oligonucleotide
ggaagggcagcaccagcu

SEQ ID NO: 130381 - RNA, 18 nt, Artificial Sequence
  Description of Artificial Sequence: Synthetic oligonucleotide
cuccuggaagggcagcac

SEQ ID NO: 130382 - RNA, 18 nt, Artificial Sequence
  Description of Artificial Sequence: Synthetic oligonucleotide
ugcagcuccuggaagggc

SEQ ID NO: 130383 - RNA, 18 nt, Artificial Sequence
  Description of Artificial Sequence: Synthetic oligonucleotide
cgaucugcagcuccugga

SEQ ID NO: 130384 - RNA, 18 nt, Artificial Sequence
  Description of Artificial Sequence: Synthetic oligonucleotide
gucaucgaucugcagcuc

SEQ ID NO: 130385 - RNA, 18 nt, Artificial Sequence
  Description of Artificial Sequence: Synthetic oligonucleotide
ucauugucaucgaucugc

SEQ ID NO: 130386 - RNA, 18 nt, Artificial Sequence
  Description of Artificial Sequence: Synthetic oligonucleotide
cauacucauugucaucga

SEQ ID NO: 130387 - RNA, 18 nt, Artificial Sequence
  Description of Artificial Sequence: Synthetic oligonucleotide
guaggcauacucauuguc

SEQ ID NO: 130388 - RNA, 18 nt, Artificial Sequence
  Description of Artificial Sequence: Synthetic oligonucleotide
uugagguaggcauacuca

SEQ ID NO: 130389 - RNA, 18 nt, Artificial Sequence
  Description of Artificial Sequence: Synthetic oligonucleotide
uggcuuugagguaggcau

SEQ ID NO: 130390 - RNA, 18 nt, Artificial Sequence
  Description of Artificial Sequence: Synthetic oligonucleotide
gaugauggcuuugaggua

SEQ ID NO: 130391 - RNA, 18 nt, Artificial Sequence
  Description of Artificial Sequence: Synthetic oligonucleotide
aagaagaugauggcuuug

SEQ ID NO: 130392 - RNA, 18 nt, Artificial Sequence
  Description of Artificial Sequence: Synthetic oligonucleotide
ggucaaagaagaugaugg

SEQ ID NO: 130393 - RNA, 18 nt, Artificial Sequence
  Description of Artificial Sequence: Synthetic oligonucleotide
ggcuuaggaggugugcac

SEQ ID NO: 130394 - RNA, 18 nt, Artificial Sequence
  Description of Artificial Sequence: Synthetic oligonucleotide
gggauggcuuaggaggug

SEQ ID NO: 130395 - RNA, 18 nt, Artificial Sequence
  Description of Artificial Sequence: Synthetic oligonucleotide
agucagggauggcuuagg

SEQ ID NO: 130396 - RNA, 18 nt, Artificial Sequence
  Description of Artificial Sequence: Synthetic oligonucleotide
gagagagucagggauggc

SEQ ID NO: 130397 - RNA, 18 nt, Artificial Sequence
  Description of Artificial Sequence: Synthetic oligonucleotide
cuggagagagagucaggg

SEQ ID NO: 130398 - RNA, 18 nt, Artificial Sequence
  Description of Artificial Sequence: Synthetic oligonucleotide
gcguucuggagagagagu

SEQ ID NO: 130399 - RNA, 18 nt, Artificial Sequence
  Description of Artificial Sequence: Synthetic oligonucleotide
gcagagcguucuggagag

SEQ ID NO: 130400 - RNA, 18 nt, Artificial Sequence
  Description of Artificial Sequence: Synthetic oligonucleotide
gucuggcagagcguucug

SEQ ID NO: 130401 - RNA, 18 nt, Artificial Sequence
  Description of Artificial Sequence: Synthetic oligonucleotide
gagaagucuggcagagcg

SEQ ID NO: 130402 - RNA, 18 nt, Artificial Sequence
  Description of Artificial Sequence: Synthetic oligonucleotide
aauaggagaagucuggca

SEQ ID NO: 130403 - RNA, 18 nt, Artificial Sequence
  Description of Artificial Sequence: Synthetic oligonucleotide
aacccaauaggagaaguc

SEQ ID NO: 130404 - RNA, 18 nt, Artificial Sequence
  Description of Artificial Sequence: Synthetic oligonucleotide
uacagaacccaauaggag

SEQ ID NO: 130405 - RNA, 18 nt, Artificial Sequence
  Description of Artificial Sequence: Synthetic oligonucleotide
caguguacagaacccaau

SEQ ID NO: 130406 - RNA, 18 nt, Artificial Sequence
  Description of Artificial Sequence: Synthetic oligonucleotide
gaacucaguguacagaac

SEQ ID NO: 130407 - RNA, 18 nt, Artificial Sequence
  Description of Artificial Sequence: Synthetic oligonucleotide
gcugugaacucaguguac

SEQ ID NO: 130408 - RNA, 18 nt, Artificial Sequence
  Description of Artificial Sequence: Synthetic oligonucleotide
augaggcugugaacucag

SEQ ID NO: 130409 - RNA, 18 nt, Artificial Sequence
  Description of Artificial Sequence: Synthetic oligonucleotide
augagaugaggcugugaa

SEQ ID NO: 130410 - RNA, 18 nt, Artificial Sequence
  Description of Artificial Sequence: Synthetic oligonucleotide
uuaacaugagaugaggcu

SEQ ID NO: 130411 - RNA, 18 nt, Artificial Sequence
  Description of Artificial Sequence: Synthetic oligonucleotide
ugucguuaacaugagaug

SEQ ID NO: 130412 - RNA, 18 nt, Artificial Sequence
  Description of Artificial Sequence: Synthetic oligonucleotide
cuggcugucguuaacaug

SEQ ID NO: 130413 - RNA, 18 nt, Artificial Sequence
  Description of Artificial Sequence: Synthetic oligonucleotide
cucuccuggcugucguua

SEQ ID NO: 130414 - RNA, 18 nt, Artificial Sequence
  Description of Artificial Sequence: Synthetic oligonucleotide
acggccucuccuggcugu

SEQ ID NO: 130415 - RNA, 18 nt, Artificial Sequence
  Description of Artificial Sequence: Synthetic oligonucleotide
ugaaaacggccucuccug

SEQ ID NO: 130416 - RNA, 18 nt, Artificial Sequence
  Description of Artificial Sequence: Synthetic oligonucleotide
uuaaaugaaaacggccuc

SEQ ID NO: 130417 - RNA, 18 nt, Artificial Sequence
  Description of Artificial Sequence: Synthetic oligonucleotide
aucuguuaaaugaaaacg

SEQ ID NO: 130418 - RNA, 18 nt, Artificial Sequence
  Description of Artificial Sequence: Synthetic oligonucleotide
gccucaucuguuaaauga

SEQ ID NO: 130419 - RNA, 18 nt, Artificial Sequence
  Description of Artificial Sequence: Synthetic oligonucleotide
gacuugccucaucuguua

SEQ ID NO: 130420 - RNA, 18 nt, Artificial Sequence
  Description of Artificial Sequence: Synthetic oligonucleotide
aucuugacuugccucauc

SEQ ID NO: 130421 - RNA, 18 nt, Artificial Sequence
  Description of Artificial Sequence: Synthetic oligonucleotide
uucaaaucuugacuugcc

SEQ ID NO: 130422 - RNA, 18 nt, Artificial Sequence
  Description of Artificial Sequence: Synthetic oligonucleotide
gucucuucaaaucuugac

SEQ ID NO: 130423 - RNA, 18 nt, Artificial Sequence
  Description of Artificial Sequence: Synthetic oligonucleotide
auauugucucuucaaauc

SEQ ID NO: 130424 - RNA, 18 nt, Artificial Sequence
  Description of Artificial Sequence: Synthetic oligonucleotide
cggccauauugucucuuc

SEQ ID NO: 130425 - RNA, 18 nt, Artificial Sequence
  Description of Artificial Sequence: Synthetic oligonucleotide
gcgcccggccauauuguc

SEQ ID NO: 130426 - RNA, 18 nt, Artificial Sequence
  Description of Artificial Sequence: Synthetic oligonucleotide
ccacugcgcccggccaua

SEQ ID NO: 130427 - RNA, 18 nt, Artificial Sequence
  Description of Artificial Sequence: Synthetic oligonucleotide
gugagccacugcgcccgg

SEQ ID NO: 130428 - RNA, 18 nt, Artificial Sequence
  Description of Artificial Sequence: Synthetic oligonucleotide
caggugugagccacugcg

SEQ ID NO: 130429 - RNA, 18 nt, Artificial Sequence
  Description of Artificial Sequence: Synthetic oligonucleotide
gauuacaggugugagcca

SEQ ID NO: 130430 - RNA, 18 nt, Artificial Sequence
  Description of Artificial Sequence: Synthetic oligonucleotide
gcugggauuacaggugug

SEQ ID NO: 130431 - RNA, 18 nt, Artificial Sequence
  Description of Artificial Sequence: Synthetic oligonucleotide
aaagugcugggauuacag

SEQ ID NO: 130432 - RNA, 18 nt, Artificial Sequence
  Description of Artificial Sequence: Synthetic oligonucleotide
cucccaaagugcugggau

SEQ ID NO: 130433 - RNA, 18 nt, Artificial Sequence
  Description of Artificial Sequence: Synthetic oligonucleotide
ucagccucccaaagugcu

SEQ ID NO: 130434 - RNA, 18 nt, Artificial Sequence
  Description of Artificial Sequence: Synthetic oligonucleotide
ccgccucagccucccaaa

SEQ ID NO: 130435 - RNA, 18 nt, Artificial Sequence
  Description of Artificial Sequence: Synthetic oligonucleotide
uccgcccgccucagccuc

SEQ ID NO: 130436 - RNA, 18 nt, Artificial Sequence
  Description of Artificial Sequence: Synthetic oligonucleotide
ggugauccgcccgccuca

SEQ ID NO: 130437 - RNA, 18 nt, Artificial Sequence
  Description of Artificial Sequence: Synthetic oligonucleotide
ccucaggugauccgcccg

SEQ ID NO: 130438 - RNA, 18 nt, Artificial Sequence
  Description of Artificial Sequence: Synthetic oligonucleotide
ccugaccucaggugaucc

SEQ ID NO: 130439 - RNA, 18 nt, Artificial Sequence
  Description of Artificial Sequence: Synthetic oligonucleotide
gaaccccugaccucaggu

SEQ ID NO: 130440 - RNA, 18 nt, Artificial Sequence
  Description of Artificial Sequence: Synthetic oligonucleotide
aucuugaaccccugaccu

SEQ ID NO: 130441 - RNA, 18 nt, Artificial Sequence
  Description of Artificial Sequence: Synthetic oligonucleotide
ggcucaucuugaaccccu

SEQ ID NO: 130442 - RNA, 18 nt, Artificial Sequence
  Description of Artificial Sequence: Synthetic oligonucleotide
agccaggcucaucuugaa

SEQ ID NO: 130443 - RNA, 18 nt, Artificial Sequence
  Description of Artificial Sequence: Synthetic oligonucleotide
auguuagccaggcucauc

SEQ ID NO: 130444 - RNA, 18 nt, Artificial Sequence
  Description of Artificial Sequence: Synthetic oligonucleotide
ucuccauguuagccaggc

SEQ ID NO: 130445 - RNA, 18 nt, Artificial Sequence
  Description of Artificial Sequence: Synthetic oligonucleotide
ggguuucuccauguuagc

SEQ ID NO: 130446 - RNA, 18 nt, Artificial Sequence
  Description of Artificial Sequence: Synthetic oligonucleotide
uuguauuuuuaguagaga

SEQ ID NO: 130447 - RNA, 18 nt, Artificial Sequence
  Description of Artificial Sequence: Synthetic oligonucleotide
aauuuuuguauuuuuagu

SEQ ID NO: 130448 - RNA, 18 nt, Artificial Sequence
  Description of Artificial Sequence: Synthetic oligonucleotide
uggcuaauuuuuguauuu

SEQ ID NO: 130449 - RNA, 18 nt, Artificial Sequence
  Description of Artificial Sequence: Synthetic oligonucleotide
augccuggcuaauuuuug

SEQ ID NO: 130450 - RNA, 18 nt, Artificial Sequence
  Description of Artificial Sequence: Synthetic oligonucleotide
ccaccaugccuggcuaau

SEQ ID NO: 130451 - RNA, 18 nt, Artificial Sequence
  Description of Artificial Sequence: Synthetic oligonucleotide
gugcaccaccaugccugg

SEQ ID NO: 130452 - RNA, 18 nt, Artificial Sequence
  Description of Artificial Sequence: Synthetic oligonucleotide
caggcgugcaccaccaug

SEQ ID NO: 130453 - RNA, 18 nt, Artificial Sequence
  Description of Artificial Sequence: Synthetic oligonucleotide
gauuacaggcgugcacca

SEQ ID NO: 130454 - RNA, 18 nt, Artificial Sequence
  Description of Artificial Sequence: Synthetic oligonucleotide
gcugggauuacaggcgug

SEQ ID NO: 130455 - RNA, 18 nt, Artificial Sequence
  Description of Artificial Sequence: Synthetic oligonucleotide
gaauagcugggauuacag

SEQ ID NO: 130456 - RNA, 18 nt, Artificial Sequence
  Description of Artificial Sequence: Synthetic oligonucleotide
cucccgaauagcugggau

SEQ ID NO: 130457 - RNA, 18 nt, Artificial Sequence
  Description of Artificial Sequence: Synthetic oligonucleotide
ucagccucccgaauagcu

SEQ ID NO: 130458 - RNA, 18 nt, Artificial Sequence
  Description of Artificial Sequence: Synthetic oligonucleotide
cugccucagccucccgaa

SEQ ID NO: 130459 - RNA, 18 nt, Artificial Sequence
  Description of Artificial Sequence: Synthetic oligonucleotide
uucuccugccucagccuc

SEQ ID NO: 130460 - RNA, 18 nt, Artificial Sequence
  Description of Artificial Sequence: Synthetic oligonucleotide
agcaauucuccugccuca

SEQ ID NO: 130461 - RNA, 18 nt, Artificial Sequence
  Description of Artificial Sequence: Synthetic oligonucleotide
guucaagcaauucuccug

SEQ ID NO: 130462 - RNA, 18 nt, Artificial Sequence
  Description of Artificial Sequence: Synthetic oligonucleotide
cccagguucaagcaauuc

SEQ ID NO: 130463 - RNA, 18 nt, Artificial Sequence
  Description of Artificial Sequence: Synthetic oligonucleotide
cgccucccagguucaagc

SEQ ID NO: 130464 - RNA, 18 nt, Artificial Sequence
  Description of Artificial Sequence: Synthetic oligonucleotide
accuccgccucccagguu

SEQ ID NO: 130465 - RNA, 18 nt, Artificial Sequence
  Description of Artificial Sequence: Synthetic oligonucleotide
cugcaaccuccgccuccc

SEQ ID NO: 130466 - RNA, 18 nt, Artificial Sequence
  Description of Artificial Sequence: Synthetic oligonucleotide
gcucacugcaaccuccgc

SEQ ID NO: 130467 - RNA, 18 nt, Artificial Sequence
  Description of Artificial Sequence: Synthetic oligonucleotide
ucuuggcucacugcaacc

SEQ ID NO: 130468 - RNA, 18 nt, Artificial Sequence
  Description of Artificial Sequence: Synthetic oligonucleotide
cgggaucuuggcucacug

SEQ ID NO: 130469 - RNA, 18 nt, Artificial Sequence
  Description of Artificial Sequence: Synthetic oligonucleotide
aguggcgggaucuuggcu

SEQ ID NO: 130470 - RNA, 18 nt, Artificial Sequence
  Description of Artificial Sequence: Synthetic oligonucleotide
aaugcaguggcgggaucu

SEQ ID NO: 130471 - RNA, 18 nt, Artificial Sequence
  Description of Artificial Sequence: Synthetic oligonucleotide
gcuggaaugcaguggcgg

SEQ ID NO: 130472 - RNA, 18 nt, Artificial Sequence
  Description of Artificial Sequence: Synthetic oligonucleotide
cccaggcuggaaugcagu

SEQ ID NO: 130473 - RNA, 18 nt, Artificial Sequence
  Description of Artificial Sequence: Synthetic oligonucleotide
agucacccaggcuggaau

SEQ ID NO: 130474 - RNA, 18 nt, Artificial Sequence
  Description of Artificial Sequence: Synthetic oligonucleotide
gauggagucacccaggcu

SEQ ID NO: 130475 - RNA, 18 nt, Artificial Sequence
  Description of Artificial Sequence: Synthetic oligonucleotide
uuugagauggagucaccc

SEQ ID NO: 130476 - RNA, 18 nt, Artificial Sequence
  Description of Artificial Sequence: Synthetic oligonucleotide
guuuuuuugagauggagu

SEQ ID NO: 130477 - RNA, 18 nt, Artificial Sequence
  Description of Artificial Sequence: Synthetic oligonucleotide
uuuuuguuuuuuugagau

SEQ ID NO: 130478 - RNA, 18 nt, Artificial Sequence
  Description of Artificial Sequence: Synthetic oligonucleotide
cuuuguuuuuguuuuuuu

SEQ ID NO: 130479 - RNA, 18 nt, Artificial Sequence
  Description of Artificial Sequence: Synthetic oligonucleotide
ccucccuuuguuuuuguu

SEQ ID NO: 130480 - RNA, 18 nt, Artificial Sequence
  Description of Artificial Sequence: Synthetic oligonucleotide
cauauccucccuuuguuu

SEQ ID NO: 130481 - RNA, 18 nt, Artificial Sequence
  Description of Artificial Sequence: Synthetic oligonucleotide
caagucauauccucccuu

SEQ ID NO: 130482 - RNA, 18 nt, Artificial Sequence
  Description of Artificial Sequence: Synthetic oligonucleotide
ccugucaagucauauccu

SEQ ID NO: 130483 - RNA, 18 nt, Artificial Sequence
  Description of Artificial Sequence: Synthetic oligonucleotide
ggugcccugucaagucau

SEQ ID NO: 130484 - RNA, 18 nt, Artificial Sequence
  Description of Artificial Sequence: Synthetic oligonucleotide
gucagggugcccugucaa

SEQ ID NO: 130485 - RNA, 18 nt, Artificial Sequence
  Description of Artificial Sequence: Synthetic oligonucleotide
uuggagucagggugcccu

SEQ ID NO: 130486 - RNA, 18 nt, Artificial Sequence
  Description of Artificial Sequence: Synthetic oligonucleotide
ggccuuuggagucagggu

SEQ ID NO: 130487 - RNA, 18 nt, Artificial Sequence
  Description of Artificial Sequence: Synthetic oligonucleotide
gcccaggccuuuggaguc

SEQ ID NO: 130488 - RNA, 18 nt, Artificial Sequence
  Description of Artificial Sequence: Synthetic oligonucleotide
ggaaagcccaggccuuug

SEQ ID NO: 130489 - RNA, 18 nt, Artificial Sequence
  Description of Artificial Sequence: Synthetic oligonucleotide
acucagguuagguuucac

SEQ ID NO: 130490 - RNA, 18 nt, Artificial Sequence
  Description of Artificial Sequence: Synthetic oligonucleotide
uagggacucagguuaggu

SEQ ID NO: 130491 - RNA, 18 nt, Artificial Sequence
  Description of Artificial Sequence: Synthetic oligonucleotide
caccuuagggacucaggu

SEQ ID NO: 130492 - RNA, 18 nt, Artificial Sequence
  Description of Artificial Sequence: Synthetic oligonucleotide
ccuaucaccuuagggacu

SEQ ID NO: 130493 - RNA, 18 nt, Artificial Sequence
  Description of Artificial Sequence: Synthetic oligonucleotide
ugcuuccuaucaccuuag

SEQ ID NO: 130494 - RNA, 18 nt, Artificial Sequence
  Description of Artificial Sequence: Synthetic oligonucleotide
guuccugcuuccuaucac

SEQ ID NO: 130495 - RNA, 18 nt, Artificial Sequence
  Description of Artificial Sequence: Synthetic oligonucleotide
cccugguuccugcuuccu

SEQ ID NO: 130496 - RNA, 18 nt, Artificial Sequence
  Description of Artificial Sequence: Synthetic oligonucleotide
cccuucccugguuccugc

SEQ ID NO: 130497 - RNA, 18 nt, Artificial Sequence
  Description of Artificial Sequence: Synthetic oligonucleotide
ggcuccccuucccugguu

SEQ ID NO: 130498 - RNA, 18 nt, Artificial Sequence
  Description of Artificial Sequence: Synthetic oligonucleotide
gaauaggcuccccuuccc

SEQ ID NO: 130499 - RNA, 18 nt, Artificial Sequence
  Description of Artificial Sequence: Synthetic oligonucleotide
uguuagaauaggcucccc

SEQ ID NO: 130500 - RNA, 18 nt, Artificial Sequence
  Description of Artificial Sequence: Synthetic oligonucleotide
uacuguguuagaauaggc

SEQ ID NO: 130501 - RNA, 18 nt, Artificial Sequence
  Description of Artificial Sequence: Synthetic oligonucleotide
gcuucuacuguguuagaa

SEQ ID NO: 130502 - RNA, 18 nt, Artificial Sequence
  Description of Artificial Sequence: Synthetic oligonucleotide
uugcugcuucuacugugu

SEQ ID NO: 130503 - RNA, 18 nt, Artificial Sequence
  Description of Artificial Sequence: Synthetic oligonucleotide
agcaguugcugcuucuac

SEQ ID NO: 130504 - RNA, 18 nt, Artificial Sequence
  Description of Artificial Sequence: Synthetic oligonucleotide
accucagcaguugcugcu

SEQ ID NO: 130505 - RNA, 18 nt, Artificial Sequence
  Description of Artificial Sequence: Synthetic oligonucleotide
uccagaccucagcaguug

SEQ ID NO: 130506 - RNA, 18 nt, Artificial Sequence
  Description of Artificial Sequence: Synthetic oligonucleotide
ccucauccagaccucagc

SEQ ID NO: 130507 - RNA, 18 nt, Artificial Sequence
  Description of Artificial Sequence: Synthetic oligonucleotide
gguccccucauccagacc

SEQ ID NO: 130508 - RNA, 18 nt, Artificial Sequence
  Description of Artificial Sequence: Synthetic oligonucleotide
guugagguccccucaucc

SEQ ID NO: 130509 - RNA, 18 nt, Artificial Sequence
  Description of Artificial Sequence: Synthetic oligonucleotide
ccacaguugagguccccu

SEQ ID NO: 130510 - RNA, 18 nt, Artificial Sequence
  Description of Artificial Sequence: Synthetic oligonucleotide
uugggccacaguugaggu

SEQ ID NO: 130511 - RNA, 18 nt, Artificial Sequence
  Description of Artificial Sequence: Synthetic oligonucleotide
ggguuuugggccacaguu

SEQ ID NO: 130512 - RNA, 18 nt, Artificial Sequence
  Description of Artificial Sequence: Synthetic oligonucleotide
ccacaaugggaacuuggg

SEQ ID NO: 130513 - RNA, 18 nt, Artificial Sequence
  Description of Artificial Sequence: Synthetic oligonucleotide
gccacaaugggaacuugg

SEQ ID NO: 130514 - RNA, 18 nt, Artificial Sequence
  Description of Artificial Sequence: Synthetic oligonucleotide
gcagagccacaaugggaa

SEQ ID NO: 130515 - RNA, 18 nt, Artificial Sequence
  Description of Artificial Sequence: Synthetic oligonucleotide
uguuggcagagccacaau

SEQ ID NO: 130516 - RNA, 18 nt, Artificial Sequence
  Description of Artificial Sequence: Synthetic oligonucleotide
ccaguuguuggcagagcc

SEQ ID NO: 130517 - RNA, 18 nt, Artificial Sequence
  Description of Artificial Sequence: Synthetic oligonucleotide
cacagccaguuguuggca

SEQ ID NO: 130518 - RNA, 18 nt, Artificial Sequence
  Description of Artificial Sequence: Synthetic oligonucleotide
ggucgcacagccaguugu

SEQ ID NO: 130519 - RNA, 18 nt, Artificial Sequence
  Description of Artificial Sequence: Synthetic oligonucleotide
uccugggucgcacagcca

SEQ ID NO: 130520 - RNA, 18 nt, Artificial Sequence
  Description of Artificial Sequence: Synthetic oligonucleotide
acuuguccugggucgcac

SEQ ID NO: 130521 - RNA, 18 nt, Artificial Sequence
  Description of Artificial Sequence: Synthetic oligonucleotide
auaggacuuguccugggu

SEQ ID NO: 130522 - RNA, 18 nt, Artificial Sequence
  Description of Artificial Sequence: Synthetic oligonucleotide
caaagauaggacuugucc

SEQ ID NO: 130523 - RNA, 18 nt, Artificial Sequence
  Description of Artificial Sequence: Synthetic oligonucleotide
cagugcaaagauaggacu

SEQ ID NO: 130524 - RNA, 18 nt, Artificial Sequence
  Description of Artificial Sequence: Synthetic oligonucleotide
agacacagugcaaagaua

SEQ ID NO: 130525 - RNA, 18 nt, Artificial Sequence
  Description of Artificial Sequence: Synthetic oligonucleotide
aacccagacacagugcaa

SEQ ID NO: 130526 - RNA, 18 nt, Artificial Sequence
  Description of Artificial Sequence: Synthetic oligonucleotide
ccucaucuuacacacggg

SEQ ID NO: 130527 - RNA, 18 nt, Artificial Sequence
  Description of Artificial Sequence: Synthetic oligonucleotide
aaccgccucaucuuacac

SEQ ID NO: 130528 - RNA, 18 nt, Artificial Sequence
  Description of Artificial Sequence: Synthetic oligonucleotide
cuagcaaccgccucaucu

SEQ ID NO: 130529 - RNA, 18 nt, Artificial Sequence
  Description of Artificial Sequence: Synthetic oligonucleotide
agcaccuagcaaccgccu

SEQ ID NO: 130530 - RNA, 18 nt, Artificial Sequence
  Description of Artificial Sequence: Synthetic oligonucleotide
caauaagcaccuagcaac

SEQ ID NO: 130531 - RNA, 18 nt, Artificial Sequence
  Description of Artificial Sequence: Synthetic oligonucleotide
gcauccaauaagcaccua

SEQ ID NO: 130532 - RNA, 18 nt, Artificial Sequence
  Description of Artificial Sequence: Synthetic oligonucleotide
ggaaugcauccaauaagc

SEQ ID NO: 130533 - RNA, 18 nt, Artificial Sequence
  Description of Artificial Sequence: Synthetic oligonucleotide
cuugaggaaugcauccaa

SEQ ID NO: 130534 - RNA, 18 nt, Artificial Sequence
  Description of Artificial Sequence: Synthetic oligonucleotide
cgggacuugaggaaugca

SEQ ID NO: 130535 - RNA, 18 nt, Artificial Sequence
  Description of Artificial Sequence: Synthetic oligonucleotide
gagggcgggacuugagga

SEQ ID NO: 130536 - RNA, 18 nt, Artificial Sequence
  Description of Artificial Sequence: Synthetic oligonucleotide
agauggagggcgggacuu

SEQ ID NO: 130537 - RNA, 18 nt, Artificial Sequence
  Description of Artificial Sequence: Synthetic oligonucleotide
auaggagauggagggcgg

SEQ ID NO: 130538 - RNA, 18 nt, Artificial Sequence
  Description of Artificial Sequence: Synthetic oligonucleotide
cuaaaccagaagagaggg

SEQ ID NO: 130539 - RNA, 18 nt, Artificial Sequence
  Description of Artificial Sequence: Synthetic oligonucleotide
aagcacuaaaccagaaga

SEQ ID NO: 130540 - RNA, 18 nt, Artificial Sequence
  Description of Artificial Sequence: Synthetic oligonucleotide
uccuaaagcacuaaacca

SEQ ID NO: 130541 - RNA, 18 nt, Artificial Sequence
  Description of Artificial Sequence: Synthetic oligonucleotide
acauuuccuaaagcacua

SEQ ID NO: 130542 - RNA, 18 nt, Artificial Sequence
  Description of Artificial Sequence: Synthetic oligonucleotide
cugccacauuuccuaaag

SEQ ID NO: 130543 - RNA, 18 nt, Artificial Sequence
  Description of Artificial Sequence: Synthetic oligonucleotide
gauuucugccacauuucc

SEQ ID NO: 130544 - RNA, 18 nt, Artificial Sequence
  Description of Artificial Sequence: Synthetic oligonucleotide
aaaaagauuucugccaca

SEQ ID NO: 130545 - RNA, 18 nt, Artificial Sequence
  Description of Artificial Sequence: Synthetic oligonucleotide
ggcagaaaaagauuucug

SEQ ID NO: 130546 - RNA, 18 nt, Artificial Sequence
  Description of Artificial Sequence: Synthetic oligonucleotide
acacaggcagaaaaagau

SEQ ID NO: 130547 - RNA, 18 nt, Artificial Sequence
  Description of Artificial Sequence: Synthetic oligonucleotide
ccuagacacaggcagaaa

SEQ ID NO: 130548 - RNA, 18 nt, Artificial Sequence
  Description of Artificial Sequence: Synthetic oligonucleotide
gauuuccuagacacaggc

SEQ ID NO: 130549 - RNA, 18 nt, Artificial Sequence
  Description of Artificial Sequence: Synthetic oligonucleotide
auuaugauuuccuagaca

SEQ ID NO: 130550 - RNA, 18 nt, Artificial Sequence
  Description of Artificial Sequence: Synthetic oligonucleotide
caugaauuaugauuuccu

SEQ ID NO: 130551 - RNA, 18 nt, Artificial Sequence
  Description of Artificial Sequence: Synthetic oligonucleotide
gccagcaugaauuaugau

SEQ ID NO: 130552 - RNA, 18 nt, Artificial Sequence
  Description of Artificial Sequence: Synthetic oligonucleotide
gguacgccagcaugaauu

SEQ ID NO: 130553 - RNA, 18 nt, Artificial Sequence
  Description of Artificial Sequence: Synthetic oligonucleotide
accaggguacgccagcau

SEQ ID NO: 130554 - RNA, 18 nt, Artificial Sequence
  Description of Artificial Sequence: Synthetic oligonucleotide
caacaaccaggguacgcc

SEQ ID NO: 130555 - RNA, 18 nt, Artificial Sequence
  Description of Artificial Sequence: Synthetic oligonucleotide
gaccucaacaaccagggu

SEQ ID NO: 130556 - RNA, 18 nt, Artificial Sequence
  Description of Artificial Sequence: Synthetic oligonucleotide
ucagggaccucaacaacc

SEQ ID NO: 130557 - RNA, 18 nt, Artificial Sequence
  Description of Artificial Sequence: Synthetic oligonucleotide
aggauucagggaccucaa

SEQ ID NO: 130558 - RNA, 18 nt, Artificial Sequence
  Description of Artificial Sequence: Synthetic oligonucleotide
gcacaaggauucagggac

SEQ ID NO: 130559 - RNA, 18 nt, Artificial Sequence
  Description of Artificial Sequence: Synthetic oligonucleotide
ugugggcacaaggauuca

SEQ ID NO: 130560 - RNA, 18 nt, Artificial Sequence
  Description of Artificial Sequence: Synthetic oligonucleotide
agcagugugggcacaagg

SEQ ID NO: 130561 - RNA, 18 nt, Artificial Sequence
  Description of Artificial Sequence: Synthetic oligonucleotide
ucuucagcagugugggca

SEQ ID NO: 130562 - RNA, 18 nt, Artificial Sequence
  Description of Artificial Sequence: Synthetic oligonucleotide
aggagucuucagcagugu

SEQ ID NO: 130563 - RNA, 18 nt, Artificial Sequence
  Description of Artificial Sequence: Synthetic oligonucleotide
acacaaggagucuucagc

SEQ ID NO: 130564 - RNA, 18 nt, Artificial Sequence
  Description of Artificial Sequence: Synthetic oligonucleotide
guaucacacaaggagucu

SEQ ID NO: 130565 - RNA, 18 nt, Artificial Sequence
  Description of Artificial Sequence: Synthetic oligonucleotide
gacuuguaucacacaagg

SEQ ID NO: 130566 - RNA, 18 nt, Artificial Sequence
  Description of Artificial Sequence: Synthetic oligonucleotide
ccccugacuuguaucaca

SEQ ID NO: 130567 - RNA, 18 nt, Artificial Sequence
  Description of Artificial Sequence: Synthetic oligonucleotide
gauguccccugacuugua

SEQ ID NO: 130568 - RNA, 18 nt, Artificial Sequence
  Description of Artificial Sequence: Synthetic oligonucleotide
acccagauguccccugac

SEQ ID NO: 130569 - RNA, 18 nt, Artificial Sequence
  Description of Artificial Sequence: Synthetic oligonucleotide
ucaagacccagauguccc

SEQ ID NO: 130570 - RNA, 18 nt, Artificial Sequence
  Description of Artificial Sequence: Synthetic oligonucleotide
gggagucaagacccagau

SEQ ID NO: 130571 - RNA, 18 nt, Artificial Sequence
  Description of Artificial Sequence: Synthetic oligonucleotide
ccagcuggagcaucuggg

SEQ ID NO: 130572 - RNA, 18 nt, Artificial Sequence
  Description of Artificial Sequence: Synthetic oligonucleotide
ggguccagcuggagcauc

SEQ ID NO: 130573 - RNA, 18 nt, Artificial Sequence
  Description of Artificial Sequence: Synthetic oligonucleotide
cagcaggguccagcugga

SEQ ID NO: 130574 - RNA, 18 nt, Artificial Sequence
  Description of Artificial Sequence: Synthetic oligonucleotide
gagggcagcaggguccag

SEQ ID NO: 130575 - RNA, 18 nt, Artificial Sequence
  Description of Artificial Sequence: Synthetic oligonucleotide
caagggagggcagcaggg

SEQ ID NO: 130576 - RNA, 18 nt, Artificial Sequence
  Description of Artificial Sequence: Synthetic oligonucleotide
gugggcaagggagggcag

SEQ ID NO: 130577 - RNA, 18 nt, Artificial Sequence
  Description of Artificial Sequence: Synthetic oligonucleotide
ucgcucagccccuuggca

SEQ ID NO: 130578 - RNA, 18 nt, Artificial Sequence
  Description of Artificial Sequence: Synthetic oligonucleotide
cuggaucgcucagccccu

SEQ ID NO: 130579 - RNA, 18 nt, Artificial Sequence
  Description of Artificial Sequence: Synthetic oligonucleotide
cuucccuggaucgcucag

SEQ ID NO: 130580 - RNA, 18 nt, Artificial Sequence
  Description of Artificial Sequence: Synthetic oligonucleotide
uugaucuucccuggaucg

SEQ ID NO: 130581 - RNA, 18 nt, Artificial Sequence
  Description of Artificial Sequence: Synthetic oligonucleotide
gccgcuugaucuucccug

SEQ ID NO: 130582 - RNA, 18 nt, Artificial Sequence
  Description of Artificial Sequence: Synthetic oligonucleotide
acgcagccgcuugaucuu

SEQ ID NO: 130583 - RNA, 18 nt, Artificial Sequence
  Description of Artificial Sequence: Synthetic oligonucleotide
ugggaacgcagccgcuug

SEQ ID NO: 130584 - RNA, 18 nt, Artificial Sequence
  Description of Artificial Sequence: Synthetic oligonucleotide
gcaccugggaacgcagcc

SEQ ID NO: 130585 - RNA, 18 nt, Artificial Sequence
  Description of Artificial Sequence: Synthetic oligonucleotide
caccugcaccugggaacg

SEQ ID NO: 130586 - RNA, 18 nt, Artificial Sequence
  Description of Artificial Sequence: Synthetic oligonucleotide
aagcucaccugcaccugg

SEQ ID NO: 130587 - RNA, 18 nt, Artificial Sequence
  Description of Artificial Sequence: Synthetic oligonucleotide
ccuccaagcucaccugca

SEQ ID NO: 130588 - RNA, 18 nt, Artificial Sequence
  Description of Artificial Sequence: Synthetic oligonucleotide
guaguccuccaagcucac

SEQ ID NO: 130589 - RNA, 18 nt, Artificial Sequence
  Description of Artificial Sequence: Synthetic oligonucleotide
uugauguaguccuccaag

SEQ ID NO: 130590 - RNA, 18 nt, Artificial Sequence
  Description of Artificial Sequence: Synthetic oligonucleotide
ggucguugauguaguccu

SEQ ID NO: 130591 - RNA, 18 nt, Artificial Sequence
  Description of Artificial Sequence: Synthetic oligonucleotide
cuggcggucguugaugua

SEQ ID NO: 130592 - RNA, 18 nt, Artificial Sequence
  Description of Artificial Sequence: Synthetic oligonucleotide
ucauacuggcggucguug

SEQ ID NO: 130593 - RNA, 18 nt, Artificial Sequence
  Description of Artificial Sequence: Synthetic oligonucleotide
gcgagucauacuggcggu

SEQ ID NO: 130594 - RNA, 18 nt, Artificial Sequence
  Description of Artificial Sequence: Synthetic oligonucleotide
gccacgcgagucauacug

SEQ ID NO: 130595 - RNA, 18 nt, Artificial Sequence
  Description of Artificial Sequence: Synthetic oligonucleotide
aagcggccacgcgaguca

SEQ ID NO: 130596 - RNA, 18 nt, Artificial Sequence
  Description of Artificial Sequence: Synthetic oligonucleotide
cuccaaagcggccacgcg

SEQ ID NO: 130597 - RNA, 18 nt, Artificial Sequence
  Description of Artificial Sequence: Synthetic oligonucleotide
cagcucuccaaagcggcc

SEQ ID NO: 130598 - RNA, 18 nt, Artificial Sequence
  Description of Artificial Sequence: Synthetic oligonucleotide
agcagcagcucuccaaag

SEQ ID NO: 130599 - RNA, 18 nt, Artificial Sequence
  Description of Artificial Sequence: Synthetic oligonucleotide
gcagcagcagcagcucuc

SEQ ID NO: 130600 - RNA, 18 nt, Artificial Sequence
  Description of Artificial Sequence: Synthetic oligonucleotide
gggcagcagcagcagcag

SEQ ID NO: 130601 - RNA, 18 nt, Artificial Sequence
  Description of Artificial Sequence: Synthetic oligonucleotide
aaggugggcagcagcagc

SEQ ID NO: 130602 - RNA, 18 nt, Artificial Sequence
  Description of Artificial Sequence: Synthetic oligonucleotide
ucugcaaggugggcagca

SEQ ID NO: 130603 - RNA, 18 nt, Artificial Sequence
  Description of Artificial Sequence: Synthetic oligonucleotide
gaugcucugcaagguggg

SEQ ID NO: 130604 - RNA, 18 nt, Artificial Sequence
  Description of Artificial Sequence: Synthetic oligonucleotide
caggugaugcucugcaag

SEQ ID NO: 130605 - RNA, 18 nt, Artificial Sequence
  Description of Artificial Sequence: Synthetic oligonucleotide
ucugccaggugaugcucu

SEQ ID NO: 130606 - RNA, 18 nt, Artificial Sequence
  Description of Artificial Sequence: Synthetic oligonucleotide
gaucaucugccaggugau

SEQ ID NO: 130607 - RNA, 18 nt, Artificial Sequence
  Description of Artificial Sequence: Synthetic oligonucleotide
ugcucgaucaucugccag

SEQ ID NO: 130608 - RNA, 18 nt, Artificial Sequence
  Description of Artificial Sequence: Synthetic oligonucleotide
ggaucugcucgaucaucu

SEQ ID NO: 130609 - RNA, 18 nt, Artificial Sequence
  Description of Artificial Sequence: Synthetic oligonucleotide
gaacuggaucugcucgau

SEQ ID NO: 130610 - RNA, 18 nt, Artificial Sequence
  Description of Artificial Sequence: Synthetic oligonucleotide
uugaugaacuggaucugc

SEQ ID NO: 130611 - RNA, 18 nt, Artificial Sequence
  Description of Artificial Sequence: Synthetic oligonucleotide
agagcuugaugaacugga

SEQ ID NO: 130612 - RNA, 18 nt, Artificial Sequence
  Description of Artificial Sequence: Synthetic oligonucleotide
gccgaagagcuugaugaa

SEQ ID NO: 130613 - RNA, 18 nt, Artificial Sequence
  Description of Artificial Sequence: Synthetic oligonucleotide
gccaugccgaagagcuug

SEQ ID NO: 130614 - RNA, 18 nt, Artificial Sequence
  Description of Artificial Sequence: Synthetic oligonucleotide
ucuuggccaugccgaaga

SEQ ID NO: 130615 - RNA, 18 nt, Artificial Sequence
  Description of Artificial Sequence: Synthetic oligonucleotide
gucaaucuuggccaugcc

SEQ ID NO: 130616 - RNA, 18 nt, Artificial Sequence
  Description of Artificial Sequence: Synthetic oligonucleotide
agguugucaaucuuggcc

SEQ ID NO: 130617 - RNA, 18 nt, Artificial Sequence
  Description of Artificial Sequence: Synthetic oligonucleotide
gcaacagguugucaaucu

SEQ ID NO: 130618 - RNA, 18 nt, Artificial Sequence
  Description of Artificial Sequence: Synthetic oligonucleotide
cuccugcaacagguuguc

SEQ ID NO: 130619 - RNA, 18 nt, Artificial Sequence
  Description of Artificial Sequence: Synthetic oligonucleotide
agcaucuccugcaacagg

SEQ ID NO: 130620 - RNA, 18 nt, Artificial Sequence
  Description of Artificial Sequence: Synthetic oligonucleotide
ccagcagcaucuccugca

SEQ ID NO: 130621 - RNA, 18 nt, Artificial Sequence
  Description of Artificial Sequence: Synthetic oligonucleotide
ucgcucagccccuuggca

SEQ ID NO: 130622 - RNA, 18 nt, Artificial Sequence
  Description of Artificial Sequence: Synthetic oligonucleotide
cuggaucgcucagccccu

SEQ ID NO: 130623 - RNA, 18 nt, Artificial Sequence
  Description of Artificial Sequence: Synthetic oligonucleotide
cuucccuggaucgcucag

SEQ ID NO: 130624 - RNA, 18 nt, Artificial Sequence
  Description of Artificial Sequence: Synthetic oligonucleotide
uugaucuucccuggaucg

SEQ ID NO: 130625 - RNA, 18 nt, Artificial Sequence
  Description of Artificial Sequence: Synthetic oligonucleotide
gccgcuugaucuucccug

SEQ ID NO: 130626 - RNA, 18 nt, Artificial Sequence
  Description of Artificial Sequence: Synthetic oligonucleotide
acgcagccgcuugaucuu

SEQ ID NO: 130627 - RNA, 18 nt, Artificial Sequence
  Description of Artificial Sequence: Synthetic oligonucleotide
ugggaacgcagccgcuug

SEQ ID NO: 130628 - RNA, 18 nt, Artificial Sequence
  Description of Artificial Sequence: Synthetic oligonucleotide
gcaccugggaacgcagcc

SEQ ID NO: 130629 - RNA, 18 nt, Artificial Sequence
  Description of Artificial Sequence: Synthetic oligonucleotide
caccugcaccugggaacg

SEQ ID NO: 130630 - RNA, 18 nt, Artificial Sequence
  Description of Artificial Sequence: Synthetic oligonucleotide
aagcucaccugcaccugg

SEQ ID NO: 130631 - RNA, 18 nt, Artificial Sequence
  Description of Artificial Sequence: Synthetic oligonucleotide
ccuccaagcucaccugca

SEQ ID NO: 130632 - RNA, 18 nt, Artificial Sequence
  Description of Artificial Sequence: Synthetic oligonucleotide
guaguccuccaagcucac

SEQ ID NO: 130633 - RNA, 18 nt, Artificial Sequence
  Description of Artificial Sequence: Synthetic oligonucleotide
uugauguaguccuccaag

SEQ ID NO: 130634 - RNA, 18 nt, Artificial Sequence
  Description of Artificial Sequence: Synthetic oligonucleotide
ggucguugauguaguccu

SEQ ID NO: 130635 - RNA, 18 nt, Artificial Sequence
  Description of Artificial Sequence: Synthetic oligonucleotide
cuggcggucguugaugua

SEQ ID NO: 130636 - RNA, 18 nt, Artificial Sequence
  Description of Artificial Sequence: Synthetic oligonucleotide
ucauacuggcggucguug

SEQ ID NO: 130637 - RNA, 18 nt, Artificial Sequence
  Description of Artificial Sequence: Synthetic oligonucleotide
gcgagucauacuggcggu

SEQ ID NO: 130638 - RNA, 18 nt, Artificial Sequence
  Description of Artificial Sequence: Synthetic oligonucleotide
gccacgcgagucauacug

SEQ ID NO: 130639 - RNA, 18 nt, Artificial Sequence
  Description of Artificial Sequence: Synthetic oligonucleotide
aagcggccacgcgaguca

SEQ ID NO: 130640 - RNA, 18 nt, Artificial Sequence
  Description of Artificial Sequence: Synthetic oligonucleotide
cuccaaagcggccacgcg

SEQ ID NO: 130641 - RNA, 18 nt, Artificial Sequence
  Description of Artificial Sequence: Synthetic oligonucleotide
cagcucuccaaagcggcc

SEQ ID NO: 130642 - RNA, 18 nt, Artificial Sequence
  Description of Artificial Sequence: Synthetic oligonucleotide
agcagcagcucuccaaag

SEQ ID NO: 130643 - RNA, 18 nt, Artificial Sequence
  Description of Artificial Sequence: Synthetic oligonucleotide
gcagcagcagcagcucuc

SEQ ID NO: 130644 - RNA, 18 nt, Artificial Sequence
  Description of Artificial Sequence: Synthetic oligonucleotide
gggcagcagcagcagcag

SEQ ID NO: 130645 - RNA, 18 nt, Artificial Sequence
  Description of Artificial Sequence: Synthetic oligonucleotide
aaggugggcagcagcagc

SEQ ID NO: 130646 - RNA, 18 nt, Artificial Sequence
  Description of Artificial Sequence: Synthetic oligonucleotide
ucugcaaggugggcagca

SEQ ID NO: 130647 - RNA, 18 nt, Artificial Sequence
  Description of Artificial Sequence: Synthetic oligonucleotide
gaugcucugcaagguggg

SEQ ID NO: 130648 - RNA, 18 nt, Artificial Sequence
  Description of Artificial Sequence: Synthetic oligonucleotide
caggugaugcucugcaag

SEQ ID NO: 130649 - RNA, 18 nt, Artificial Sequence
  Description of Artificial Sequence: Synthetic oligonucleotide
ucugccaggugaugcucu

SEQ ID NO: 130650 - RNA, 18 nt, Artificial Sequence
  Description of Artificial Sequence: Synthetic oligonucleotide
gaucaucugccaggugau

SEQ ID NO: 130651 - RNA, 18 nt, Artificial Sequence
  Description of Artificial Sequence: Synthetic oligonucleotide
ugcucgaucaucugccag

SEQ ID NO: 130652 - RNA, 18 nt, Artificial Sequence
  Description of Artificial Sequence: Synthetic oligonucleotide
ggaucugcucgaucaucu

SEQ ID NO: 130653 - RNA, 18 nt, Artificial Sequence
  Description of Artificial Sequence: Synthetic oligonucleotide
gaacuggaucugcucgau

SEQ ID NO: 130654 - RNA, 18 nt, Artificial Sequence
  Description of Artificial Sequence: Synthetic oligonucleotide
uugaugaacuggaucugc

SEQ ID NO: 130655 - RNA, 18 nt, Artificial Sequence
  Description of Artificial Sequence: Synthetic oligonucleotide
agagcuugaugaacugga

SEQ ID NO: 130656 - RNA, 18 nt, Artificial Sequence
  Description of Artificial Sequence: Synthetic oligonucleotide
gccgaagagcuugaugaa

SEQ ID NO: 130657 - RNA, 18 nt, Artificial Sequence
  Description of Artificial Sequence: Synthetic oligonucleotide
gccaugccgaagagcuug

SEQ ID NO: 130658 - RNA, 18 nt, Artificial Sequence
  Description of Artificial Sequence: Synthetic oligonucleotide
ucuuggccaugccgaaga

SEQ ID NO: 130659 - RNA, 18 nt, Artificial Sequence
  Description of Artificial Sequence: Synthetic oligonucleotide
gucaaucuuggccaugcc

SEQ ID NO: 130660 - RNA, 18 nt, Artificial Sequence
  Description of Artificial Sequence: Synthetic oligonucleotide
agguugucaaucuuggcc

SEQ ID NO: 130661 - RNA, 18 nt, Artificial Sequence
  Description of Artificial Sequence: Synthetic oligonucleotide
gcaacagguugucaaucu

SEQ ID NO: 130662 - RNA, 18 nt, Artificial Sequence
  Description of Artificial Sequence: Synthetic oligonucleotide
cuccugcaacagguuguc

SEQ ID NO: 130663 - RNA, 18 nt, Artificial Sequence
  Description of Artificial Sequence: Synthetic oligonucleotide
agcaucuccugcaacagg

SEQ ID NO: 130664 - RNA, 18 nt, Artificial Sequence
  Description of Artificial Sequence: Synthetic oligonucleotide
ccagcagcaucuccugca

SEQ ID NO: 130665 - RNA, 18 nt, Artificial Sequence
  Description of Artificial Sequence: Synthetic oligonucleotide
ccccuccugggcuuggca

SEQ ID NO: 130666 - RNA, 18 nt, Artificial Sequence
  Description of Artificial Sequence: Synthetic oligonucleotide
ccccgccccuccugggcu

SEQ ID NO: 130667 - RNA, 18 nt, Artificial Sequence
  Description of Artificial Sequence: Synthetic oligonucleotide
uccaaccccgccccuccu

SEQ ID NO: 130668 - RNA, 18 nt, Artificial Sequence
  Description of Artificial Sequence: Synthetic oligonucleotide
cccacuccaaccccgccc

SEQ ID NO: 130669 - RNA, 18 nt, Artificial Sequence
  Description of Artificial Sequence: Synthetic oligonucleotide
gaguccccacuccaaccc

SEQ ID NO: 130670 - RNA, 18 nt, Artificial Sequence
  Description of Artificial Sequence: Synthetic oligonucleotide
gggaguccccacuccaac

SEQ ID NO: 130671 - RNA, 18 nt, Artificial Sequence
  Description of Artificial Sequence: Synthetic oligonucleotide
ugaggccugucuccuggg

SEQ ID NO: 130672 - RNA, 18 nt, Artificial Sequence
  Description of Artificial Sequence: Synthetic oligonucleotide
cugugugaggccugucuc

SEQ ID NO: 130673 - RNA, 18 nt, Artificial Sequence
  Description of Artificial Sequence: Synthetic oligonucleotide
gcucacugugugaggccu

SEQ ID NO: 130674 - RNA, 18 nt, Artificial Sequence
  Description of Artificial Sequence: Synthetic oligonucleotide
ggugagcucacuguguga

SEQ ID NO: 130675 - RNA, 18 nt, Artificial Sequence
  Description of Artificial Sequence: Synthetic oligonucleotide
gggugagcucacugugug

SEQ ID NO: 130676 - RNA, 18 nt, Artificial Sequence
  Description of Artificial Sequence: Synthetic oligonucleotide
aagccaaggagcugaggg

SEQ ID NO: 130677 - RNA, 18 nt, Artificial Sequence
  Description of Artificial Sequence: Synthetic oligonucleotide
gggaagccaaggagcuga

SEQ ID NO: 130678 - RNA, 18 nt, Artificial Sequence
  Description of Artificial Sequence: Synthetic oligonucleotide
ccaaagcggcacaguggg

SEQ ID NO: 130679 - RNA, 18 nt, Artificial Sequence
  Description of Artificial Sequence: Synthetic oligonucleotide
cuugcccaaagcggcaca

SEQ ID NO: 130680 - RNA, 18 nt, Artificial Sequence
  Description of Artificial Sequence: Synthetic oligonucleotide
agcaacuugcccaaagcg

SEQ ID NO: 130681 - RNA, 18 nt, Artificial Sequence
  Description of Artificial Sequence: Synthetic oligonucleotide
gguuaagcaacuugccca

SEQ ID NO: 130682 - RNA, 18 nt, Artificial Sequence
  Description of Artificial Sequence: Synthetic oligonucleotide
agacagguuaagcaacuu

SEQ ID NO: 130683 - RNA, 18 nt, Artificial Sequence
  Description of Artificial Sequence: Synthetic oligonucleotide
ggcacagacagguuaagc

SEQ ID NO: 130684 - RNA, 18 nt, Artificial Sequence
  Description of Artificial Sequence: Synthetic oligonucleotide
acugaggcacagacaggu

SEQ ID NO: 130685 - RNA, 18 nt, Artificial Sequence
  Description of Artificial Sequence: Synthetic oligonucleotide
aggaaacugaggcacaga

SEQ ID NO: 130686 - RNA, 18 nt, Artificial Sequence
  Description of Artificial Sequence: Synthetic oligonucleotide
uggugaggaaacugaggc

SEQ ID NO: 130687 - RNA, 18 nt, Artificial Sequence
  Description of Artificial Sequence: Synthetic oligonucleotide
uuuucuggugaggaaacu

SEQ ID NO: 130688 - RNA, 18 nt, Artificial Sequence
  Description of Artificial Sequence: Synthetic oligonucleotide
cccauuuuucuggugagg

SEQ ID NO: 130689 - RNA, 18 nt, Artificial Sequence
  Description of Artificial Sequence: Synthetic oligonucleotide
uuguucccauuuuucugg

SEQ ID NO: 130690 - RNA, 18 nt, Artificial Sequence
  Description of Artificial Sequence: Synthetic oligonucleotide
uugccuuguucccauuuu

SEQ ID NO: 130691 - RNA, 18 nt, Artificial Sequence
  Description of Artificial Sequence: Synthetic oligonucleotide
gaccauugccuuguuccc

SEQ ID NO: 130692 - RNA, 18 nt, Artificial Sequence
  Description of Artificial Sequence: Synthetic oligonucleotide
aaauagaccauugccuug

SEQ ID NO: 130693 - RNA, 18 nt, Artificial Sequence
  Description of Artificial Sequence: Synthetic oligonucleotide
ugaacaaauagaccauug

SEQ ID NO: 130694 - RNA, 18 nt, Artificial Sequence
  Description of Artificial Sequence: Synthetic oligonucleotide
gugccugaacaaauagac

SEQ ID NO: 130695 - RNA, 18 nt, Artificial Sequence
  Description of Artificial Sequence: Synthetic oligonucleotide
ucucggugccugaacaaa

SEQ ID NO: 130696 - RNA, 18 nt, Artificial Sequence
  Description of Artificial Sequence: Synthetic oligonucleotide
uagguucucggugccuga

SEQ ID NO: 130697 - RNA, 18 nt, Artificial Sequence
  Description of Artificial Sequence: Synthetic oligonucleotide
cgugcuagguucucggug

SEQ ID NO: 130698 - RNA, 18 nt, Artificial Sequence
  Description of Artificial Sequence: Synthetic oligonucleotide
uggcacgugcuagguucu

SEQ ID NO: 130699 - RNA, 18 nt, Artificial Sequence
  Description of Artificial Sequence: Synthetic oligonucleotide
gugacuggcacgugcuag

SEQ ID NO: 130700 - RNA, 18 nt, Artificial Sequence
  Description of Artificial Sequence: Synthetic oligonucleotide
gaacagugacuggcacgu

SEQ ID NO: 130701 - RNA, 18 nt, Artificial Sequence
  Description of Artificial Sequence: Synthetic oligonucleotide
acuuagaacagugacugg

SEQ ID NO: 130702 - RNA, 18 nt, Artificial Sequence
  Description of Artificial Sequence: Synthetic oligonucleotide
ccagcacuuagaacagug

SEQ ID NO: 130703 - RNA, 18 nt, Artificial Sequence
  Description of Artificial Sequence: Synthetic oligonucleotide
aauugccagcacuuagaa

SEQ ID NO: 130704 - RNA, 18 nt, Artificial Sequence
  Description of Artificial Sequence: Synthetic oligonucleotide
ugcugaauugccagcacu

SEQ ID NO: 130705 - RNA, 18 nt, Artificial Sequence
  Description of Artificial Sequence: Synthetic oligonucleotide
uucuuugcugaauugcca

SEQ ID NO: 130706 - RNA, 18 nt, Artificial Sequence
  Description of Artificial Sequence: Synthetic oligonucleotide
ucuuguucuuugcugaau

SEQ ID NO: 130707 - RNA, 18 nt, Artificial Sequence
  Description of Artificial Sequence: Synthetic oligonucleotide
aaagaucuuguucuuugc

SEQ ID NO: 130708 - RNA, 18 nt, Artificial Sequence
  Description of Artificial Sequence: Synthetic oligonucleotide
agggcaaagaucuuguuc

SEQ ID NO: 130709 - RNA, 18 nt, Artificial Sequence
  Description of Artificial Sequence: Synthetic oligonucleotide
ccccgagggcaaagaucu

SEQ ID NO: 130710 - RNA, 18 nt, Artificial Sequence
  Description of Artificial Sequence: Synthetic oligonucleotide
agccuccccgagggcaaa

SEQ ID NO: 130711 - RNA, 18 nt, Artificial Sequence
  Description of Artificial Sequence: Synthetic oligonucleotide
cacacagccuccccgagg

SEQ ID NO: 130712 - RNA, 18 nt, Artificial Sequence
  Description of Artificial Sequence: Synthetic oligonucleotide
acacacacacagccuccc

SEQ ID NO: 130713 - RNA, 18 nt, Artificial Sequence
  Description of Artificial Sequence: Synthetic oligonucleotide
uacucacacacacacagc

SEQ ID NO: 130714 - RNA, 18 nt, Artificial Sequence
  Description of Artificial Sequence: Synthetic oligonucleotide
auacauacucacacacac

SEQ ID NO: 130715 - RNA, 18 nt, Artificial Sequence
  Description of Artificial Sequence: Synthetic oligonucleotide
cauccauacauacucaca

SEQ ID NO: 130716 - RNA, 18 nt, Artificial Sequence
  Description of Artificial Sequence: Synthetic oligonucleotide
ccacgcauccauacauac

SEQ ID NO: 130717 - RNA, 18 nt, Artificial Sequence
  Description of Artificial Sequence: Synthetic oligonucleotide
gauauccacgcauccaua

SEQ ID NO: 130718 - RNA, 18 nt, Artificial Sequence
  Description of Artificial Sequence: Synthetic oligonucleotide
acacagauauccacgcau

SEQ ID NO: 130719 - RNA, 18 nt, Artificial Sequence
  Description of Artificial Sequence: Synthetic oligonucleotide
cauauacacagauaucca

SEQ ID NO: 130720 - RNA, 18 nt, Artificial Sequence
  Description of Artificial Sequence: Synthetic oligonucleotide
acgggcauauacacagau

SEQ ID NO: 130721 - RNA, 18 nt, Artificial Sequence
  Description of Artificial Sequence: Synthetic oligonucleotide
cacauacgggcauauaca

SEQ ID NO: 130722 - RNA, 18 nt, Artificial Sequence
  Description of Artificial Sequence: Synthetic oligonucleotide
gcacgcacauacgggcau

SEQ ID NO: 130723 - RNA, 18 nt, Artificial Sequence
  Description of Artificial Sequence: Synthetic oligonucleotide
cacaugcacgcacauacg

SEQ ID NO: 130724 - RNA, 18 nt, Artificial Sequence
  Description of Artificial Sequence: Synthetic oligonucleotide
auauacacaugcacgcac

SEQ ID NO: 130725 - RNA, 18 nt, Artificial Sequence
  Description of Artificial Sequence: Synthetic oligonucleotide
gcuuuauauacacaugca

SEQ ID NO: 130726 - RNA, 18 nt, Artificial Sequence
  Description of Artificial Sequence: Synthetic oligonucleotide
gugaggcuuuauauacac

SEQ ID NO: 130727 - RNA, 18 nt, Artificial Sequence
  Description of Artificial Sequence: Synthetic oligonucleotide
aaaaugugaggcuuuaua

SEQ ID NO: 130728 - RNA, 18 nt, Artificial Sequence
  Description of Artificial Sequence: Synthetic oligonucleotide
aucauaaaaugugaggcu

SEQ ID NO: 130729 - RNA, 18 nt, Artificial Sequence
  Description of Artificial Sequence: Synthetic oligonucleotide
ucaaaaucauaaaaugug

SEQ ID NO: 130730 - RNA, 18 nt, Artificial Sequence
  Description of Artificial Sequence: Synthetic oligonucleotide
uuauuucaaaaucauaaa

SEQ ID NO: 130731 - RNA, 18 nt, Artificial Sequence
  Description of Artificial Sequence: Synthetic oligonucleotide
ccuguuuauuucaaaauc

SEQ ID NO: 130732 - RNA, 18 nt, Artificial Sequence
  Description of Artificial Sequence: Synthetic oligonucleotide
uauuaccuguuuauuuca

SEQ ID NO: 130733 - RNA, 18 nt, Artificial Sequence
  Description of Artificial Sequence: Synthetic oligonucleotide
uaucauauuaccuguuua

SEQ ID NO: 130734 - RNA, 18 nt, Artificial Sequence
  Description of Artificial Sequence: Synthetic oligonucleotide
aacucuaucauauuaccu

SEQ ID NO: 130735 - RNA, 18 nt, Artificial Sequence
  Description of Artificial Sequence: Synthetic oligonucleotide
aguuaaacucuaucauau

SEQ ID NO: 130736 - RNA, 18 nt, Artificial Sequence
  Description of Artificial Sequence: Synthetic oligonucleotide
uuuucaguuaaacucuau

SEQ ID NO: 130737 - RNA, 18 nt, Artificial Sequence
  Description of Artificial Sequence: Synthetic oligonucleotide
auuccuuuucaguuaaac

SEQ ID NO: 130738 - RNA, 18 nt, Artificial Sequence
  Description of Artificial Sequence: Synthetic oligonucleotide
agaggauuccuuuucagu

SEQ ID NO: 130739 - RNA, 18 nt, Artificial Sequence
  Description of Artificial Sequence: Synthetic oligonucleotide
ucuaaagaggauuccuuu

SEQ ID NO: 130740 - RNA, 18 nt, Artificial Sequence
  Description of Artificial Sequence: Synthetic oligonucleotide
cccuaucuaaagaggauu

SEQ ID NO: 130741 - RNA, 18 nt, Artificial Sequence
  Description of Artificial Sequence: Synthetic oligonucleotide
gccuccccuaucuaaaga

SEQ ID NO: 130742 - RNA, 18 nt, Artificial Sequence
  Description of Artificial Sequence: Synthetic oligonucleotide
cuguggccuccccuaucu

SEQ ID NO: 130743 - RNA, 18 nt, Artificial Sequence
  Description of Artificial Sequence: Synthetic oligonucleotide
gucuccuguggccucccc

SEQ ID NO: 130744 - RNA, 18 nt, Artificial Sequence
  Description of Artificial Sequence: Synthetic oligonucleotide
gagaggucuccuguggcc

SEQ ID NO: 130745 - RNA, 18 nt, Artificial Sequence
  Description of Artificial Sequence: Synthetic oligonucleotide
cuucagagaggucuccug

SEQ ID NO: 130746 - RNA, 18 nt, Artificial Sequence
  Description of Artificial Sequence: Synthetic oligonucleotide
caccacuucagagagguc

SEQ ID NO: 130747 - RNA, 18 nt, Artificial Sequence
  Description of Artificial Sequence: Synthetic oligonucleotide
agagucaccacuucagag

SEQ ID NO: 130748 - RNA, 18 nt, Artificial Sequence
  Description of Artificial Sequence: Synthetic oligonucleotide
gcacaagagucaccacuu

SEQ ID NO: 130749 - RNA, 18 nt, Artificial Sequence
  Description of Artificial Sequence: Synthetic oligonucleotide
ucuuagcacaagagucac

SEQ ID NO: 130750 - RNA, 18 nt, Artificial Sequence
  Description of Artificial Sequence: Synthetic oligonucleotide
uagggucuuagcacaaga

SEQ ID NO: 130751 - RNA, 18 nt, Artificial Sequence
  Description of Artificial Sequence: Synthetic oligonucleotide
gccguuagggucuuagca

SEQ ID NO: 130752 - RNA, 18 nt, Artificial Sequence
  Description of Artificial Sequence: Synthetic oligonucleotide
uuucagccguuagggucu

SEQ ID NO: 130753 - RNA, 18 nt, Artificial Sequence
  Description of Artificial Sequence: Synthetic oligonucleotide
uuuccuuucagccguuag

SEQ ID NO: 130754 - RNA, 18 nt, Artificial Sequence
  Description of Artificial Sequence: Synthetic oligonucleotide
uuccauuuccuuucagcc

SEQ ID NO: 130755 - RNA, 18 nt, Artificial Sequence
  Description of Artificial Sequence: Synthetic oligonucleotide
aagccuuccauuuccuuu

SEQ ID NO: 130756 - RNA, 18 nt, Artificial Sequence
  Description of Artificial Sequence: Synthetic oligonucleotide
cuuuuaagccuuccauuu

SEQ ID NO: 130757 - RNA, 18 nt, Artificial Sequence
  Description of Artificial Sequence: Synthetic oligonucleotide
cuugucuuuuaagccuuc

SEQ ID NO: 130758 - RNA, 18 nt, Artificial Sequence
  Description of Artificial Sequence: Synthetic oligonucleotide
ccucucuugucuuuuaag

SEQ ID NO: 130759 - RNA, 18 nt, Artificial Sequence
  Description of Artificial Sequence: Synthetic oligonucleotide
auauuccucucuugucuu

SEQ ID NO: 130760 - RNA, 18 nt, Artificial Sequence
  Description of Artificial Sequence: Synthetic oligonucleotide
guuuuuccaccccaaacc

SEQ ID NO: 130761 - RNA, 18 nt, Artificial Sequence
  Description of Artificial Sequence: Synthetic oligonucleotide
gagauguuuuuccacccc

SEQ ID NO: 130762 - RNA, 18 nt, Artificial Sequence
  Description of Artificial Sequence: Synthetic oligonucleotide
ugucagagauguuuuucc

SEQ ID NO: 130763 - RNA, 18 nt, Artificial Sequence
  Description of Artificial Sequence: Synthetic oligonucleotide
gcuucugucagagauguu

SEQ ID NO: 130764 - RNA, 18 nt, Artificial Sequence
  Description of Artificial Sequence: Synthetic oligonucleotide
uuguugcuucugucagag

SEQ ID NO: 130765 - RNA, 18 nt, Artificial Sequence
  Description of Artificial Sequence: Synthetic oligonucleotide
ucacguuguugcuucugu

SEQ ID NO: 130766 - RNA, 18 nt, Artificial Sequence
  Description of Artificial Sequence: Synthetic oligonucleotide
ucugcucacguuguugcu

SEQ ID NO: 130767 - RNA, 18 nt, Artificial Sequence
  Description of Artificial Sequence: Synthetic oligonucleotide
augcuucugcucacguug

SEQ ID NO: 130768 - RNA, 18 nt, Artificial Sequence
  Description of Artificial Sequence: Synthetic oligonucleotide
ucucuaugcuucugcuca

SEQ ID NO: 130769 - RNA, 18 nt, Artificial Sequence
  Description of Artificial Sequence: Synthetic oligonucleotide
uucuaucucuaugcuucu

SEQ ID NO: 130770 - RNA, 18 nt, Artificial Sequence
  Description of Artificial Sequence: Synthetic oligonucleotide
uguuuuucuaucucuaug

SEQ ID NO: 130771 - RNA, 18 nt, Artificial Sequence
  Description of Artificial Sequence: Synthetic oligonucleotide
cccuguguuuuucuaucu

SEQ ID NO: 130772 - RNA, 18 nt, Artificial Sequence
  Description of Artificial Sequence: Synthetic oligonucleotide
guguccccuguguuuuuc

SEQ ID NO: 130773 - RNA, 18 nt, Artificial Sequence
  Description of Artificial Sequence: Synthetic oligonucleotide
ucuauguguccccugugu

SEQ ID NO: 130774 - RNA, 18 nt, Artificial Sequence
  Description of Artificial Sequence: Synthetic oligonucleotide
uagcaucuaugugucccc

SEQ ID NO: 130775 - RNA, 18 nt, Artificial Sequence
  Description of Artificial Sequence: Synthetic oligonucleotide
acuuauagcaucuaugug

SEQ ID NO: 130776 - RNA, 18 nt, Artificial Sequence
  Description of Artificial Sequence: Synthetic oligonucleotide
gaccuacuuauagcaucu

SEQ ID NO: 130777 - RNA, 18 nt, Artificial Sequence
  Description of Artificial Sequence: Synthetic oligonucleotide
caacugaccuacuuauag

SEQ ID NO: 130778 - RNA, 18 nt, Artificial Sequence
  Description of Artificial Sequence: Synthetic oligonucleotide
gcagccaacugaccuacu

SEQ ID NO: 130779 - RNA, 18 nt, Artificial Sequence
  Description of Artificial Sequence: Synthetic oligonucleotide
cugcugcagccaacugac

SEQ ID NO: 130780 - RNA, 18 nt, Artificial Sequence
  Description of Artificial Sequence: Synthetic oligonucleotide
caucucugcugcagccaa

SEQ ID NO: 130781 - RNA, 18 nt, Artificial Sequence
  Description of Artificial Sequence: Synthetic oligonucleotide
ccccacaucucugcugca

SEQ ID NO: 130782 - RNA, 18 nt, Artificial Sequence
  Description of Artificial Sequence: Synthetic oligonucleotide
ucaucccccacaucucug

SEQ ID NO: 130783 - RNA, 18 nt, Artificial Sequence
  Description of Artificial Sequence: Synthetic oligonucleotide
cagccucaucccccacau

SEQ ID NO: 130784 - RNA, 18 nt, Artificial Sequence
  Description of Artificial Sequence: Synthetic oligonucleotide
ccuuucagccucaucccc

SEQ ID NO: 130785 - RNA, 18 nt, Artificial Sequence
  Description of Artificial Sequence: Synthetic oligonucleotide
ccucaccuuucagccuca

SEQ ID NO: 130786 - RNA, 18 nt, Artificial Sequence
  Description of Artificial Sequence: Synthetic oligonucleotide
ucccgccucaccuuucag

SEQ ID NO: 130787 - RNA, 18 nt, Artificial Sequence
  Description of Artificial Sequence: Synthetic oligonucleotide
uuuggucccgccucaccu

SEQ ID NO: 130788 - RNA, 18 nt, Artificial Sequence
  Description of Artificial Sequence: Synthetic oligonucleotide
aaccauuuggucccgccu

SEQ ID NO: 130789 - RNA, 18 nt, Artificial Sequence
  Description of Artificial Sequence: Synthetic oligonucleotide
ccuucaaccauuuggucc

SEQ ID NO: 130790 - RNA, 18 nt, Artificial Sequence
  Description of Artificial Sequence: Synthetic oligonucleotide
caaguccuucaaccauuu

SEQ ID NO: 130791 - RNA, 18 nt, Artificial Sequence
  Description of Artificial Sequence: Synthetic oligonucleotide
gagugcaaguccuucaac

SEQ ID NO: 130792 - RNA, 18 nt, Artificial Sequence
  Description of Artificial Sequence: Synthetic oligonucleotide
ccuuggagugcaaguccu

SEQ ID NO: 130793 - RNA, 18 nt, Artificial Sequence
  Description of Artificial Sequence: Synthetic oligonucleotide
aagcuccuuggagugcaa

SEQ ID NO: 130794 - RNA, 18 nt, Artificial Sequence
  Description of Artificial Sequence: Synthetic oligonucleotide
ucucaaagcuccuuggag

SEQ ID NO: 130795 - RNA, 18 nt, Artificial Sequence
  Description of Artificial Sequence: Synthetic oligonucleotide
auggcucucaaagcuccu

SEQ ID NO: 130796 - RNA, 18 nt, Artificial Sequence
  Description of Artificial Sequence: Synthetic oligonucleotide
aaucaauggcucucaaag

SEQ ID NO: 130797 - RNA, 18 nt, Artificial Sequence
  Description of Artificial Sequence: Synthetic oligonucleotide
gauguaaucaauggcucu

SEQ ID NO: 130798 - RNA, 18 nt, Artificial Sequence
  Description of Artificial Sequence: Synthetic oligonucleotide
uaauggauguaaucaaug

SEQ ID NO: 130799 - RNA, 18 nt, Artificial Sequence
  Description of Artificial Sequence: Synthetic oligonucleotide
uaacauaauggauguaau

SEQ ID NO: 130800 - RNA, 18 nt, Artificial Sequence
  Description of Artificial Sequence: Synthetic oligonucleotide
cauaguaacauaauggau

SEQ ID NO: 130801 - RNA, 18 nt, Artificial Sequence
  Description of Artificial Sequence: Synthetic oligonucleotide
ggucacauaguaacauaa

SEQ ID NO: 130802 - RNA, 18 nt, Artificial Sequence
  Description of Artificial Sequence: Synthetic oligonucleotide
guauuggucacauaguaa

SEQ ID NO: 130803 - RNA, 18 nt, Artificial Sequence
  Description of Artificial Sequence: Synthetic oligonucleotide
guaguguauuggucacau

SEQ ID NO: 130804 - RNA, 18 nt, Artificial Sequence
  Description of Artificial Sequence: Synthetic oligonucleotide
aaugaguaguguauuggu

SEQ ID NO: 130805 - RNA, 18 nt, Artificial Sequence
  Description of Artificial Sequence: Synthetic oligonucleotide
guucuaaugaguagugua

SEQ ID NO: 130806 - RNA, 18 nt, Artificial Sequence
  Description of Artificial Sequence: Synthetic oligonucleotide
uaaauguucuaaugagua

SEQ ID NO: 130807 - RNA, 18 nt, Artificial Sequence
  Description of Artificial Sequence: Synthetic oligonucleotide
ucacguaaauguucuaau

SEQ ID NO: 130808 - RNA, 18 nt, Artificial Sequence
  Description of Artificial Sequence: Synthetic oligonucleotide
ugagaucacguaaauguu

SEQ ID NO: 130809 - RNA, 18 nt, Artificial Sequence
  Description of Artificial Sequence: Synthetic oligonucleotide
agcucugagaucacguaa

SEQ ID NO: 130810 - RNA, 18 nt, Artificial Sequence
  Description of Artificial Sequence: Synthetic oligonucleotide
aaggaagcucugagauca

SEQ ID NO: 130811 - RNA, 18 nt, Artificial Sequence
  Description of Artificial Sequence: Synthetic oligonucleotide
cauauaaggaagcucuga

SEQ ID NO: 130812 - RNA, 18 nt, Artificial Sequence
  Description of Artificial Sequence: Synthetic oligonucleotide
aggugcauauaaggaagc

SEQ ID NO: 130813 - RNA, 18 nt, Artificial Sequence
  Description of Artificial Sequence: Synthetic oligonucleotide
gaacaaggugcauauaag

SEQ ID NO: 130814 - RNA, 18 nt, Artificial Sequence
  Description of Artificial Sequence: Synthetic oligonucleotide
gaaaggaacaaggugcau

SEQ ID NO: 130815 - RNA, 18 nt, Artificial Sequence
  Description of Artificial Sequence: Synthetic oligonucleotide
gaguugaaaggaacaagg

SEQ ID NO: 130816 - RNA, 18 nt, Artificial Sequence
  Description of Artificial Sequence: Synthetic oligonucleotide
aaagugaguugaaaggaa

SEQ ID NO: 130817 - RNA, 18 nt, Artificial Sequence
  Description of Artificial Sequence: Synthetic oligonucleotide
gaacaaaagugaguugaa

SEQ ID NO: 130818 - RNA, 18 nt, Artificial Sequence
  Description of Artificial Sequence: Synthetic oligonucleotide
caagagaacaaaagugag

SEQ ID NO: 130819 - RNA, 18 nt, Artificial Sequence
  Description of Artificial Sequence: Synthetic oligonucleotide
aaaaccaagagaacaaaa

SEQ ID NO: 130820 - RNA, 18 nt, Artificial Sequence
  Description of Artificial Sequence: Synthetic oligonucleotide
cccaaaaaaccaagagaa

SEQ ID NO: 130821 - RNA, 18 nt, Artificial Sequence
  Description of Artificial Sequence: Synthetic oligonucleotide
aggaccccaaaaaaccaa

SEQ ID NO: 130822 - RNA, 18 nt, Artificial Sequence
  Description of Artificial Sequence: Synthetic oligonucleotide
uuaagaggaccccaaaaa

SEQ ID NO: 130823 - RNA, 18 nt, Artificial Sequence
  Description of Artificial Sequence: Synthetic oligonucleotide
ggguguuaagaggacccc

SEQ ID NO: 130824 - RNA, 18 nt, Artificial Sequence
  Description of Artificial Sequence: Synthetic oligonucleotide
caugaggguguuaagagg

SEQ ID NO: 130825 - RNA, 18 nt, Artificial Sequence
  Description of Artificial Sequence: Synthetic oligonucleotide
gacuucaugaggguguua

SEQ ID NO: 130826 - RNA, 18 nt, Artificial Sequence
  Description of Artificial Sequence: Synthetic oligonucleotide
cuauagacuucaugaggg

SEQ ID NO: 130827 - RNA, 18 nt, Artificial Sequence
  Description of Artificial Sequence: Synthetic oligonucleotide
cccaucuauagacuucau

SEQ ID NO: 130828 - RNA, 18 nt, Artificial Sequence
  Description of Artificial Sequence: Synthetic oligonucleotide
ccauucccaucuauagac

SEQ ID NO: 130829 - RNA, 18 nt, Artificial Sequence
  Description of Artificial Sequence: Synthetic oligonucleotide
guguaccauucccaucua

SEQ ID NO: 130830 - RNA, 18 nt, Artificial Sequence
  Description of Artificial Sequence: Synthetic oligonucleotide
cuaggguguaccauuccc

SEQ ID NO: 130831 - RNA, 18 nt, Artificial Sequence
  Description of Artificial Sequence: Synthetic oligonucleotide
guaaacuaggguguacca

SEQ ID NO: 130832 - RNA, 18 nt, Artificial Sequence
  Description of Artificial Sequence: Synthetic oligonucleotide
gguuaguaaacuagggug

SEQ ID NO: 130833 - RNA, 18 nt, Artificial Sequence
  Description of Artificial Sequence: Synthetic oligonucleotide
uccuggguuaguaaacua

SEQ ID NO: 130834 - RNA, 18 nt, Artificial Sequence
  Description of Artificial Sequence: Synthetic oligonucleotide
ccuauuccuggguuagua

SEQ ID NO: 130835 - RNA, 18 nt, Artificial Sequence
  Description of Artificial Sequence: Synthetic oligonucleotide
ggguaccuauuccugggu

SEQ ID NO: 130836 - RNA, 18 nt, Artificial Sequence
  Description of Artificial Sequence: Synthetic oligonucleotide
cuguuggguaccuauucc

SEQ ID NO: 130837 - RNA, 18 nt, Artificial Sequence
  Description of Artificial Sequence: Synthetic oligonucleotide
agugccuguuggguaccu

SEQ ID NO: 130838 - RNA, 18 nt, Artificial Sequence
  Description of Artificial Sequence: Synthetic oligonucleotide
uuggcagugccuguuggg

SEQ ID NO: 130839 - RNA, 18 nt, Artificial Sequence
  Description of Artificial Sequence: Synthetic oligonucleotide
caauauuggcagugccug

SEQ ID NO: 130840 - RNA, 18 nt, Artificial Sequence
  Description of Artificial Sequence: Synthetic oligonucleotide
ccauccaauauuggcagu

SEQ ID NO: 130841 - RNA, 18 nt, Artificial Sequence
  Description of Artificial Sequence: Synthetic oligonucleotide
ccagcccauccaauauug

SEQ ID NO: 130842 - RNA, 18 nt, Artificial Sequence
  Description of Artificial Sequence: Synthetic oligonucleotide
aucaaccagcccauccaa

SEQ ID NO: 130843 - RNA, 18 nt, Artificial Sequence
  Description of Artificial Sequence: Synthetic oligonucleotide
ggccaaucaaccagccca

SEQ ID NO: 130844 - RNA, 18 nt, Artificial Sequence
  Description of Artificial Sequence: Synthetic oligonucleotide
ggcguggccaaucaacca

SEQ ID NO: 130845 - RNA, 18 nt, Artificial Sequence
  Description of Artificial Sequence: Synthetic oligonucleotide
ccucaggcguggccaauc

SEQ ID NO: 130846 - RNA, 18 nt, Artificial Sequence
  Description of Artificial Sequence: Synthetic oligonucleotide
aucuuccucaggcguggc

SEQ ID NO: 130847 - RNA, 18 nt, Artificial Sequence
  Description of Artificial Sequence: Synthetic oligonucleotide
acgccaucuuccucaggc

SEQ ID NO: 130848 - RNA, 18 nt, Artificial Sequence
  Description of Artificial Sequence: Synthetic oligonucleotide
uugggacgccaucuuccu

SEQ ID NO: 130849 - RNA, 18 nt, Artificial Sequence
  Description of Artificial Sequence: Synthetic oligonucleotide
aggccuugggacgccauc

SEQ ID NO: 130850 - RNA, 18 nt, Artificial Sequence
  Description of Artificial Sequence: Synthetic oligonucleotide
accucaggccuugggacg

SEQ ID NO: 130851 - RNA, 18 nt, Artificial Sequence
  Description of Artificial Sequence: Synthetic oligonucleotide
ugcagaccucaggccuug

SEQ ID NO: 130852 - RNA, 18 nt, Artificial Sequence
  Description of Artificial Sequence: Synthetic oligonucleotide
ugggaugcagaccucagg

SEQ ID NO: 130853 - RNA, 18 nt, Artificial Sequence
  Description of Artificial Sequence: Synthetic oligonucleotide
gagucugggaugcagacc

SEQ ID NO: 130854 - RNA, 18 nt, Artificial Sequence
  Description of Artificial Sequence: Synthetic oligonucleotide
auggagagucugggaugc

SEQ ID NO: 130855 - RNA, 18 nt, Artificial Sequence
  Description of Artificial Sequence: Synthetic oligonucleotide
ucaggauggagagucugg

SEQ ID NO: 130856 - RNA, 18 nt, Artificial Sequence
  Description of Artificial Sequence: Synthetic oligonucleotide
gucgaucaggauggagag

SEQ ID NO: 130857 - RNA, 18 nt, Artificial Sequence
  Description of Artificial Sequence: Synthetic oligonucleotide
gcaucaggugagggugca

SEQ ID NO: 130858 - RNA, 18 nt, Artificial Sequence
  Description of Artificial Sequence: Synthetic oligonucleotide
uuccugcaucaggugagg

SEQ ID NO: 130859 - RNA, 18 nt, Artificial Sequence
  Description of Artificial Sequence: Synthetic oligonucleotide
auauguuccugcaucagg

SEQ ID NO: 130860 - RNA, 18 nt, Artificial Sequence
  Description of Artificial Sequence: Synthetic oligonucleotide
uucccauauguuccugca

SEQ ID NO: 130861 - RNA, 18 nt, Artificial Sequence
  Description of Artificial Sequence: Synthetic oligonucleotide
guugguucccauauguuc

SEQ ID NO: 130862 - RNA, 18 nt, Artificial Sequence
  Description of Artificial Sequence: Synthetic oligonucleotide
augacguugguucccaua

SEQ ID NO: 130863 - RNA, 18 nt, Artificial Sequence
  Description of Artificial Sequence: Synthetic oligonucleotide
caacgaugacguugguuc

SEQ ID NO: 130864 - RNA, 18 nt, Artificial Sequence
  Description of Artificial Sequence: Synthetic oligonucleotide
guuggcaacgaugacguu

SEQ ID NO: 130865 - RNA, 18 nt, Artificial Sequence
  Description of Artificial Sequence: Synthetic oligonucleotide
auuguguuggcaacgaug

SEQ ID NO: 130866 - RNA, 18 nt, Artificial Sequence
  Description of Artificial Sequence: Synthetic oligonucleotide
ugggcauuguguuggcaa

SEQ ID NO: 130867 - RNA, 18 nt, Artificial Sequence
  Description of Artificial Sequence: Synthetic oligonucleotide
gugagugggcauuguguu

SEQ ID NO: 130868 - RNA, 18 nt, Artificial Sequence
  Description of Artificial Sequence: Synthetic oligonucleotide
cugaggugagugggcauu

SEQ ID NO: 130869 - RNA, 18 nt, Artificial Sequence
  Description of Artificial Sequence: Synthetic oligonucleotide
cguugcugaggugagugg

SEQ ID NO: 130870 - RNA, 18 nt, Artificial Sequence
  Description of Artificial Sequence: Synthetic oligonucleotide
cuguccguugcugaggug

SEQ ID NO: 130871 - RNA, 18 nt, Artificial Sequence
  Description of Artificial Sequence: Synthetic oligonucleotide
cacaucuguccguugcug

SEQ ID NO: 130872 - RNA, 18 nt, Artificial Sequence
  Description of Artificial Sequence: Synthetic oligonucleotide
acucacacaucuguccgu

SEQ ID NO: 130873 - RNA, 18 nt, Artificial Sequence
  Description of Artificial Sequence: Synthetic oligonucleotide
gggccacucacacaucug

SEQ ID NO: 130874 - RNA, 18 nt, Artificial Sequence
  Description of Artificial Sequence: Synthetic oligonucleotide
ucaggugagggugcaggg

SEQ ID NO: 130875 - RNA, 18 nt, Artificial Sequence
  Description of Artificial Sequence: Synthetic oligonucleotide
ugcaucaggugagggugc

SEQ ID NO: 130876 - RNA, 18 nt, Artificial Sequence
  Description of Artificial Sequence: Synthetic oligonucleotide
guuccugcaucaggugag

SEQ ID NO: 130877 - RNA, 18 nt, Artificial Sequence
  Description of Artificial Sequence: Synthetic oligonucleotide
cauauguuccugcaucag

SEQ ID NO: 130878 - RNA, 18 nt, Artificial Sequence
  Description of Artificial Sequence: Synthetic oligonucleotide
guucccauauguuccugc

SEQ ID NO: 130879 - RNA, 18 nt, Artificial Sequence
  Description of Artificial Sequence: Synthetic oligonucleotide
cguugguucccauauguu

SEQ ID NO: 130880 - RNA, 18 nt, Artificial Sequence
  Description of Artificial Sequence: Synthetic oligonucleotide
gaugacguugguucccau

SEQ ID NO: 130881 - RNA, 18 nt, Artificial Sequence
  Description of Artificial Sequence: Synthetic oligonucleotide
gcaacgaugacguugguu

SEQ ID NO: 130882 - RNA, 18 nt, Artificial Sequence
  Description of Artificial Sequence: Synthetic oligonucleotide
uguuggcaacgaugacgu

SEQ ID NO: 130883 - RNA, 18 nt, Artificial Sequence
  Description of Artificial Sequence: Synthetic oligonucleotide
cauuguguuggcaacgau

SEQ ID NO: 130884 - RNA, 18 nt, Artificial Sequence
  Description of Artificial Sequence: Synthetic oligonucleotide
gugggcauuguguuggca

SEQ ID NO: 130885 - RNA, 18 nt, Artificial Sequence
  Description of Artificial Sequence: Synthetic oligonucleotide
ggugagugggcauugugu

SEQ ID NO: 130886 - RNA, 18 nt, Artificial Sequence
  Description of Artificial Sequence: Synthetic oligonucleotide
gcugaggugagugggcau

SEQ ID NO: 130887 - RNA, 18 nt, Artificial Sequence
  Description of Artificial Sequence: Synthetic oligonucleotide
ccguugcugaggugagug

SEQ ID NO: 130888 - RNA, 18 nt, Artificial Sequence
  Description of Artificial Sequence: Synthetic oligonucleotide
ucuguccguugcugaggu

SEQ ID NO: 130889 - RNA, 18 nt, Artificial Sequence
  Description of Artificial Sequence: Synthetic oligonucleotide
acacaucuguccguugcu

SEQ ID NO: 130890 - RNA, 18 nt, Artificial Sequence
  Description of Artificial Sequence: Synthetic oligonucleotide
cacucacacaucuguccg

SEQ ID NO: 130891 - RNA, 18 nt, Artificial Sequence
  Description of Artificial Sequence: Synthetic oligonucleotide
ccuguccccugggucggg

SEQ ID NO: 130892 - RNA, 18 nt, Artificial Sequence
  Description of Artificial Sequence: Synthetic oligonucleotide
guaaaaucccagaguuug

SEQ ID NO: 130893 - RNA, 18 nt, Artificial Sequence
  Description of Artificial Sequence: Synthetic oligonucleotide
gcaagguaaaaucccaga

SEQ ID NO: 130894 - RNA, 18 nt, Artificial Sequence
  Description of Artificial Sequence: Synthetic oligonucleotide
ccuuugcaagguaaaauc

SEQ ID NO: 130895 - RNA, 18 nt, Artificial Sequence
  Description of Artificial Sequence: Synthetic oligonucleotide
cucacccuuugcaaggua

SEQ ID NO: 130896 - RNA, 18 nt, Artificial Sequence
  Description of Artificial Sequence: Synthetic oligonucleotide
ccauccucacccuuugca

SEQ ID NO: 130897 - RNA, 18 nt, Artificial Sequence
  Description of Artificial Sequence: Synthetic oligonucleotide
aagccccauccucacccu

SEQ ID NO: 130898 - RNA, 18 nt, Artificial Sequence
  Description of Artificial Sequence: Synthetic oligonucleotide
gucuuaagccccauccuc

SEQ ID NO: 130899 - RNA, 18 nt, Artificial Sequence
  Description of Artificial Sequence: Synthetic oligonucleotide
cuccugucuuaagcccca

SEQ ID NO: 130900 - RNA, 18 nt, Artificial Sequence
  Description of Artificial Sequence: Synthetic oligonucleotide
ccugccuccugucuuaag

SEQ ID NO: 130901 - RNA, 18 nt, Artificial Sequence
  Description of Artificial Sequence: Synthetic oligonucleotide
uuucuccugccuccuguc

SEQ ID NO: 130902 - RNA, 18 nt, Artificial Sequence
  Description of Artificial Sequence: Synthetic oligonucleotide
uccacuuucuccugccuc

SEQ ID NO: 130903 - RNA, 18 nt, Artificial Sequence
  Description of Artificial Sequence: Synthetic oligonucleotide
uagacuccacuuucuccu

SEQ ID NO: 130904 - RNA, 18 nt, Artificial Sequence
  Description of Artificial Sequence: Synthetic oligonucleotide
ccuucuagacuccacuuu

SEQ ID NO: 130905 - RNA, 18 nt, Artificial Sequence
  Description of Artificial Sequence: Synthetic oligonucleotide
uucuaccuucuagacucc

SEQ ID NO: 130906 - RNA, 18 nt, Artificial Sequence
  Description of Artificial Sequence: Synthetic oligonucleotide
ccugguucuaccuucuag

SEQ ID NO: 130907 - RNA, 18 nt, Artificial Sequence
  Description of Artificial Sequence: Synthetic oligonucleotide
ugcauccugguucuaccu

SEQ ID NO: 130908 - RNA, 18 nt, Artificial Sequence
  Description of Artificial Sequence: Synthetic oligonucleotide
acuguugcauccugguuc

SEQ ID NO: 130909 - RNA, 18 nt, Artificial Sequence
  Description of Artificial Sequence: Synthetic oligonucleotide
agaaaacuguugcauccu

SEQ ID NO: 130910 - RNA, 18 nt, Artificial Sequence
  Description of Artificial Sequence: Synthetic oligonucleotide
aacccagaaaacuguugc

SEQ ID NO: 130911 - RNA, 18 nt, Artificial Sequence
  Description of Artificial Sequence: Synthetic oligonucleotide
ccuggaacccagaaaacu

SEQ ID NO: 130912 - RNA, 18 nt, Artificial Sequence
  Description of Artificial Sequence: Synthetic oligonucleotide
ccuacccuggaacccaga

SEQ ID NO: 130913 - RNA, 18 nt, Artificial Sequence
  Description of Artificial Sequence: Synthetic oligonucleotide
uauucccuacccuggaac

SEQ ID NO: 130914 - RNA, 18 nt, Artificial Sequence
  Description of Artificial Sequence: Synthetic oligonucleotide
cccuuuauucccuacccu

SEQ ID NO: 130915 - RNA, 18 nt, Artificial Sequence
  Description of Artificial Sequence: Synthetic oligonucleotide
ucuugcccuuuauucccu

SEQ ID NO: 130916 - RNA, 18 nt, Artificial Sequence
  Description of Artificial Sequence: Synthetic oligonucleotide
gacaaucuugcccuuuau

SEQ ID NO: 130917 - RNA, 18 nt, Artificial Sequence
  Description of Artificial Sequence: Synthetic oligonucleotide
aaauggacaaucuugccc

SEQ ID NO: 130918 - RNA, 18 nt, Artificial Sequence
  Description of Artificial Sequence: Synthetic oligonucleotide
ucaacaaauggacaaucu

SEQ ID NO: 130919 - RNA, 18 nt, Artificial Sequence
  Description of Artificial Sequence: Synthetic oligonucleotide
cagccucaacaaauggac

SEQ ID NO: 130920 - RNA, 18 nt, Artificial Sequence
  Description of Artificial Sequence: Synthetic oligonucleotide
auaaacagccucaacaaa

SEQ ID NO: 130921 - RNA, 18 nt, Artificial Sequence
  Description of Artificial Sequence: Synthetic oligonucleotide
acugaauaaacagccuca

SEQ ID NO: 130922 - RNA, 18 nt, Artificial Sequence
  Description of Artificial Sequence: Synthetic oligonucleotide
accuuacugaauaaacag

SEQ ID NO: 130923 - RNA, 18 nt, Artificial Sequence
  Description of Artificial Sequence: Synthetic oligonucleotide
cagucaccuuacugaaua

SEQ ID NO: 130924 - RNA, 18 nt, Artificial Sequence
  Description of Artificial Sequence: Synthetic oligonucleotide
gcugucagucaccuuacu

SEQ ID NO: 130925 - RNA, 18 nt, Artificial Sequence
  Description of Artificial Sequence: Synthetic oligonucleotide
uaaaggcugucagucacc

SEQ ID NO: 130926 - RNA, 18 nt, Artificial Sequence
  Description of Artificial Sequence: Synthetic oligonucleotide
uucaguaaaggcugucag

SEQ ID NO: 130927 - RNA, 18 nt, Artificial Sequence
  Description of Artificial Sequence: Synthetic oligonucleotide
cuucauucaguaaaggcu

SEQ ID NO: 130928 - RNA, 18 nt, Artificial Sequence
  Description of Artificial Sequence: Synthetic oligonucleotide
aauggcuucauucaguaa

SEQ ID NO: 130929 - RNA, 18 nt, Artificial Sequence
  Description of Artificial Sequence: Synthetic oligonucleotide
ccaacaauggcuucauuc

SEQ ID NO: 130930 - RNA, 18 nt, Artificial Sequence
  Description of Artificial Sequence: Synthetic oligonucleotide
ucaucccaacaauggcuu

SEQ ID NO: 130931 - RNA, 18 nt, Artificial Sequence
  Description of Artificial Sequence: Synthetic oligonucleotide
uugccucaucccaacaau

SEQ ID NO: 130932 - RNA, 18 nt, Artificial Sequence
  Description of Artificial Sequence: Synthetic oligonucleotide
guggauugccucauccca

SEQ ID NO: 130933 - RNA, 18 nt, Artificial Sequence
  Description of Artificial Sequence: Synthetic oligonucleotide
auccaguggauugccuca

SEQ ID NO: 130934 - RNA, 18 nt, Artificial Sequence
  Description of Artificial Sequence: Synthetic oligonucleotide
accucauccaguggauug

SEQ ID NO: 130935 - RNA, 18 nt, Artificial Sequence
  Description of Artificial Sequence: Synthetic oligonucleotide
ggguuaccucauccagug

SEQ ID NO: 130936 - RNA, 18 nt, Artificial Sequence
  Description of Artificial Sequence: Synthetic oligonucleotide
ccaauggguuaccucauc

SEQ ID NO: 130937 - RNA, 18 nt, Artificial Sequence
  Description of Artificial Sequence: Synthetic oligonucleotide
uucacccaauggguuacc

SEQ ID NO: 130938 - RNA, 18 nt, Artificial Sequence
  Description of Artificial Sequence: Synthetic oligonucleotide
acaucuucacccaauggg

SEQ ID NO: 130939 - RNA, 18 nt, Artificial Sequence
  Description of Artificial Sequence: Synthetic oligonucleotide
caagaacaucuucaccca

SEQ ID NO: 130940 - RNA, 18 nt, Artificial Sequence
  Description of Artificial Sequence: Synthetic oligonucleotide
ucacccaagaacaucuuc

SEQ ID NO: 130941 - RNA, 18 nt, Artificial Sequence
  Description of Artificial Sequence: Synthetic oligonucleotide
aauucucacccaagaaca

SEQ ID NO: 130942 - RNA, 18 nt, Artificial Sequence
  Description of Artificial Sequence: Synthetic oligonucleotide
aauggaauucucacccaa

SEQ ID NO: 130943 - RNA, 18 nt, Artificial Sequence
  Description of Artificial Sequence: Synthetic oligonucleotide
caacuaauggaauucuca

SEQ ID NO: 130944 - RNA, 18 nt, Artificial Sequence
  Description of Artificial Sequence: Synthetic oligonucleotide
aaugucaacuaauggaau

SEQ ID NO: 130945 - RNA, 18 nt, Artificial Sequence
  Description of Artificial Sequence: Synthetic oligonucleotide
uggacaaugucaacuaau

SEQ ID NO: 130946 - RNA, 18 nt, Artificial Sequence
  Description of Artificial Sequence: Synthetic oligonucleotide
cuuaauggacaaugucaa

SEQ ID NO: 130947 - RNA, 18 nt, Artificial Sequence
  Description of Artificial Sequence: Synthetic oligonucleotide
uuuuacuuaauggacaau

SEQ ID NO: 130948 - RNA, 18 nt, Artificial Sequence
  Description of Artificial Sequence: Synthetic oligonucleotide
accacuuuuacuuaaugg

SEQ ID NO: 130949 - RNA, 18 nt, Artificial Sequence
  Description of Artificial Sequence: Synthetic oligonucleotide
caaugaccacuuuuacuu

SEQ ID NO: 130950 - RNA, 18 nt, Artificial Sequence
  Description of Artificial Sequence: Synthetic oligonucleotide
uacuucaaugaccacuuu

SEQ ID NO: 130951 - RNA, 18 nt, Artificial Sequence
  Description of Artificial Sequence: Synthetic oligonucleotide
agccuuacuucaaugacc

SEQ ID NO: 130952 - RNA, 18 nt, Artificial Sequence
  Description of Artificial Sequence: Synthetic oligonucleotide
ugugcagccuuacuucaa

SEQ ID NO: 130953 - RNA, 18 nt, Artificial Sequence
  Description of Artificial Sequence: Synthetic oligonucleotide
ccaacugugcagccuuac

SEQ ID NO: 130954 - RNA, 18 nt, Artificial Sequence
  Description of Artificial Sequence: Synthetic oligonucleotide
cuuacccaacugugcagc

SEQ ID NO: 130955 - RNA, 18 nt, Artificial Sequence
  Description of Artificial Sequence: Synthetic oligonucleotide
auagccuuacccaacugu

SEQ ID NO: 130956 - RNA, 18 nt, Artificial Sequence
  Description of Artificial Sequence: Synthetic oligonucleotide
aauggauagccuuaccca

SEQ ID NO: 130957 - RNA, 18 nt, Artificial Sequence
  Description of Artificial Sequence: Synthetic oligonucleotide
ugucuaauggauagccuu

SEQ ID NO: 130958 - RNA, 18 nt, Artificial Sequence
  Description of Artificial Sequence: Synthetic oligonucleotide
cuaauugucuaauggaua

SEQ ID NO: 130959 - RNA, 18 nt, Artificial Sequence
  Description of Artificial Sequence: Synthetic oligonucleotide
cucaucuaauugucuaau

SEQ ID NO: 130960 - RNA, 18 nt, Artificial Sequence
  Description of Artificial Sequence: Synthetic oligonucleotide
guagucucaucuaauugu

SEQ ID NO: 130961 - RNA, 18 nt, Artificial Sequence
  Description of Artificial Sequence: Synthetic oligonucleotide
aauggguagucucaucua

SEQ ID NO: 130962 - RNA, 18 nt, Artificial Sequence
  Description of Artificial Sequence: Synthetic oligonucleotide
gacccaauggguagucuc

SEQ ID NO: 130963 - RNA, 18 nt, Artificial Sequence
  Description of Artificial Sequence: Synthetic oligonucleotide
auccugacccaaugggua

SEQ ID NO: 130964 - RNA, 18 nt, Artificial Sequence
  Description of Artificial Sequence: Synthetic oligonucleotide
cagacauccugacccaau

SEQ ID NO: 130965 - RNA, 18 nt, Artificial Sequence
  Description of Artificial Sequence: Synthetic oligonucleotide
cccagcagacauccugac

SEQ ID NO: 130966 - RNA, 18 nt, Artificial Sequence
  Description of Artificial Sequence: Synthetic oligonucleotide
ucuagcccagcagacauc

SEQ ID NO: 130967 - RNA, 18 nt, Artificial Sequence
  Description of Artificial Sequence: Synthetic oligonucleotide
gauggucuagcccagcag

SEQ ID NO: 130968 - RNA, 18 nt, Artificial Sequence
  Description of Artificial Sequence: Synthetic oligonucleotide
cagaggauggucuagccc

SEQ ID NO: 130969 - RNA, 18 nt, Artificial Sequence
  Description of Artificial Sequence: Synthetic oligonucleotide
gguuucagaggauggucu

SEQ ID NO: 130970 - RNA, 18 nt, Artificial Sequence
  Description of Artificial Sequence: Synthetic oligonucleotide
uuggagguuucagaggau

SEQ ID NO: 130971 - RNA, 18 nt, Artificial Sequence
  Description of Artificial Sequence: Synthetic oligonucleotide
auacuuuggagguuucag

SEQ ID NO: 130972 - RNA, 18 nt, Artificial Sequence
  Description of Artificial Sequence: Synthetic oligonucleotide
aguuuauacuuuggaggu

SEQ ID NO: 130973 - RNA, 18 nt, Artificial Sequence
  Description of Artificial Sequence: Synthetic oligonucleotide
ugacaaguuuauacuuug

SEQ ID NO: 130974 - RNA, 18 nt, Artificial Sequence
  Description of Artificial Sequence: Synthetic oligonucleotide
cccaaugacaaguuuaua

SEQ ID NO: 130975 - RNA, 18 nt, Artificial Sequence
  Description of Artificial Sequence: Synthetic oligonucleotide
cuuugcccaaugacaagu

SEQ ID NO: 130976 - RNA, 18 nt, Artificial Sequence
  Description of Artificial Sequence: Synthetic oligonucleotide
aagagcuuugcccaauga

SEQ ID NO: 130977 - RNA, 18 nt, Artificial Sequence
  Description of Artificial Sequence: Synthetic oligonucleotide
cuuugaagagcuuugccc

SEQ ID NO: 130978 - RNA, 18 nt, Artificial Sequence
  Description of Artificial Sequence: Synthetic oligonucleotide
uuauccuuugaagagcuu

SEQ ID NO: 130979 - RNA, 18 nt, Artificial Sequence
  Description of Artificial Sequence: Synthetic oligonucleotide
uaaucuuauccuuugaag

SEQ ID NO: 130980 - RNA, 18 nt, Artificial Sequence
  Description of Artificial Sequence: Synthetic oligonucleotide
auugauaaucuuauccuu

SEQ ID NO: 130981 - RNA, 18 nt, Artificial Sequence
  Description of Artificial Sequence: Synthetic oligonucleotide
aucccauugauaaucuua

SEQ ID NO: 130982 - RNA, 18 nt, Artificial Sequence
  Description of Artificial Sequence: Synthetic oligonucleotide
acuucaucccauugauaa

SEQ ID NO: 130983 - RNA, 18 nt, Artificial Sequence
  Description of Artificial Sequence: Synthetic oligonucleotide
ggaucacuucaucccauu

SEQ ID NO: 130984 - RNA, 18 nt, Artificial Sequence
  Description of Artificial Sequence: Synthetic oligonucleotide
ucaguggaucacuucauc

SEQ ID NO: 130985 - RNA, 18 nt, Artificial Sequence
  Description of Artificial Sequence: Synthetic oligonucleotide
uuaucucaguggaucacu

SEQ ID NO: 130986 - RNA, 18 nt, Artificial Sequence
  Description of Artificial Sequence: Synthetic oligonucleotide
ucaucuuaucucagugga

SEQ ID NO: 130987 - RNA, 18 nt, Artificial Sequence
  Description of Artificial Sequence: Synthetic oligonucleotide
aaauaucaucuuaucuca

SEQ ID NO: 130988 - RNA, 18 nt, Artificial Sequence
  Description of Artificial Sequence: Synthetic oligonucleotide
caguaaaauaucaucuua

SEQ ID NO: 130989 - RNA, 18 nt, Artificial Sequence
  Description of Artificial Sequence: Synthetic oligonucleotide
aaugucaguaaaauauca

SEQ ID NO: 130990 - RNA, 18 nt, Artificial Sequence
  Description of Artificial Sequence: Synthetic oligonucleotide
agaacaaugucaguaaaa

SEQ ID NO: 130991 - RNA, 18 nt, Artificial Sequence
  Description of Artificial Sequence: Synthetic oligonucleotide
ucuuuguucaauggaaaa

SEQ ID NO: 130992 - RNA, 18 nt, Artificial Sequence
  Description of Artificial Sequence: Synthetic oligonucleotide
ggccaucuuuguucaaug

SEQ ID NO: 130993 - RNA, 18 nt, Artificial Sequence
  Description of Artificial Sequence: Synthetic oligonucleotide
caauuggccaucuuuguu

SEQ ID NO: 130994 - RNA, 18 nt, Artificial Sequence
  Description of Artificial Sequence: Synthetic oligonucleotide
ugacccaauuggccaucu

SEQ ID NO: 130995 - RNA, 18 nt, Artificial Sequence
  Description of Artificial Sequence: Synthetic oligonucleotide
aaauuugacccaauuggc

SEQ ID NO: 130996 - RNA, 18 nt, Artificial Sequence
  Description of Artificial Sequence: Synthetic oligonucleotide
agagcaaauuugacccaa

SEQ ID NO: 130997 - RNA, 18 nt, Artificial Sequence
  Description of Artificial Sequence: Synthetic oligonucleotide
uuuggagagcaaauuuga

SEQ ID NO: 130998 - RNA, 18 nt, Artificial Sequence
  Description of Artificial Sequence: Synthetic oligonucleotide
gcagguuuggagagcaaa

SEQ ID NO: 130999 - RNA, 18 nt, Artificial Sequence
  Description of Artificial Sequence: Synthetic oligonucleotide
ucauggcagguuuggaga

SEQ ID NO: 131000 - RNA, 18 nt, Artificial Sequence
  Description of Artificial Sequence: Synthetic oligonucleotide
cacucucauggcagguuu

SEQ ID NO: 131001 - RNA, 18 nt, Artificial Sequence
  Description of Artificial Sequence: Synthetic oligonucleotide
ggccucacucucauggca

SEQ ID NO: 131002 - RNA, 18 nt, Artificial Sequence
  Description of Artificial Sequence: Synthetic oligonucleotide
uaauuggccucacucuca

SEQ ID NO: 131003 - RNA, 18 nt, Artificial Sequence
  Description of Artificial Sequence: Synthetic oligonucleotide
gaaacuaauuggccucac

SEQ ID NO: 131004 - RNA, 18 nt, Artificial Sequence
  Description of Artificial Sequence: Synthetic oligonucleotide
uaauagaaacuaauuggc

SEQ ID NO: 131005 - RNA, 18 nt, Artificial Sequence
  Description of Artificial Sequence: Synthetic oligonucleotide
augaguaauagaaacuaa

SEQ ID NO: 131006 - RNA, 18 nt, Artificial Sequence
  Description of Artificial Sequence: Synthetic oligonucleotide
aggagaugaguaauagaa

SEQ ID NO: 131007 - RNA, 18 nt, Artificial Sequence
  Description of Artificial Sequence: Synthetic oligonucleotide
uauuuaggagaugaguaa

SEQ ID NO: 131008 - RNA, 18 nt, Artificial Sequence
  Description of Artificial Sequence: Synthetic oligonucleotide
uuggauauuuaggagaug

SEQ ID NO: 131009 - RNA, 18 nt, Artificial Sequence
  Description of Artificial Sequence: Synthetic oligonucleotide
auuucuuggauauuuagg

SEQ ID NO: 131010 - RNA, 18 nt, Artificial Sequence
  Description of Artificial Sequence: Synthetic oligonucleotide
auaccauuucuuggauau

SEQ ID NO: 131011 - RNA, 18 nt, Artificial Sequence
  Description of Artificial Sequence: Synthetic oligonucleotide
aaaaaauaccauuucuug

SEQ ID NO: 131012 - RNA, 18 nt, Artificial Sequence
  Description of Artificial Sequence: Synthetic oligonucleotide
ggcucaaaaaauaccauu

SEQ ID NO: 131013 - RNA, 18 nt, Artificial Sequence
  Description of Artificial Sequence: Synthetic oligonucleotide
cagcuggcucaaaaaaua

SEQ ID NO: 131014 - RNA, 18 nt, Artificial Sequence
  Description of Artificial Sequence: Synthetic oligonucleotide
cggaccagcuggcucaaa

SEQ ID NO: 131015 - RNA, 18 nt, Artificial Sequence
  Description of Artificial Sequence: Synthetic oligonucleotide
aaccccggaccagcuggc

SEQ ID NO: 131016 - RNA, 18 nt, Artificial Sequence
  Description of Artificial Sequence: Synthetic oligonucleotide
gaugaaaccccggaccag

SEQ ID NO: 131017 - RNA, 18 nt, Artificial Sequence
  Description of Artificial Sequence: Synthetic oligonucleotide
caguugaugaaaccccgg

SEQ ID NO: 131018 - RNA, 18 nt, Artificial Sequence
  Description of Artificial Sequence: Synthetic oligonucleotide
agcagcaguugaugaaac

SEQ ID NO: 131019 - RNA, 18 nt, Artificial Sequence
  Description of Artificial Sequence: Synthetic oligonucleotide
gaaggagcagcaguugau

SEQ ID NO: 131020 - RNA, 18 nt, Artificial Sequence
  Description of Artificial Sequence: Synthetic oligonucleotide
ugggagaaggagcagcag

SEQ ID NO: 131021 - RNA, 18 nt, Artificial Sequence
  Description of Artificial Sequence: Synthetic oligonucleotide
uuuccugggagaaggagc

SEQ ID NO: 131022 - RNA, 18 nt, Artificial Sequence
  Description of Artificial Sequence: Synthetic oligonucleotide
uagucuuuccugggagaa

SEQ ID NO: 131023 - RNA, 18 nt, Artificial Sequence
  Description of Artificial Sequence: Synthetic oligonucleotide
agggauagucuuuccugg

SEQ ID NO: 131024 - RNA, 18 nt, Artificial Sequence
  Description of Artificial Sequence: Synthetic oligonucleotide
gugacagggauagucuuu

SEQ ID NO: 131025 - RNA, 18 nt, Artificial Sequence
  Description of Artificial Sequence: Synthetic oligonucleotide
gaugggugacagggauag

SEQ ID NO: 131026 - RNA, 18 nt, Artificial Sequence
  Description of Artificial Sequence: Synthetic oligonucleotide
aaugggaugggugacagg

SEQ ID NO: 131027 - RNA, 18 nt, Artificial Sequence
  Description of Artificial Sequence: Synthetic oligonucleotide
gcggcaaugggaugggug

SEQ ID NO: 131028 - RNA, 18 nt, Artificial Sequence
  Description of Artificial Sequence: Synthetic oligonucleotide
ccccagcggcaaugggau

SEQ ID NO: 131029 - RNA, 18 nt, Artificial Sequence
  Description of Artificial Sequence: Synthetic oligonucleotide
gcuguccccagcggcaau

SEQ ID NO: 131030 - RNA, 18 nt, Artificial Sequence
  Description of Artificial Sequence: Synthetic oligonucleotide
gccuggcuguccccagcg

SEQ ID NO: 131031 - RNA, 18 nt, Artificial Sequence
  Description of Artificial Sequence: Synthetic oligonucleotide
cccaggccuggcuguccc

SEQ ID NO: 131032 - RNA, 18 nt, Artificial Sequence
  Description of Artificial Sequence: Synthetic oligonucleotide
caaggcccaggccuggcu

SEQ ID NO: 131033 - RNA, 18 nt, Artificial Sequence
  Description of Artificial Sequence: Synthetic oligonucleotide
caaaccaaggcccaggcc

SEQ ID NO: 131034 - RNA, 18 nt, Artificial Sequence
  Description of Artificial Sequence: Synthetic oligonucleotide
ucucccaaaccaaggccc

SEQ ID NO: 131035 - RNA, 18 nt, Artificial Sequence
  Description of Artificial Sequence: Synthetic oligonucleotide
cugcuucucccaaaccaa

SEQ ID NO: 131036 - RNA, 18 nt, Artificial Sequence
  Description of Artificial Sequence: Synthetic oligonucleotide
uuggacugcuucucccaa

SEQ ID NO: 131037 - RNA, 18 nt, Artificial Sequence
  Description of Artificial Sequence: Synthetic oligonucleotide
cagacuuggacugcuucu

SEQ ID NO: 131038 - RNA, 18 nt, Artificial Sequence
  Description of Artificial Sequence: Synthetic oligonucleotide
auaugcagacuuggacug

SEQ ID NO: 131039 - RNA, 18 nt, Artificial Sequence
  Description of Artificial Sequence: Synthetic oligonucleotide
auuugauaugcagacuug

SEQ ID NO: 131040 - RNA, 18 nt, Artificial Sequence
  Description of Artificial Sequence: Synthetic oligonucleotide
cauuuauuugauaugcag

SEQ ID NO: 131041 - RNA, 18 nt, Artificial Sequence
  Description of Artificial Sequence: Synthetic oligonucleotide
uccaucauuuauuugaua

SEQ ID NO: 131042 - RNA, 18 nt, Artificial Sequence
  Description of Artificial Sequence: Synthetic oligonucleotide
ucuccuccaucauuuauu

SEQ ID NO: 131043 - RNA, 18 nt, Artificial Sequence
  Description of Artificial Sequence: Synthetic oligonucleotide
acccaucuccuccaucau

SEQ ID NO: 131044 - RNA, 18 nt, Artificial Sequence
  Description of Artificial Sequence: Synthetic oligonucleotide
cuaccacccaucuccucc

SEQ ID NO: 131045 - RNA, 18 nt, Artificial Sequence
  Description of Artificial Sequence: Synthetic oligonucleotide
agguccuaccacccaucu

SEQ ID NO: 131046 - RNA, 18 nt, Artificial Sequence
  Description of Artificial Sequence: Synthetic oligonucleotide
cuggaagguccuaccacc

SEQ ID NO: 131047 - RNA, 18 nt, Artificial Sequence
  Description of Artificial Sequence: Synthetic oligonucleotide
gaggucuggaagguccua

SEQ ID NO: 131048 - RNA, 18 nt, Artificial Sequence
  Description of Artificial Sequence: Synthetic oligonucleotide
uuuaugaggucuggaagg

SEQ ID NO: 131049 - RNA, 18 nt, Artificial Sequence
  Description of Artificial Sequence: Synthetic oligonucleotide
uaaguuuuaugaggucug

SEQ ID NO: 131050 - RNA, 18 nt, Artificial Sequence
  Description of Artificial Sequence: Synthetic oligonucleotide
aagccuaaguuuuaugag

SEQ ID NO: 131051 - RNA, 18 nt, Artificial Sequence
  Description of Artificial Sequence: Synthetic oligonucleotide
ucauaaagccuaaguuuu

SEQ ID NO: 131052 - RNA, 18 nt, Artificial Sequence
  Description of Artificial Sequence: Synthetic oligonucleotide
ccagaucauaaagccuaa

SEQ ID NO: 131053 - RNA, 18 nt, Artificial Sequence
  Description of Artificial Sequence: Synthetic oligonucleotide
gagucccagaucauaaag

SEQ ID NO: 131054 - RNA, 18 nt, Artificial Sequence
  Description of Artificial Sequence: Synthetic oligonucleotide
ucugugagucccagauca

SEQ ID NO: 131055 - RNA, 18 nt, Artificial Sequence
  Description of Artificial Sequence: Synthetic oligonucleotide
aaccuucugugaguccca

SEQ ID NO: 131056 - RNA, 18 nt, Artificial Sequence
  Description of Artificial Sequence: Synthetic oligonucleotide
ugcucaaccuucugugag

SEQ ID NO: 131057 - RNA, 18 nt, Artificial Sequence
  Description of Artificial Sequence: Synthetic oligonucleotide
uuuauugcucaaccuucu

SEQ ID NO: 131058 - RNA, 18 nt, Artificial Sequence
  Description of Artificial Sequence: Synthetic oligonucleotide
ggucuuuuauugcucaac

SEQ ID NO: 131059 - RNA, 18 nt, Artificial Sequence
  Description of Artificial Sequence: Synthetic oligonucleotide
ccuaaggucuuuuauugc

SEQ ID NO: 131060 - RNA, 18 nt, Artificial Sequence
  Description of Artificial Sequence: Synthetic oligonucleotide
uaaucccuaaggucuuuu

SEQ ID NO: 131061 - RNA, 18 nt, Artificial Sequence
  Description of Artificial Sequence: Synthetic oligonucleotide
ccagauaaucccuaaggu

SEQ ID NO: 131062 - RNA, 18 nt, Artificial Sequence
  Description of Artificial Sequence: Synthetic oligonucleotide
uuaaaccagauaaucccu

SEQ ID NO: 131063 - RNA, 18 nt, Artificial Sequence
  Description of Artificial Sequence: Synthetic oligonucleotide
auuaauuaaaccagauaa

SEQ ID NO: 131064 - RNA, 18 nt, Artificial Sequence
  Description of Artificial Sequence: Synthetic oligonucleotide
agagaauuaauuaaacca

SEQ ID NO: 131065 - RNA, 18 nt, Artificial Sequence
  Description of Artificial Sequence: Synthetic oligonucleotide
aaaugagagaauuaauua

SEQ ID NO: 131066 - RNA, 18 nt, Artificial Sequence
  Description of Artificial Sequence: Synthetic oligonucleotide
cuauaaaaugagagaauu

SEQ ID NO: 131067 - RNA, 18 nt, Artificial Sequence
  Description of Artificial Sequence: Synthetic oligonucleotide
uuccucuauaaaaugaga

SEQ ID NO: 131068 - RNA, 18 nt, Artificial Sequence
  Description of Artificial Sequence: Synthetic oligonucleotide
auuucuuccucuauaaaa

SEQ ID NO: 131069 - RNA, 18 nt, Artificial Sequence
  Description of Artificial Sequence: Synthetic oligonucleotide
acuuaauuucuuccucua

SEQ ID NO: 131070 - RNA, 18 nt, Artificial Sequence
  Description of Artificial Sequence: Synthetic oligonucleotide
ccuugacuuaauuucuuc

SEQ ID NO: 131071 - RNA, 18 nt, Artificial Sequence
  Description of Artificial Sequence: Synthetic oligonucleotide
ccccaccuugacuuaauu

SEQ ID NO: 131072 - RNA, 18 nt, Artificial Sequence
  Description of Artificial Sequence: Synthetic oligonucleotide
cccugccccaccuugacu

SEQ ID NO: 131073 - RNA, 18 nt, Artificial Sequence
  Description of Artificial Sequence: Synthetic oligonucleotide
ucccacccugccccaccu

SEQ ID NO: 131074 - RNA, 18 nt, Artificial Sequence
  Description of Artificial Sequence: Synthetic oligonucleotide
uccccucccacccugccc

SEQ ID NO: 131075 - RNA, 18 nt, Artificial Sequence
  Description of Artificial Sequence: Synthetic oligonucleotide
aguucuccccucccaccc

SEQ ID NO: 131076 - RNA, 18 nt, Artificial Sequence
  Description of Artificial Sequence: Synthetic oligonucleotide
gggaaaguucuccccucc

SEQ ID NO: 131077 - RNA, 18 nt, Artificial Sequence
  Description of Artificial Sequence: Synthetic oligonucleotide
ggcccgggaaaguucucc

SEQ ID NO: 131078 - RNA, 18 nt, Artificial Sequence
  Description of Artificial Sequence: Synthetic oligonucleotide
gaagaggcccgggaaagu

SEQ ID NO: 131079 - RNA, 18 nt, Artificial Sequence
  Description of Artificial Sequence: Synthetic oligonucleotide
uaaaugaagaggcccggg

SEQ ID NO: 131080 - RNA, 18 nt, Artificial Sequence
  Description of Artificial Sequence: Synthetic oligonucleotide
gggaguaaaugaagaggc

SEQ ID NO: 131081 - RNA, 18 nt, Artificial Sequence
  Description of Artificial Sequence: Synthetic oligonucleotide
uuugugggaguaaaugaa

SEQ ID NO: 131082 - RNA, 18 nt, Artificial Sequence
  Description of Artificial Sequence: Synthetic oligonucleotide
cagccuuugugggaguaa

SEQ ID NO: 131083 - RNA, 18 nt, Artificial Sequence
  Description of Artificial Sequence: Synthetic oligonucleotide
aauuccagccuuuguggg

SEQ ID NO: 131084 - RNA, 18 nt, Artificial Sequence
  Description of Artificial Sequence: Synthetic oligonucleotide
cucaaaauuccagccuuu

SEQ ID NO: 131085 - RNA, 18 nt, Artificial Sequence
  Description of Artificial Sequence: Synthetic oligonucleotide
ggcugcucaaaauuccag

SEQ ID NO: 131086 - RNA, 18 nt, Artificial Sequence
  Description of Artificial Sequence: Synthetic oligonucleotide
ccuggcggugagggcugu

SEQ ID NO: 131087 - RNA, 18 nt, Artificial Sequence
  Description of Artificial Sequence: Synthetic oligonucleotide
agccaccuggcggugagg

SEQ ID NO: 131088 - RNA, 18 nt, Artificial Sequence
  Description of Artificial Sequence: Synthetic oligonucleotide
cccugagccaccuggcgg

SEQ ID NO: 131089 - RNA, 18 nt, Artificial Sequence
  Description of Artificial Sequence: Synthetic oligonucleotide
ucagacccugagccaccu

SEQ ID NO: 131090 - RNA, 18 nt, Artificial Sequence
  Description of Artificial Sequence: Synthetic oligonucleotide
agggcucagacccugagc

SEQ ID NO: 131091 - RNA, 18 nt, Artificial Sequence
  Description of Artificial Sequence: Synthetic oligonucleotide
cuuauagggcucagaccc

SEQ ID NO: 131092 - RNA, 18 nt, Artificial Sequence
  Description of Artificial Sequence: Synthetic oligonucleotide
aggagcuuauagggcuca

SEQ ID NO: 131093 - RNA, 18 nt, Artificial Sequence
  Description of Artificial Sequence: Synthetic oligonucleotide
ccggcaggagcuuauagg

SEQ ID NO: 131094 - RNA, 18 nt, Artificial Sequence
  Description of Artificial Sequence: Synthetic oligonucleotide
ggcucccggcaggagcuu

SEQ ID NO: 131095 - RNA, 18 nt, Artificial Sequence
  Description of Artificial Sequence: Synthetic oligonucleotide
gcgacggcucccggcagg

SEQ ID NO: 131096 - RNA, 18 nt, Artificial Sequence
  Description of Artificial Sequence: Synthetic oligonucleotide
uuguggcgacggcucccg

SEQ ID NO: 131097 - RNA, 18 nt, Artificial Sequence
  Description of Artificial Sequence: Synthetic oligonucleotide
gacgauuguggcgacggc

SEQ ID NO: 131098 - RNA, 18 nt, Artificial Sequence
  Description of Artificial Sequence: Synthetic oligonucleotide
ggcuugacgauuguggcg

SEQ ID NO: 131099 - RNA, 18 nt, Artificial Sequence
  Description of Artificial Sequence: Synthetic oligonucleotide
gggcuugacgauuguggc

SEQ ID NO: 131100 - RNA, 18 nt, Artificial Sequence
  Description of Artificial Sequence: Synthetic oligonucleotide
uggugauggucggcuggg

SEQ ID NO: 131101 - RNA, 18 nt, Artificial Sequence
  Description of Artificial Sequence: Synthetic oligonucleotide
cugcuuggugauggucgg

SEQ ID NO: 131102 - RNA, 18 nt, Artificial Sequence
  Description of Artificial Sequence: Synthetic oligonucleotide
acuuccugcuuggugaug

SEQ ID NO: 131103 - RNA, 18 nt, Artificial Sequence
  Description of Artificial Sequence: Synthetic oligonucleotide
agauaacuuccugcuugg

SEQ ID NO: 131104 - RNA, 18 nt, Artificial Sequence
  Description of Artificial Sequence: Synthetic oligonucleotide
uugcuagauaacuuccug

SEQ ID NO: 131105 - RNA, 18 nt, Artificial Sequence
  Description of Artificial Sequence: Synthetic oligonucleotide
gcggcuugcuagauaacu

SEQ ID NO: 131106 - RNA, 18 nt, Artificial Sequence
  Description of Artificial Sequence: Synthetic oligonucleotide
ccccagcggcuugcuaga

SEQ ID NO: 131107 - RNA, 18 nt, Artificial Sequence
  Description of Artificial Sequence: Synthetic oligonucleotide
ccaagccccagcggcuug

SEQ ID NO: 131108 - RNA, 18 nt, Artificial Sequence
  Description of Artificial Sequence: Synthetic oligonucleotide
agcccccaagccccagcg

SEQ ID NO: 131109 - RNA, 18 nt, Artificial Sequence
  Description of Artificial Sequence: Synthetic oligonucleotide
aguggagcccccaagccc

SEQ ID NO: 131110 - RNA, 18 nt, Artificial Sequence
  Description of Artificial Sequence: Synthetic oligonucleotide
gagccaguggagccccca

SEQ ID NO: 131111 - RNA, 18 nt, Artificial Sequence
  Description of Artificial Sequence: Synthetic oligonucleotide
gggagccaguggagcccc

SEQ ID NO: 131112 - RNA, 18 nt, Artificial Sequence
  Description of Artificial Sequence: Synthetic oligonucleotide
ccaggugcucucuuaggg

SEQ ID NO: 131113 - RNA, 18 nt, Artificial Sequence
  Description of Artificial Sequence: Synthetic oligonucleotide
gaucaccaggugcucucu

SEQ ID NO: 131114 - RNA, 18 nt, Artificial Sequence
  Description of Artificial Sequence: Synthetic oligonucleotide
cacgugaucaccaggugc

SEQ ID NO: 131115 - RNA, 18 nt, Artificial Sequence
  Description of Artificial Sequence: Synthetic oligonucleotide
gugaccacgugaucacca

SEQ ID NO: 131116 - RNA, 18 nt, Artificial Sequence
  Description of Artificial Sequence: Synthetic oligonucleotide
uugccgugaccacgugau

SEQ ID NO: 131117 - RNA, 18 nt, Artificial Sequence
  Description of Artificial Sequence: Synthetic oligonucleotide
uuccuuugccgugaccac

SEQ ID NO: 131118 - RNA, 18 nt, Artificial Sequence
  Description of Artificial Sequence: Synthetic oligonucleotide
acgucuuccuuugccgug

SEQ ID NO: 131119 - RNA, 18 nt, Artificial Sequence
  Description of Artificial Sequence: Synthetic oligonucleotide
gcaucacgucuuccuuug

SEQ ID NO: 131120 - RNA, 18 nt, Artificial Sequence
  Description of Artificial Sequence: Synthetic oligonucleotide
uccuggcaucacgucuuc

SEQ ID NO: 131121 - RNA, 18 nt, Artificial Sequence
  Description of Artificial Sequence: Synthetic oligonucleotide
acugguccuggcaucacg

SEQ ID NO: 131122 - RNA, 18 nt, Artificial Sequence
  Description of Artificial Sequence: Synthetic oligonucleotide
cugggacugguccuggca

SEQ ID NO: 131123 - RNA, 18 nt, Artificial Sequence
  Description of Artificial Sequence: Synthetic oligonucleotide
cugcucugggacuggucc

SEQ ID NO: 131124 - RNA, 18 nt, Artificial Sequence
  Description of Artificial Sequence: Synthetic oligonucleotide
cauuccugcucugggacu

SEQ ID NO: 131125 - RNA, 18 nt, Artificial Sequence
  Description of Artificial Sequence: Synthetic oligonucleotide
cuucccauuccugcucug

SEQ ID NO: 131126 - RNA, 18 nt, Artificial Sequence
  Description of Artificial Sequence: Synthetic oligonucleotide
ucauccuucccauuccug

SEQ ID NO: 131127 - RNA, 18 nt, Artificial Sequence
  Description of Artificial Sequence: Synthetic oligonucleotide
gcccuucauccuucccau

SEQ ID NO: 131128 - RNA, 18 nt, Artificial Sequence
  Description of Artificial Sequence: Synthetic oligonucleotide
cucgggcccuucauccuu

SEQ ID NO: 131129 - RNA, 18 nt, Artificial Sequence
  Description of Artificial Sequence: Synthetic oligonucleotide
auguucucgggcccuuca

SEQ ID NO: 131130 - RNA, 18 nt, Artificial Sequence
  Description of Artificial Sequence: Synthetic oligonucleotide
aggccauguucucgggcc

SEQ ID NO: 131131 - RNA, 18 nt, Artificial Sequence
  Description of Artificial Sequence: Synthetic oligonucleotide
cccuuaggccauguucuc

SEQ ID NO: 131132 - RNA, 18 nt, Artificial Sequence
  Description of Artificial Sequence: Synthetic oligonucleotide
uguggcccuuaggccaug

SEQ ID NO: 131133 - RNA, 18 nt, Artificial Sequence
  Description of Artificial Sequence: Synthetic oligonucleotide
ugggauguggcccuuagg

SEQ ID NO: 131134 - RNA, 18 nt, Artificial Sequence
  Description of Artificial Sequence: Synthetic oligonucleotide
ggcagugggauguggccc

SEQ ID NO: 131135 - RNA, 18 nt, Artificial Sequence
  Description of Artificial Sequence: Synthetic oligonucleotide
aggguggcagugggaugu

SEQ ID NO: 131136 - RNA, 18 nt, Artificial Sequence
  Description of Artificial Sequence: Synthetic oligonucleotide
cgucaaggguggcagugg

SEQ ID NO: 131137 - RNA, 18 nt, Artificial Sequence
  Description of Artificial Sequence: Synthetic oligonucleotide
cagggcgucaaggguggc

SEQ ID NO: 131138 - RNA, 18 nt, Artificial Sequence
  Description of Artificial Sequence: Synthetic oligonucleotide
cagagcagggcgucaagg

SEQ ID NO: 131139 - RNA, 18 nt, Artificial Sequence
  Description of Artificial Sequence: Synthetic oligonucleotide
uuauccagagcagggcgu

SEQ ID NO: 131140 - RNA, 18 nt, Artificial Sequence
  Description of Artificial Sequence: Synthetic oligonucleotide
ucuuguuauccagagcag

SEQ ID NO: 131141 - RNA, 18 nt, Artificial Sequence
  Description of Artificial Sequence: Synthetic oligonucleotide
caaagucuuguuauccag

SEQ ID NO: 131142 - RNA, 18 nt, Artificial Sequence
  Description of Artificial Sequence: Synthetic oligonucleotide
caagucaaagucuuguua

SEQ ID NO: 131143 - RNA, 18 nt, Artificial Sequence
  Description of Artificial Sequence: Synthetic oligonucleotide
cuccccaagucaaagucu

SEQ ID NO: 131144 - RNA, 18 nt, Artificial Sequence
  Description of Artificial Sequence: Synthetic oligonucleotide
gaggucuccccaagucaa

SEQ ID NO: 131145 - RNA, 18 nt, Artificial Sequence
  Description of Artificial Sequence: Synthetic oligonucleotide
caguagaggucuccccaa

SEQ ID NO: 131146 - RNA, 18 nt, Artificial Sequence
  Description of Artificial Sequence: Synthetic oligonucleotide
caaggcaguagaggucuc

SEQ ID NO: 131147 - RNA, 18 nt, Artificial Sequence
  Description of Artificial Sequence: Synthetic oligonucleotide
uuguccaaggcaguagag

SEQ ID NO: 131148 - RNA, 18 nt, Artificial Sequence
  Description of Artificial Sequence: Synthetic oligonucleotide
aaaaguuguccaaggcag

SEQ ID NO: 131149 - RNA, 18 nt, Artificial Sequence
  Description of Artificial Sequence: Synthetic oligonucleotide
augagaaaaguuguccaa

SEQ ID NO: 131150 - RNA, 18 nt, Artificial Sequence
  Description of Artificial Sequence: Synthetic oligonucleotide
ucaacaugagaaaaguug

SEQ ID NO: 131151 - RNA, 18 nt, Artificial Sequence
  Description of Artificial Sequence: Synthetic oligonucleotide
uggcuucaacaugagaaa

SEQ ID NO: 131152 - RNA, 18 nt, Artificial Sequence
  Description of Artificial Sequence: Synthetic oligonucleotide
ggcaguggcuucaacaug

SEQ ID NO: 131153 - RNA, 18 nt, Artificial Sequence
  Description of Artificial Sequence: Synthetic oligonucleotide
gugaaggcaguggcuuca

SEQ ID NO: 131154 - RNA, 18 nt, Artificial Sequence
  Description of Artificial Sequence: Synthetic oligonucleotide
ugaaggugaaggcagugg

SEQ ID NO: 131155 - RNA, 18 nt, Artificial Sequence
  Description of Artificial Sequence: Synthetic oligonucleotide
gaaggugaaggugaaggc

SEQ ID NO: 131156 - RNA, 18 nt, Artificial Sequence
  Description of Artificial Sequence: Synthetic oligonucleotide
uggaugaaggugaaggug

SEQ ID NO: 131157 - RNA, 18 nt, Artificial Sequence
  Description of Artificial Sequence: Synthetic oligonucleotide
ggacauggaugaagguga

SEQ ID NO: 131158 - RNA, 18 nt, Artificial Sequence
  Description of Artificial Sequence: Synthetic oligonucleotide
ggguuggacauggaugaa

SEQ ID NO: 131159 - RNA, 18 nt, Artificial Sequence
  Description of Artificial Sequence: Synthetic oligonucleotide
guccuuugggaugaaguc

SEQ ID NO: 131160 - RNA, 18 nt, Artificial Sequence
  Description of Artificial Sequence: Synthetic oligonucleotide
cggcuguccuuugggaug

SEQ ID NO: 131161 - RNA, 18 nt, Artificial Sequence
  Description of Artificial Sequence: Synthetic oligonucleotide
ccaggcggcuguccuuug

SEQ ID NO: 131162 - RNA, 18 nt, Artificial Sequence
  Description of Artificial Sequence: Synthetic oligonucleotide
caucuccaggcggcuguc

SEQ ID NO: 131163 - RNA, 18 nt, Artificial Sequence
  Description of Artificial Sequence: Synthetic oligonucleotide
caagucaucuccaggcgg

SEQ ID NO: 131164 - RNA, 18 nt, Artificial Sequence
  Description of Artificial Sequence: Synthetic oligonucleotide
ggccucaagucaucucca

SEQ ID NO: 131165 - RNA, 18 nt, Artificial Sequence
  Description of Artificial Sequence: Synthetic oligonucleotide
aguaaggccucaagucau

SEQ ID NO: 131166 - RNA, 18 nt, Artificial Sequence
  Description of Artificial Sequence: Synthetic oligonucleotide
guuuaaguaaggccucaa

SEQ ID NO: 131167 - RNA, 18 nt, Artificial Sequence
  Description of Artificial Sequence: Synthetic oligonucleotide
gcuggguuuaaguaaggc

SEQ ID NO: 131168 - RNA, 18 nt, Artificial Sequence
  Description of Artificial Sequence: Synthetic oligonucleotide
agggagcuggguuuaagu

SEQ ID NO: 131169 - RNA, 18 nt, Artificial Sequence
  Description of Artificial Sequence: Synthetic oligonucleotide
gaagaagggagcuggguu

SEQ ID NO: 131170 - RNA, 18 nt, Artificial Sequence
  Description of Artificial Sequence: Synthetic oligonucleotide
cuagggaagaagggagcu

SEQ ID NO: 131171 - RNA, 18 nt, Artificial Sequence
  Description of Artificial Sequence: Synthetic oligonucleotide
ccaggcuagggaagaagg

SEQ ID NO: 131172 - RNA, 18 nt, Artificial Sequence
  Description of Artificial Sequence: Synthetic oligonucleotide
aagcaccaggcuagggaa

SEQ ID NO: 131173 - RNA, 18 nt, Artificial Sequence
  Description of Artificial Sequence: Synthetic oligonucleotide
aggagaagcaccaggcua

SEQ ID NO: 131174 - RNA, 18 nt, Artificial Sequence
  Description of Artificial Sequence: Synthetic oligonucleotide
aggagaggagaagcacca

SEQ ID NO: 131175 - RNA, 18 nt, Artificial Sequence
  Description of Artificial Sequence: Synthetic oligonucleotide
gggcuaggagaggagaag

SEQ ID NO: 131176 - RNA, 18 nt, Artificial Sequence
  Description of Artificial Sequence: Synthetic oligonucleotide
cugucuggacaccaugac

SEQ ID NO: 131177 - RNA, 18 nt, Artificial Sequence
  Description of Artificial Sequence: Synthetic oligonucleotide
gggcucugucuggacacc

SEQ ID NO: 131178 - RNA, 18 nt, Artificial Sequence
  Description of Artificial Sequence: Synthetic oligonucleotide
ucacagggcucugucugg

SEQ ID NO: 131179 - RNA, 18 nt, Artificial Sequence
  Description of Artificial Sequence: Synthetic oligonucleotide
cagccucacagggcucug

SEQ ID NO: 131180 - RNA, 18 nt, Artificial Sequence
  Description of Artificial Sequence: Synthetic oligonucleotide
ggacccagccucacaggg

SEQ ID NO: 131181 - RNA, 18 nt, Artificial Sequence
  Description of Artificial Sequence: Synthetic oligonucleotide
caauuggacccagccuca

SEQ ID NO: 131182 - RNA, 18 nt, Artificial Sequence
  Description of Artificial Sequence: Synthetic oligonucleotide
ugccacaauuggacccag

SEQ ID NO: 131183 - RNA, 18 nt, Artificial Sequence
  Description of Artificial Sequence: Synthetic oligonucleotide
ccaagugccacaauugga

SEQ ID NO: 131184 - RNA, 18 nt, Artificial Sequence
  Description of Artificial Sequence: Synthetic oligonucleotide
gugccccaagugccacaa

SEQ ID NO: 131185 - RNA, 18 nt, Artificial Sequence
  Description of Artificial Sequence: Synthetic oligonucleotide
gcaaggugccccaagugc

SEQ ID NO: 131186 - RNA, 18 nt, Artificial Sequence
  Description of Artificial Sequence: Synthetic oligonucleotide
gaggagcaaggugcccca

SEQ ID NO: 131187 - RNA, 18 nt, Artificial Sequence
  Description of Artificial Sequence: Synthetic oligonucleotide
agaaggaggagcaaggug

SEQ ID NO: 131188 - RNA, 18 nt, Artificial Sequence
  Description of Artificial Sequence: Synthetic oligonucleotide
gcagcagaaggaggagca

SEQ ID NO: 131189 - RNA, 18 nt, Artificial Sequence
  Description of Artificial Sequence: Synthetic oligonucleotide
gggcagcagcagaaggag

SEQ ID NO: 131190 - RNA, 18 nt, Artificial Sequence
  Description of Artificial Sequence: Synthetic oligonucleotide
gagggaggcagcagaggu

SEQ ID NO: 131191 - RNA, 18 nt, Artificial Sequence
  Description of Artificial Sequence: Synthetic oligonucleotide
cagcagagggaggcagca

SEQ ID NO: 131192 - RNA, 18 nt, Artificial Sequence
  Description of Artificial Sequence: Synthetic oligonucleotide
ggugacagcagagggagg

SEQ ID NO: 131193 - RNA, 18 nt, Artificial Sequence
  Description of Artificial Sequence: Synthetic oligonucleotide
agcaaggugacagcagag

SEQ ID NO: 131194 - RNA, 18 nt, Artificial Sequence
  Description of Artificial Sequence: Synthetic oligonucleotide
ggcugagcaaggugacag

SEQ ID NO: 131195 - RNA, 18 nt, Artificial Sequence
  Description of Artificial Sequence: Synthetic oligonucleotide
gggauggcugagcaaggu

SEQ ID NO: 131196 - RNA, 18 nt, Artificial Sequence
  Description of Artificial Sequence: Synthetic oligonucleotide
aagacgggauggcugagc

SEQ ID NO: 131197 - RNA, 18 nt, Artificial Sequence
  Description of Artificial Sequence: Synthetic oligonucleotide
uggagaagacgggauggc

SEQ ID NO: 131198 - RNA, 18 nt, Artificial Sequence
  Description of Artificial Sequence: Synthetic oligonucleotide
gguguuggagaagacggg

SEQ ID NO: 131199 - RNA, 18 nt, Artificial Sequence
  Description of Artificial Sequence: Synthetic oligonucleotide
gaggugguguuggagaag

SEQ ID NO: 131200 - RNA, 18 nt, Artificial Sequence
  Description of Artificial Sequence: Synthetic oligonucleotide
cuggagaggugguguugg

SEQ ID NO: 131201 - RNA, 18 nt, Artificial Sequence
  Description of Artificial Sequence: Synthetic oligonucleotide
ggccucuggagagguggu

SEQ ID NO: 131202 - RNA, 18 nt, Artificial Sequence
  Description of Artificial Sequence: Synthetic oligonucleotide
uccuuggccucuggagag

SEQ ID NO: 131203 - RNA, 18 nt, Artificial Sequence
  Description of Artificial Sequence: Synthetic oligonucleotide
aggccuccuuggccucug

SEQ ID NO: 131204 - RNA, 18 nt, Artificial Sequence
  Description of Artificial Sequence: Synthetic oligonucleotide
uuccaaggccuccuuggc

SEQ ID NO: 131205 - RNA, 18 nt, Artificial Sequence
  Description of Artificial Sequence: Synthetic oligonucleotide
aucguuuccaaggccucc

SEQ ID NO: 131206 - RNA, 18 nt, Artificial Sequence
  Description of Artificial Sequence: Synthetic oligonucleotide
gggaaucguuuccaaggc

SEQ ID NO: 131207 - RNA, 18 nt, Artificial Sequence
  Description of Artificial Sequence: Synthetic oligonucleotide
guucccagaaugacuggg

SEQ ID NO: 131208 - RNA, 18 nt, Artificial Sequence
  Description of Artificial Sequence: Synthetic oligonucleotide
aacauguucccagaauga

SEQ ID NO: 131209 - RNA, 18 nt, Artificial Sequence
  Description of Artificial Sequence: Synthetic oligonucleotide
cuuacaacauguucccag

SEQ ID NO: 131210 - RNA, 18 nt, Artificial Sequence
  Description of Artificial Sequence: Synthetic oligonucleotide
cagugcuuacaacauguu

SEQ ID NO: 131211 - RNA, 18 nt, Artificial Sequence
  Description of Artificial Sequence: Synthetic oligonucleotide
ccagucagugcuuacaac

SEQ ID NO: 131212 - RNA, 18 nt, Artificial Sequence
  Description of Artificial Sequence: Synthetic oligonucleotide
uggucccagucagugcuu

SEQ ID NO: 131213 - RNA, 18 nt, Artificial Sequence
  Description of Artificial Sequence: Synthetic oligonucleotide
gugccuggucccagucag

SEQ ID NO: 131214 - RNA, 18 nt, Artificial Sequence
  Description of Artificial Sequence: Synthetic oligonucleotide
gccuggugccugguccca

SEQ ID NO: 131215 - RNA, 18 nt, Artificial Sequence
  Description of Artificial Sequence: Synthetic oligonucleotide
acccugccuggugccugg

SEQ ID NO: 131216 - RNA, 18 nt, Artificial Sequence
  Description of Artificial Sequence: Synthetic oligonucleotide
ucuagacccugccuggug

SEQ ID NO: 131217 - RNA, 18 nt, Artificial Sequence
  Description of Artificial Sequence: Synthetic oligonucleotide
agccuucuagacccugcc

SEQ ID NO: 131218 - RNA, 18 nt, Artificial Sequence
  Description of Artificial Sequence: Synthetic oligonucleotide
accacagccuucuagacc

SEQ ID NO: 131219 - RNA, 18 nt, Artificial Sequence
  Description of Artificial Sequence: Synthetic oligonucleotide
cccucaccacagccuucu

SEQ ID NO: 131220 - RNA, 18 nt, Artificial Sequence
  Description of Artificial Sequence: Synthetic oligonucleotide
gucuucccucaccacagc

SEQ ID NO: 131221 - RNA, 18 nt, Artificial Sequence
  Description of Artificial Sequence: Synthetic oligonucleotide
aaggcgucuucccucacc

SEQ ID NO: 131222 - RNA, 18 nt, Artificial Sequence
  Description of Artificial Sequence: Synthetic oligonucleotide
ggagaaaggcgucuuccc

SEQ ID NO: 131223 - RNA, 18 nt, Artificial Sequence
  Description of Artificial Sequence: Synthetic oligonucleotide
uuggaggagaaaggcguc

SEQ ID NO: 131224 - RNA, 18 nt, Artificial Sequence
  Description of Artificial Sequence: Synthetic oligonucleotide
uuggguuggaggagaaag

SEQ ID NO: 131225 - RNA, 18 nt, Artificial Sequence
  Description of Artificial Sequence: Synthetic oligonucleotide
ugagguuggguuggagga

SEQ ID NO: 131226 - RNA, 18 nt, Artificial Sequence
  Description of Artificial Sequence: Synthetic oligonucleotide
gaggaugagguuggguug

SEQ ID NO: 131227 - RNA, 18 nt, Artificial Sequence
  Description of Artificial Sequence: Synthetic oligonucleotide
agaaggaggaugagguug

SEQ ID NO: 131228 - RNA, 18 nt, Artificial Sequence
  Description of Artificial Sequence: Synthetic oligonucleotide
ccugaagaaggaggauga

SEQ ID NO: 131229 - RNA, 18 nt, Artificial Sequence
  Description of Artificial Sequence: Synthetic oligonucleotide
aagucccugaagaaggag

SEQ ID NO: 131230 - RNA, 18 nt, Artificial Sequence
  Description of Artificial Sequence: Synthetic oligonucleotide
cacccaagucccugaaga

SEQ ID NO: 131231 - RNA, 18 nt, Artificial Sequence
  Description of Artificial Sequence: Synthetic oligonucleotide
guacccacccaagucccu

SEQ ID NO: 131232 - RNA, 18 nt, Artificial Sequence
  Description of Artificial Sequence: Synthetic oligonucleotide
cccaaguacccacccaag

SEQ ID NO: 131233 - RNA, 18 nt, Artificial Sequence
  Description of Artificial Sequence: Synthetic oligonucleotide
ccucacccaaguacccac

SEQ ID NO: 131234 - RNA, 18 nt, Artificial Sequence
  Description of Artificial Sequence: Synthetic oligonucleotide
gggauccucacccaagua

SEQ ID NO: 131235 - RNA, 18 nt, Artificial Sequence
  Description of Artificial Sequence: Synthetic oligonucleotide
cuucagggauccucaccc

SEQ ID NO: 131236 - RNA, 18 nt, Artificial Sequence
  Description of Artificial Sequence: Synthetic oligonucleotide
aaggccuucagggauccu

SEQ ID NO: 131237 - RNA, 18 nt, Artificial Sequence
  Description of Artificial Sequence: Synthetic oligonucleotide
gguugaaggccuucaggg

SEQ ID NO: 131238 - RNA, 18 nt, Artificial Sequence
  Description of Artificial Sequence: Synthetic oligonucleotide
ucucggguugaaggccuu

SEQ ID NO: 131239 - RNA, 18 nt, Artificial Sequence
  Description of Artificial Sequence: Synthetic oligonucleotide
uguuuucucggguugaag

SEQ ID NO: 131240 - RNA, 18 nt, Artificial Sequence
  Description of Artificial Sequence: Synthetic oligonucleotide
ggguuuguuuucucgggu

SEQ ID NO: 131241 - RNA, 18 nt, Artificial Sequence
  Description of Artificial Sequence: Synthetic oligonucleotide
aaccuggguuuguuuucu

SEQ ID NO: 131242 - RNA, 18 nt, Artificial Sequence
  Description of Artificial Sequence: Synthetic oligonucleotide
ucgccaaccuggguuugu

SEQ ID NO: 131243 - RNA, 18 nt, Artificial Sequence
  Description of Artificial Sequence: Synthetic oligonucleotide
ugcagucgccaaccuggg

SEQ ID NO: 131244 - RNA, 18 nt, Artificial Sequence
  Description of Artificial Sequence: Synthetic oligonucleotide
ccuguugcagucgccaac

SEQ ID NO: 131245 - RNA, 18 nt, Artificial Sequence
  Description of Artificial Sequence: Synthetic oligonucleotide
aaguuccuguugcagucg

SEQ ID NO: 131246 - RNA, 18 nt, Artificial Sequence
  Description of Artificial Sequence: Synthetic oligonucleotide
acuccaaguuccuguugc

SEQ ID NO: 131247 - RNA, 18 nt, Artificial Sequence
  Description of Artificial Sequence: Synthetic oligonucleotide
ucuccacuccaaguuccu

SEQ ID NO: 131248 - RNA, 18 nt, Artificial Sequence
  Description of Artificial Sequence: Synthetic oligonucleotide
uuuccucuccacuccaag

SEQ ID NO: 131249 - RNA, 18 nt, Artificial Sequence
  Description of Artificial Sequence: Synthetic oligonucleotide
augcuuuuccucuccacu

SEQ ID NO: 131250 - RNA, 18 nt, Artificial Sequence
  Description of Artificial Sequence: Synthetic oligonucleotide
uucugaugcuuuuccucu

SEQ ID NO: 131251 - RNA, 18 nt, Artificial Sequence
  Description of Artificial Sequence: Synthetic oligonucleotide
ccucuuucugaugcuuuu

SEQ ID NO: 131252 - RNA, 18 nt, Artificial Sequence
  Description of Artificial Sequence: Synthetic oligonucleotide
gucugccucuuucugaug

SEQ ID NO: 131253 - RNA, 18 nt, Artificial Sequence
  Description of Artificial Sequence: Synthetic oligonucleotide
ggauggucugccucuuuc

SEQ ID NO: 131254 - RNA, 18 nt, Artificial Sequence
  Description of Artificial Sequence: Synthetic oligonucleotide
cugguggauggucugccu

SEQ ID NO: 131255 - RNA, 18 nt, Artificial Sequence
  Description of Artificial Sequence: Synthetic oligonucleotide
aaggccugguggaugguc

SEQ ID NO: 131256 - RNA, 18 nt, Artificial Sequence
  Description of Artificial Sequence: Synthetic oligonucleotide
ucucaaaggccuggugga

SEQ ID NO: 131257 - RNA, 18 nt, Artificial Sequence
  Description of Artificial Sequence: Synthetic oligonucleotide
cccuuucucaaaggccug

SEQ ID NO: 131258 - RNA, 18 nt, Artificial Sequence
  Description of Artificial Sequence: Synthetic oligonucleotide
uucuacccuuucucaaag

SEQ ID NO: 131259 - RNA, 18 nt, Artificial Sequence
  Description of Artificial Sequence: Synthetic oligonucleotide
cagaauucuacccuuucu

SEQ ID NO: 131260 - RNA, 18 nt, Artificial Sequence
  Description of Artificial Sequence: Synthetic oligonucleotide
ccagccagaauucuaccc

SEQ ID NO: 131261 - RNA, 18 nt, Artificial Sequence
  Description of Artificial Sequence: Synthetic oligonucleotide
cucuaccagccagaauuc

SEQ ID NO: 131262 - RNA, 18 nt, Artificial Sequence
  Description of Artificial Sequence: Synthetic oligonucleotide
accugcucuaccagccag

SEQ ID NO: 131263 - RNA, 18 nt, Artificial Sequence
  Description of Artificial Sequence: Synthetic oligonucleotide
aucucaccugcucuacca

SEQ ID NO: 131264 - RNA, 18 nt, Artificial Sequence
  Description of Artificial Sequence: Synthetic oligonucleotide
gucccaucucaccugcuc

SEQ ID NO: 131265 - RNA, 18 nt, Artificial Sequence
  Description of Artificial Sequence: Synthetic oligonucleotide
ggaaugucccaucucacc

SEQ ID NO: 131266 - RNA, 18 nt, Artificial Sequence
  Description of Artificial Sequence: Synthetic oligonucleotide
ucuuuggaaugucccauc

SEQ ID NO: 131267 - RNA, 18 nt, Artificial Sequence
  Description of Artificial Sequence: Synthetic oligonucleotide
gcuguucuuuggaauguc

SEQ ID NO: 131268 - RNA, 18 nt, Artificial Sequence
  Description of Artificial Sequence: Synthetic oligonucleotide
cucaggcuguucuuugga

SEQ ID NO: 131269 - RNA, 18 nt, Artificial Sequence
  Description of Artificial Sequence: Synthetic oligonucleotide
cuuggcucaggcuguucu

SEQ ID NO: 131270 - RNA, 18 nt, Artificial Sequence
  Description of Artificial Sequence: Synthetic oligonucleotide
uaggccuuggcucaggcu

SEQ ID NO: 131271 - RNA, 18 nt, Artificial Sequence
  Description of Artificial Sequence: Synthetic oligonucleotide
accacuaggccuuggcuc

SEQ ID NO: 131272 - RNA, 18 nt, Artificial Sequence
  Description of Artificial Sequence: Synthetic oligonucleotide
uuacuaccacuaggccuu

SEQ ID NO: 131273 - RNA, 18 nt, Artificial Sequence
  Description of Artificial Sequence: Synthetic oligonucleotide
gauucuuacuaccacuag

SEQ ID NO: 131274 - RNA, 18 nt, Artificial Sequence
  Description of Artificial Sequence: Synthetic oligonucleotide
ugcuagauucuuacuacc

SEQ ID NO: 131275 - RNA, 18 nt, Artificial Sequence
  Description of Artificial Sequence: Synthetic oligonucleotide
auucuugcuagauucuua

SEQ ID NO: 131276 - RNA, 18 nt, Artificial Sequence
  Description of Artificial Sequence: Synthetic oligonucleotide
ccucaauucuugcuagau

SEQ ID NO: 131277 - RNA, 18 nt, Artificial Sequence
  Description of Artificial Sequence: Synthetic oligonucleotide
uucuuccucaauucuugc

SEQ ID NO: 131278 - RNA, 18 nt, Artificial Sequence
  Description of Artificial Sequence: Synthetic oligonucleotide
caccauucuuccucaauu

SEQ ID NO: 131279 - RNA, 18 nt, Artificial Sequence
  Description of Artificial Sequence: Synthetic oligonucleotide
ucccacaccauucuuccu

SEQ ID NO: 131280 - RNA, 18 nt, Artificial Sequence
  Description of Artificial Sequence: Synthetic oligonucleotide
cccucucccacaccauuc

SEQ ID NO: 131281 - RNA, 18 nt, Artificial Sequence
  Description of Artificial Sequence: Synthetic oligonucleotide
aucaucccucucccacac

SEQ ID NO: 131282 - RNA, 18 nt, Artificial Sequence
  Description of Artificial Sequence: Synthetic oligonucleotide
ucuucaucaucccucucc

SEQ ID NO: 131283 - RNA, 18 nt, Artificial Sequence
  Description of Artificial Sequence: Synthetic oligonucleotide
cucucucuucaucauccc

SEQ ID NO: 131284 - RNA, 18 nt, Artificial Sequence
  Description of Artificial Sequence: Synthetic oligonucleotide
gcccucucucucuucauc

SEQ ID NO: 131285 - RNA, 18 nt, Artificial Sequence
  Description of Artificial Sequence: Synthetic oligonucleotide
agcaggcccucucucucu

SEQ ID NO: 131286 - RNA, 18 nt, Artificial Sequence
  Description of Artificial Sequence: Synthetic oligonucleotide
ucuccagcaggcccucuc

SEQ ID NO: 131287 - RNA, 18 nt, Artificial Sequence
  Description of Artificial Sequence: Synthetic oligonucleotide
uaugcucuccagcaggcc

SEQ ID NO: 131288 - RNA, 18 nt, Artificial Sequence
  Description of Artificial Sequence: Synthetic oligonucleotide
gacccuaugcucuccagc

SEQ ID NO: 131289 - RNA, 18 nt, Artificial Sequence
  Description of Artificial Sequence: Synthetic oligonucleotide
uuccagacccuaugcucu

SEQ ID NO: 131290 - RNA, 18 nt, Artificial Sequence
  Description of Artificial Sequence: Synthetic oligonucleotide
ugguguuccagacccuau

SEQ ID NO: 131291 - RNA, 18 nt, Artificial Sequence
  Description of Artificial Sequence: Synthetic oligonucleotide
cagccugguguuccagac

SEQ ID NO: 131292 - RNA, 18 nt, Artificial Sequence
  Description of Artificial Sequence: Synthetic oligonucleotide
gaccucagccugguguuc

SEQ ID NO: 131293 - RNA, 18 nt, Artificial Sequence
  Description of Artificial Sequence: Synthetic oligonucleotide
aucaggaccucagccugg

SEQ ID NO: 131294 - RNA, 18 nt, Artificial Sequence
  Description of Artificial Sequence: Synthetic oligonucleotide
agcugaucaggaccucag

SEQ ID NO: 131295 - RNA, 18 nt, Artificial Sequence
  Description of Artificial Sequence: Synthetic oligonucleotide
cuugaagcugaucaggac

SEQ ID NO: 131296 - RNA, 18 nt, Artificial Sequence
  Description of Artificial Sequence: Synthetic oligonucleotide
uacuccuugaagcugauc

SEQ ID NO: 131297 - RNA, 18 nt, Artificial Sequence
  Description of Artificial Sequence: Synthetic oligonucleotide
cugcauacuccuugaagc

SEQ ID NO: 131298 - RNA, 18 nt, Artificial Sequence
  Description of Artificial Sequence: Synthetic oligonucleotide
gcucccugcauacuccuu

SEQ ID NO: 131299 - RNA, 18 nt, Artificial Sequence
  Description of Artificial Sequence: Synthetic oligonucleotide
gcccagcucccugcauac

SEQ ID NO: 131300 - RNA, 18 nt, Artificial Sequence
  Description of Artificial Sequence: Synthetic oligonucleotide
uggaagcccagcucccug

SEQ ID NO: 131301 - RNA, 18 nt, Artificial Sequence
  Description of Artificial Sequence: Synthetic oligonucleotide
uuuucuggaagcccagcu

SEQ ID NO: 131302 - RNA, 18 nt, Artificial Sequence
  Description of Artificial Sequence: Synthetic oligonucleotide
guucauuuucuggaagcc

SEQ ID NO: 131303 - RNA, 18 nt, Artificial Sequence
  Description of Artificial Sequence: Synthetic oligonucleotide
gcuguguucauuuucugg

SEQ ID NO: 131304 - RNA, 18 nt, Artificial Sequence
  Description of Artificial Sequence: Synthetic oligonucleotide
gaacugcuguguucauuu

SEQ ID NO: 131305 - RNA, 18 nt, Artificial Sequence
  Description of Artificial Sequence: Synthetic oligonucleotide
cugcagaacugcuguguu

SEQ ID NO: 131306 - RNA, 18 nt, Artificial Sequence
  Description of Artificial Sequence: Synthetic oligonucleotide
guccucugcagaacugcu

SEQ ID NO: 131307 - RNA, 18 nt, Artificial Sequence
  Description of Artificial Sequence: Synthetic oligonucleotide
cucccguccucugcagaa

SEQ ID NO: 131308 - RNA, 18 nt, Artificial Sequence
  Description of Artificial Sequence: Synthetic oligonucleotide
ccagccucccguccucug

SEQ ID NO: 131309 - RNA, 18 nt, Artificial Sequence
  Description of Artificial Sequence: Synthetic oligonucleotide
agcuuccagccucccguc

SEQ ID NO: 131310 - RNA, 18 nt, Artificial Sequence
  Description of Artificial Sequence: Synthetic oligonucleotide
cucccagcuuccagccuc

SEQ ID NO: 131311 - RNA, 18 nt, Artificial Sequence
  Description of Artificial Sequence: Synthetic oligonucleotide
cugaccucccagcuucca

SEQ ID NO: 131312 - RNA, 18 nt, Artificial Sequence
  Description of Artificial Sequence: Synthetic oligonucleotide
cccaccugaccucccagc

SEQ ID NO: 131313 - RNA, 18 nt, Artificial Sequence
  Description of Artificial Sequence: Synthetic oligonucleotide
uccaccccaccugaccuc

SEQ ID NO: 131314 - RNA, 18 nt, Artificial Sequence
  Description of Artificial Sequence: Synthetic oligonucleotide
uaucauccaccccaccug

SEQ ID NO: 131315 - RNA, 18 nt, Artificial Sequence
  Description of Artificial Sequence: Synthetic oligonucleotide
cauuauaucauccacccc

SEQ ID NO: 131316 - RNA, 18 nt, Artificial Sequence
  Description of Artificial Sequence: Synthetic oligonucleotide
acccgcauuauaucaucc

SEQ ID NO: 131317 - RNA, 18 nt, Artificial Sequence
  Description of Artificial Sequence: Synthetic oligonucleotide
cucucacccgcauuauau

SEQ ID NO: 131318 - RNA, 18 nt, Artificial Sequence
  Description of Artificial Sequence: Synthetic oligonucleotide
cauuacucucacccgcau

SEQ ID NO: 131319 - RNA, 18 nt, Artificial Sequence
  Description of Artificial Sequence: Synthetic oligonucleotide
agccucauuacucucacc

SEQ ID NO: 131320 - RNA, 18 nt, Artificial Sequence
  Description of Artificial Sequence: Synthetic oligonucleotide
ccccaagccucauuacuc

SEQ ID NO: 131321 - RNA, 18 nt, Artificial Sequence
  Description of Artificial Sequence: Synthetic oligonucleotide
uccagccccaagccucau

SEQ ID NO: 131322 - RNA, 18 nt, Artificial Sequence
  Description of Artificial Sequence: Synthetic oligonucleotide
uccucuccagccccaagc

SEQ ID NO: 131323 - RNA, 18 nt, Artificial Sequence
  Description of Artificial Sequence: Synthetic oligonucleotide
ucuuguccucuccagccc

SEQ ID NO: 131324 - RNA, 18 nt, Artificial Sequence
  Description of Artificial Sequence: Synthetic oligonucleotide
acccaucuuguccucucc

SEQ ID NO: 131325 - RNA, 18 nt, Artificial Sequence
  Description of Artificial Sequence: Synthetic oligonucleotide
gguuuacccaucuugucc

SEQ ID NO: 131326 - RNA, 18 nt, Artificial Sequence
  Description of Artificial Sequence: Synthetic oligonucleotide
gugaggguuuacccaucu

SEQ ID NO: 131327 - RNA, 18 nt, Artificial Sequence
  Description of Artificial Sequence: Synthetic oligonucleotide
cugaugugaggguuuacc

SEQ ID NO: 131328 - RNA, 18 nt, Artificial Sequence
  Description of Artificial Sequence: Synthetic oligonucleotide
ucacucugaugugagggu

SEQ ID NO: 131329 - RNA, 18 nt, Artificial Sequence
  Description of Artificial Sequence: Synthetic oligonucleotide
ggaugucacucugaugug

SEQ ID NO: 131330 - RNA, 18 nt, Artificial Sequence
  Description of Artificial Sequence: Synthetic oligonucleotide
cuccuggaugucacucug

SEQ ID NO: 131331 - RNA, 18 nt, Artificial Sequence
  Description of Artificial Sequence: Synthetic oligonucleotide
uauuccuccuggauguca

SEQ ID NO: 131332 - RNA, 18 nt, Artificial Sequence
  Description of Artificial Sequence: Synthetic oligonucleotide
gagcuuauuccuccugga

SEQ ID NO: 131333 - RNA, 18 nt, Artificial Sequence
  Description of Artificial Sequence: Synthetic oligonucleotide
ccugggagcuuauuccuc

SEQ ID NO: 131334 - RNA, 18 nt, Artificial Sequence
  Description of Artificial Sequence: Synthetic oligonucleotide
caggcccugggagcuuau

SEQ ID NO: 131335 - RNA, 18 nt, Artificial Sequence
  Description of Artificial Sequence: Synthetic oligonucleotide
ugagacaggcccugggag

SEQ ID NO: 131336 - RNA, 18 nt, Artificial Sequence
  Description of Artificial Sequence: Synthetic oligonucleotide
gagcuugagacaggcccu

SEQ ID NO: 131337 - RNA, 18 nt, Artificial Sequence
  Description of Artificial Sequence: Synthetic oligonucleotide
aggaagagcuugagacag

SEQ ID NO: 131338 - RNA, 18 nt, Artificial Sequence
  Description of Artificial Sequence: Synthetic oligonucleotide
gaguaaggaagagcuuga

SEQ ID NO: 131339 - RNA, 18 nt, Artificial Sequence
  Description of Artificial Sequence: Synthetic oligonucleotide
ccugggaguaaggaagag

SEQ ID NO: 131340 - RNA, 18 nt, Artificial Sequence
  Description of Artificial Sequence: Synthetic oligonucleotide
cagugccugggaguaagg

SEQ ID NO: 131341 - RNA, 18 nt, Artificial Sequence
  Description of Artificial Sequence: Synthetic oligonucleotide
uaagacagugccugggag

SEQ ID NO: 131342 - RNA, 18 nt, Artificial Sequence
  Description of Artificial Sequence: Synthetic oligonucleotide
ugccuuaagacagugccu

SEQ ID NO: 131343 - RNA, 18 nt, Artificial Sequence
  Description of Artificial Sequence: Synthetic oligonucleotide
ucagaugccuuaagacag

SEQ ID NO: 131344 - RNA, 18 nt, Artificial Sequence
  Description of Artificial Sequence: Synthetic oligonucleotide
gcaugucagaugccuuaa

SEQ ID NO: 131345 - RNA, 18 nt, Artificial Sequence
  Description of Artificial Sequence: Synthetic oligonucleotide
augaugcaugucagaugc

SEQ ID NO: 131346 - RNA, 18 nt, Artificial Sequence
  Description of Artificial Sequence: Synthetic oligonucleotide
augagaugaugcauguca

SEQ ID NO: 131347 - RNA, 18 nt, Artificial Sequence
  Description of Artificial Sequence: Synthetic oligonucleotide
auuaaaugagaugaugca

SEQ ID NO: 131348 - RNA, 18 nt, Artificial Sequence
  Description of Artificial Sequence: Synthetic oligonucleotide
ggaggauuaaaugagaug

SEQ ID NO: 131349 - RNA, 18 nt, Artificial Sequence
  Description of Artificial Sequence: Synthetic oligonucleotide
ggaagggaggauuaaaug

SEQ ID NO: 131350 - RNA, 18 nt, Artificial Sequence
  Description of Artificial Sequence: Synthetic oligonucleotide
agggaggaagggaggauu

SEQ ID NO: 131351 - RNA, 18 nt, Artificial Sequence
  Description of Artificial Sequence: Synthetic oligonucleotide
uuaauagggaggaaggga

SEQ ID NO: 131352 - RNA, 18 nt, Artificial Sequence
  Description of Artificial Sequence: Synthetic oligonucleotide
cuagguuaauagggagga

SEQ ID NO: 131353 - RNA, 18 nt, Artificial Sequence
  Description of Artificial Sequence: Synthetic oligonucleotide
aaucucuagguuaauagg

SEQ ID NO: 131354 - RNA, 18 nt, Artificial Sequence
  Description of Artificial Sequence: Synthetic oligonucleotide
aaaacaaucucuagguua

SEQ ID NO: 131355 - RNA, 18 nt, Artificial Sequence
  Description of Artificial Sequence: Synthetic oligonucleotide
aaacaaaaacaaucucua

SEQ ID NO: 131356 - RNA, 18 nt, Artificial Sequence
  Description of Artificial Sequence: Synthetic oligonucleotide
auaaaaaacaaaaacaau

SEQ ID NO: 131357 - RNA, 18 nt, Artificial Sequence
  Description of Artificial Sequence: Synthetic oligonucleotide
ggagaauaaaaaacaaaa

SEQ ID NO: 131358 - RNA, 18 nt, Artificial Sequence
  Description of Artificial Sequence: Synthetic oligonucleotide
gaggaggagaauaaaaaa

SEQ ID NO: 131359 - RNA, 18 nt, Artificial Sequence
  Description of Artificial Sequence: Synthetic oligonucleotide
ggagggaggaggagaaua

SEQ ID NO: 131360 - RNA, 18 nt, Artificial Sequence
  Description of Artificial Sequence: Synthetic oligonucleotide
gggagggaggaggagaau

SEQ ID NO: 131361 - RNA, 18 nt, Artificial Sequence
  Description of Artificial Sequence: Synthetic oligonucleotide
agguuaggagggaguggg

SEQ ID NO: 131362 - RNA, 18 nt, Artificial Sequence
  Description of Artificial Sequence: Synthetic oligonucleotide
ucucuagguuaggaggga

SEQ ID NO: 131363 - RNA, 18 nt, Artificial Sequence
  Description of Artificial Sequence: Synthetic oligonucleotide
aacaaucucuagguuagg

SEQ ID NO: 131364 - RNA, 18 nt, Artificial Sequence
  Description of Artificial Sequence: Synthetic oligonucleotide
ucuguaacaaucucuagg

SEQ ID NO: 131365 - RNA, 18 nt, Artificial Sequence
  Description of Artificial Sequence: Synthetic oligonucleotide
cagcuucuguaacaaucu

SEQ ID NO: 131366 - RNA, 18 nt, Artificial Sequence
  Description of Artificial Sequence: Synthetic oligonucleotide
aauuucagcuucuguaac

SEQ ID NO: 131367 - RNA, 18 nt, Artificial Sequence
  Description of Artificial Sequence: Synthetic oligonucleotide
aacgcaauuucagcuucu

SEQ ID NO: 131368 - RNA, 18 nt, Artificial Sequence
  Description of Artificial Sequence: Synthetic oligonucleotide
cuuagaacgcaauuucag

SEQ ID NO: 131369 - RNA, 18 nt, Artificial Sequence
  Description of Artificial Sequence: Synthetic oligonucleotide
caccucuuagaacgcaau

SEQ ID NO: 131370 - RNA, 18 nt, Artificial Sequence
  Description of Artificial Sequence: Synthetic oligonucleotide
cacuucaccucuuagaac

SEQ ID NO: 131371 - RNA, 18 nt, Artificial Sequence
  Description of Artificial Sequence: Synthetic oligonucleotide
aaaaucacuucaccucuu

SEQ ID NO: 131372 - RNA, 18 nt, Artificial Sequence
  Description of Artificial Sequence: Synthetic oligonucleotide
gaaaaaaaaucacuucac

SEQ ID NO: 131373 - RNA, 18 nt, Artificial Sequence
  Description of Artificial Sequence: Synthetic oligonucleotide
uuucagaaaaaaaaucac

SEQ ID NO: 131374 - RNA, 18 nt, Artificial Sequence
  Description of Artificial Sequence: Synthetic oligonucleotide
gugaguuucagaaaaaaa

SEQ ID NO: 131375 - RNA, 18 nt, Artificial Sequence
  Description of Artificial Sequence: Synthetic oligonucleotide
guugugugaguuucagaa

SEQ ID NO: 131376 - RNA, 18 nt, Artificial Sequence
  Description of Artificial Sequence: Synthetic oligonucleotide
uccuaguugugugaguuu

SEQ ID NO: 131377 - RNA, 18 nt, Artificial Sequence
  Description of Artificial Sequence: Synthetic oligonucleotide
ccacuuccuaguugugug

SEQ ID NO: 131378 - RNA, 18 nt, Artificial Sequence
  Description of Artificial Sequence: Synthetic oligonucleotide
cucagccacuuccuaguu

SEQ ID NO: 131379 - RNA, 18 nt, Artificial Sequence
  Description of Artificial Sequence: Synthetic oligonucleotide
ccugacucagccacuucc

SEQ ID NO: 131380 - RNA, 18 nt, Artificial Sequence
  Description of Artificial Sequence: Synthetic oligonucleotide
caaguccugacucagcca

SEQ ID NO: 131381 - RNA, 18 nt, Artificial Sequence
  Description of Artificial Sequence: Synthetic oligonucleotide
ggguucaaguccugacuc

SEQ ID NO: 131382 - RNA, 18 nt, Artificial Sequence
  Description of Artificial Sequence: Synthetic oligonucleotide
gaccuggguucaaguccu

SEQ ID NO: 131383 - RNA, 18 nt, Artificial Sequence
  Description of Artificial Sequence: Synthetic oligonucleotide
agggagaccuggguucaa

SEQ ID NO: 131384 - RNA, 18 nt, Artificial Sequence
  Description of Artificial Sequence: Synthetic oligonucleotide
gauccagggagaccuggg

SEQ ID NO: 131385 - RNA, 18 nt, Artificial Sequence
  Description of Artificial Sequence: Synthetic oligonucleotide
guucugauccagggagac

SEQ ID NO: 131386 - RNA, 18 nt, Artificial Sequence
  Description of Artificial Sequence: Synthetic oligonucleotide
cuccuguucugauccagg

SEQ ID NO: 131387 - RNA, 18 nt, Artificial Sequence
  Description of Artificial Sequence: Synthetic oligonucleotide
aagagcuccuguucugau

SEQ ID NO: 131388 - RNA, 18 nt, Artificial Sequence
  Description of Artificial Sequence: Synthetic oligonucleotide
uaguuaagagcuccuguu

SEQ ID NO: 131389 - RNA, 18 nt, Artificial Sequence
  Description of Artificial Sequence: Synthetic oligonucleotide
cacuguaguuaagagcuc

SEQ ID NO: 131390 - RNA, 18 nt, Artificial Sequence
  Description of Artificial Sequence: Synthetic oligonucleotide
ucagccacuguaguuaag

SEQ ID NO: 131391 - RNA, 18 nt, Artificial Sequence
  Description of Artificial Sequence: Synthetic oligonucleotide
gcuauucagccacuguag

SEQ ID NO: 131392 - RNA, 18 nt, Artificial Sequence
  Description of Artificial Sequence: Synthetic oligonucleotide
gagaagcuauucagccac

SEQ ID NO: 131393 - RNA, 18 nt, Artificial Sequence
  Description of Artificial Sequence: Synthetic oligonucleotide
cuuuggagaagcuauuca

SEQ ID NO: 131394 - RNA, 18 nt, Artificial Sequence
  Description of Artificial Sequence: Synthetic oligonucleotide
ggagccuuuggagaagcu

SEQ ID NO: 131395 - RNA, 18 nt, Artificial Sequence
  Description of Artificial Sequence: Synthetic oligonucleotide
cacagggagccuuuggag

SEQ ID NO: 131396 - RNA, 18 nt, Artificial Sequence
  Description of Artificial Sequence: Synthetic oligonucleotide
gagaacacagggagccuu

SEQ ID NO: 131397 - RNA, 18 nt, Artificial Sequence
  Description of Artificial Sequence: Synthetic oligonucleotide
acggugagaacacaggga

SEQ ID NO: 131398 - RNA, 18 nt, Artificial Sequence
  Description of Artificial Sequence: Synthetic oligonucleotide
ugaucacggugagaacac

SEQ ID NO: 131399 - RNA, 18 nt, Artificial Sequence
  Description of Artificial Sequence: Synthetic oligonucleotide
caacuugaucacggugag

SEQ ID NO: 131400 - RNA, 18 nt, Artificial Sequence
  Description of Artificial Sequence: Synthetic oligonucleotide
ccccucaacuugaucacg

SEQ ID NO: 131401 - RNA, 18 nt, Artificial Sequence
  Description of Artificial Sequence: Synthetic oligonucleotide
ggaagccccucaacuuga

SEQ ID NO: 131402 - RNA, 18 nt, Artificial Sequence
  Description of Artificial Sequence: Synthetic oligonucleotide
gagccggaagccccucaa

SEQ ID NO: 131403 - RNA, 18 nt, Artificial Sequence
  Description of Artificial Sequence: Synthetic oligonucleotide
gaagggagccggaagccc

SEQ ID NO: 131404 - RNA, 18 nt, Artificial Sequence
  Description of Artificial Sequence: Synthetic oligonucleotide
cuguagaagggagccgga

SEQ ID NO: 131405 - RNA, 18 nt, Artificial Sequence
  Description of Artificial Sequence: Synthetic oligonucleotide
ugaggcuguagaagggag

SEQ ID NO: 131406 - RNA, 18 nt, Artificial Sequence
  Description of Artificial Sequence: Synthetic oligonucleotide
guuucugaggcuguagaa

SEQ ID NO: 131407 - RNA, 18 nt, Artificial Sequence
  Description of Artificial Sequence: Synthetic oligonucleotide
gucugguuucugaggcug

SEQ ID NO: 131408 - RNA, 18 nt, Artificial Sequence
  Description of Artificial Sequence: Synthetic oligonucleotide
aacgagucugguuucuga

SEQ ID NO: 131409 - RNA, 18 nt, Artificial Sequence
  Description of Artificial Sequence: Synthetic oligonucleotide
agaagaacgagucugguu

SEQ ID NO: 131410 - RNA, 18 nt, Artificial Sequence
  Description of Artificial Sequence: Synthetic oligonucleotide
uucccagaagaacgaguc

SEQ ID NO: 131411 - RNA, 18 nt, Artificial Sequence
  Description of Artificial Sequence: Synthetic oligonucleotide
caggguucccagaagaac

SEQ ID NO: 131412 - RNA, 18 nt, Artificial Sequence
  Description of Artificial Sequence: Synthetic oligonucleotide
gugggcaggguucccaga

SEQ ID NO: 131413 - RNA, 18 nt, Artificial Sequence
  Description of Artificial Sequence: Synthetic oligonucleotide
ugggagugggcaggguuc

SEQ ID NO: 131414 - RNA, 18 nt, Artificial Sequence
  Description of Artificial Sequence: Synthetic oligonucleotide
gguccugggagugggcag

SEQ ID NO: 131415 - RNA, 18 nt, Artificial Sequence
  Description of Artificial Sequence: Synthetic oligonucleotide
aucuugguccugggagug

SEQ ID NO: 131416 - RNA, 18 nt, Artificial Sequence
  Description of Artificial Sequence: Synthetic oligonucleotide
ggccaaucuugguccugg

SEQ ID NO: 131417 - RNA, 18 nt, Artificial Sequence
  Description of Artificial Sequence: Synthetic oligonucleotide
ccucaggccaaucuuggu

SEQ ID NO: 131418 - RNA, 18 nt, Artificial Sequence
  Description of Artificial Sequence: Synthetic oligonucleotide
ugcagccucaggccaauc

SEQ ID NO: 131419 - RNA, 18 nt, Artificial Sequence
  Description of Artificial Sequence: Synthetic oligonucleotide
uuuagugcagccucaggc

SEQ ID NO: 131420 - RNA, 18 nt, Artificial Sequence
  Description of Artificial Sequence: Synthetic oligonucleotide
ugaauuuuagugcagccu

SEQ ID NO: 131421 - RNA, 18 nt, Artificial Sequence
  Description of Artificial Sequence: Synthetic oligonucleotide
cuaagugaauuuuagugc

SEQ ID NO: 131422 - RNA, 18 nt, Artificial Sequence
  Description of Artificial Sequence: Synthetic oligonucleotide
cgacccuaagugaauuuu

SEQ ID NO: 131423 - RNA, 18 nt, Artificial Sequence
  Description of Artificial Sequence: Synthetic oligonucleotide
augcucgacccuaaguga

SEQ ID NO: 131424 - RNA, 18 nt, Artificial Sequence
  Description of Artificial Sequence: Synthetic oligonucleotide
acaggaugcucgacccua

SEQ ID NO: 131425 - RNA, 18 nt, Artificial Sequence
  Description of Artificial Sequence: Synthetic oligonucleotide
agcaaacaggaugcucga

SEQ ID NO: 131426 - RNA, 18 nt, Artificial Sequence
  Description of Artificial Sequence: Synthetic oligonucleotide
uuaucagcaaacaggaug

SEQ ID NO: 131427 - RNA, 18 nt, Artificial Sequence
  Description of Artificial Sequence: Synthetic oligonucleotide
aauauuuaucagcaaaca

SEQ ID NO: 131428 - RNA, 18 nt, Artificial Sequence
  Description of Artificial Sequence: Synthetic oligonucleotide
uccuuaauauuuaucagc

SEQ ID NO: 131429 - RNA, 18 nt, Artificial Sequence
  Description of Artificial Sequence: Synthetic oligonucleotide
aauucuccuuaauauuua

SEQ ID NO: 131430 - RNA, 18 nt, Artificial Sequence
  Description of Artificial Sequence: Synthetic oligonucleotide
ucaugaauucuccuuaau

SEQ ID NO: 131431 - RNA, 18 nt, Artificial Sequence
  Description of Artificial Sequence: Synthetic oligonucleotide
aagagucaugaauucucc

SEQ ID NO: 131432 - RNA, 18 nt, Artificial Sequence
  Description of Artificial Sequence: Synthetic oligonucleotide
cugucaagagucaugaau

SEQ ID NO: 131433 - RNA, 18 nt, Artificial Sequence
  Description of Artificial Sequence: Synthetic oligonucleotide
aaaagcugucaagaguca

SEQ ID NO: 131434 - RNA, 18 nt, Artificial Sequence
  Description of Artificial Sequence: Synthetic oligonucleotide
gagagaaaagcugucaag

SEQ ID NO: 131435 - RNA, 18 nt, Artificial Sequence
  Description of Artificial Sequence: Synthetic oligonucleotide
gugaagagagaaaagcug

SEQ ID NO: 131436 - RNA, 18 nt, Artificial Sequence
  Description of Artificial Sequence: Synthetic oligonucleotide
gggagugaagagagaaaa

SEQ ID NO: 131437 - RNA, 18 nt, Artificial Sequence
  Description of Artificial Sequence: Synthetic oligonucleotide
cccuccccuugacuuggg

SEQ ID NO: 131438 - RNA, 18 nt, Artificial Sequence
  Description of Artificial Sequence: Synthetic oligonucleotide
gccaccccuccccuugac

SEQ ID NO: 131439 - RNA, 18 nt, Artificial Sequence
  Description of Artificial Sequence: Synthetic oligonucleotide
ccccugccaccccucccc

SEQ ID NO: 131440 - RNA, 18 nt, Artificial Sequence
  Description of Artificial Sequence: Synthetic oligonucleotide
acagaccccugccacccc

SEQ ID NO: 131441 - RNA, 18 nt, Artificial Sequence
  Description of Artificial Sequence: Synthetic oligonucleotide
aggaaacagaccccugcc

SEQ ID NO: 131442 - RNA, 18 nt, Artificial Sequence
  Description of Artificial Sequence: Synthetic oligonucleotide
cuuccaggaaacagaccc

SEQ ID NO: 131443 - RNA, 18 nt, Artificial Sequence
  Description of Artificial Sequence: Synthetic oligonucleotide
ccugacuuccaggaaaca

SEQ ID NO: 131444 - RNA, 18 nt, Artificial Sequence
  Description of Artificial Sequence: Synthetic oligonucleotide
augagccugacuuccagg

SEQ ID NO: 131445 - RNA, 18 nt, Artificial Sequence
  Description of Artificial Sequence: Synthetic oligonucleotide
gccagaugagccugacuu

SEQ ID NO: 131446 - RNA, 18 nt, Artificial Sequence
  Description of Artificial Sequence: Synthetic oligonucleotide
aacaggccagaugagccu

SEQ ID NO: 131447 - RNA, 18 nt, Artificial Sequence
  Description of Artificial Sequence: Synthetic oligonucleotide
augccaacaggccagaug

SEQ ID NO: 131448 - RNA, 18 nt, Artificial Sequence
  Description of Artificial Sequence: Synthetic oligonucleotide
cccccaugccaacaggcc

SEQ ID NO: 131449 - RNA, 18 nt, Artificial Sequence
  Description of Artificial Sequence: Synthetic oligonucleotide
ucccacccccaugccaac

SEQ ID NO: 131450 - RNA, 18 nt, Artificial Sequence
  Description of Artificial Sequence: Synthetic oligonucleotide
cacugucccacccccaug

SEQ ID NO: 131451 - RNA, 18 nt, Artificial Sequence
  Description of Artificial Sequence: Synthetic oligonucleotide
gugcacacugucccaccc

SEQ ID NO: 131452 - RNA, 18 nt, Artificial Sequence
  Description of Artificial Sequence: Synthetic oligonucleotide
acacugugcacacugucc

SEQ ID NO: 131453 - RNA, 18 nt, Artificial Sequence
  Description of Artificial Sequence: Synthetic oligonucleotide
cccccacacugugcacac

SEQ ID NO: 131454 - RNA, 18 nt, Artificial Sequence
  Description of Artificial Sequence: Synthetic oligonucleotide
cccugcccccacacugug

SEQ ID NO: 131455 - RNA, 18 nt, Artificial Sequence
  Description of Artificial Sequence: Synthetic oligonucleotide
cccuccccugcccccaca

SEQ ID NO: 131456 - RNA, 18 nt, Artificial Sequence
  Description of Artificial Sequence: Synthetic oligonucleotide
cuuagcccuccccugccc

SEQ ID NO: 131457 - RNA, 18 nt, Artificial Sequence
  Description of Artificial Sequence: Synthetic oligonucleotide
gccugcuuagcccucccc

SEQ ID NO: 131458 - RNA, 18 nt, Artificial Sequence
  Description of Artificial Sequence: Synthetic oligonucleotide
cccaggccugcuuagccc

SEQ ID NO: 131459 - RNA, 18 nt, Artificial Sequence
  Description of Artificial Sequence: Synthetic oligonucleotide
ucaaacccaggccugcuu

SEQ ID NO: 131460 - RNA, 18 nt, Artificial Sequence
  Description of Artificial Sequence: Synthetic oligonucleotide
agcccucaaacccaggcc

SEQ ID NO: 131461 - RNA, 18 nt, Artificial Sequence
  Description of Artificial Sequence: Synthetic oligonucleotide
ggagcagcccucaaaccc

SEQ ID NO: 131462 - RNA, 18 nt, Artificial Sequence
  Description of Artificial Sequence: Synthetic oligonucleotide
ucuccggagcagcccuca

SEQ ID NO: 131463 - RNA, 18 nt, Artificial Sequence
  Description of Artificial Sequence: Synthetic oligonucleotide
gacggucuccggagcagc

SEQ ID NO: 131464 - RNA, 18 nt, Artificial Sequence
  Description of Artificial Sequence: Synthetic oligonucleotide
ggagugacggucuccgga

SEQ ID NO: 131465 - RNA, 18 nt, Artificial Sequence
  Description of Artificial Sequence: Synthetic oligonucleotide
caccuggagugacggucu

SEQ ID NO: 131466 - RNA, 18 nt, Artificial Sequence
  Description of Artificial Sequence: Synthetic oligonucleotide
gaaugcaccuggagugac

SEQ ID NO: 131467 - RNA, 18 nt, Artificial Sequence
  Description of Artificial Sequence: Synthetic oligonucleotide
uuccagaaugcaccugga

SEQ ID NO: 131468 - RNA, 18 nt, Artificial Sequence
  Description of Artificial Sequence: Synthetic oligonucleotide
aaugcuuccagaaugcac

SEQ ID NO: 131469 - RNA, 18 nt, Artificial Sequence
  Description of Artificial Sequence: Synthetic oligonucleotide
ggucuaaugcuuccagaa

SEQ ID NO: 131470 - RNA, 18 nt, Artificial Sequence
  Description of Artificial Sequence: Synthetic oligonucleotide
gggucuaaugcuuccaga

SEQ ID NO: 131471 - RNA, 18 nt, Artificial Sequence
  Description of Artificial Sequence: Synthetic oligonucleotide
uggucgcuccauccuggg

SEQ ID NO: 131472 - RNA, 18 nt, Artificial Sequence
  Description of Artificial Sequence: Synthetic oligonucleotide
caugcuggucgcuccauc

SEQ ID NO: 131473 - RNA, 18 nt, Artificial Sequence
  Description of Artificial Sequence: Synthetic oligonucleotide
gaugacaugcuggucgcu

SEQ ID NO: 131474 - RNA, 18 nt, Artificial Sequence
  Description of Artificial Sequence: Synthetic oligonucleotide
acauggaugacaugcugg

SEQ ID NO: 131475 - RNA, 18 nt, Artificial Sequence
  Description of Artificial Sequence: Synthetic oligonucleotide
auuccacauggaugacau

SEQ ID NO: 131476 - RNA, 18 nt, Artificial Sequence
  Description of Artificial Sequence: Synthetic oligonucleotide
ccaagauuccacauggau

SEQ ID NO: 131477 - RNA, 18 nt, Artificial Sequence
  Description of Artificial Sequence: Synthetic oligonucleotide
agccaccaagauuccaca

SEQ ID NO: 131478 - RNA, 18 nt, Artificial Sequence
  Description of Artificial Sequence: Synthetic oligonucleotide
cucaaagccaccaagauu

SEQ ID NO: 131479 - RNA, 18 nt, Artificial Sequence
  Description of Artificial Sequence: Synthetic oligonucleotide
auguccucaaagccacca

SEQ ID NO: 131480 - RNA, 18 nt, Artificial Sequence
  Description of Artificial Sequence: Synthetic oligonucleotide
ccagaauguccucaaagc

SEQ ID NO: 131481 - RNA, 18 nt, Artificial Sequence
  Description of Artificial Sequence: Synthetic oligonucleotide
auuuuccagaauguccuc

SEQ ID NO: 131482 - RNA, 18 nt, Artificial Sequence
  Description of Artificial Sequence: Synthetic oligonucleotide
guggcauuuuccagaaug

SEQ ID NO: 131483 - RNA, 18 nt, Artificial Sequence
  Description of Artificial Sequence: Synthetic oligonucleotide
ggucaguggcauuuucca

SEQ ID NO: 131484 - RNA, 18 nt, Artificial Sequence
  Description of Artificial Sequence: Synthetic oligonucleotide
acacuggucaguggcauu

SEQ ID NO: 131485 - RNA, 18 nt, Artificial Sequence
  Description of Artificial Sequence: Synthetic oligonucleotide
uguucacacuggucagug

SEQ ID NO: 131486 - RNA, 18 nt, Artificial Sequence
  Description of Artificial Sequence: Synthetic oligonucleotide
ccuuuuguucacacuggu

SEQ ID NO: 131487 - RNA, 18 nt, Artificial Sequence
  Description of Artificial Sequence: Synthetic oligonucleotide
acaucccuuuuguucaca

SEQ ID NO: 131488 - RNA, 18 nt, Artificial Sequence
  Description of Artificial Sequence: Synthetic oligonucleotide
auaacacaucccuuuugu

SEQ ID NO: 131489 - RNA, 18 nt, Artificial Sequence
  Description of Artificial Sequence: Synthetic oligonucleotide
gccccauaacacaucccu

SEQ ID NO: 131490 - RNA, 18 nt, Artificial Sequence
  Description of Artificial Sequence: Synthetic oligonucleotide
cuccagccccauaacaca

SEQ ID NO: 131491 - RNA, 18 nt, Artificial Sequence
  Description of Artificial Sequence: Synthetic oligonucleotide
cacaccuccagccccaua

SEQ ID NO: 131492 - RNA, 18 nt, Artificial Sequence
  Description of Artificial Sequence: Synthetic oligonucleotide
cuaaucacaccuccagcc

SEQ ID NO: 131493 - RNA, 18 nt, Artificial Sequence
  Description of Artificial Sequence: Synthetic oligonucleotide
ccuaccuaaucacaccuc

SEQ ID NO: 131494 - RNA, 18 nt, Artificial Sequence
  Description of Artificial Sequence: Synthetic oligonucleotide
ucccuccuaccuaaucac

SEQ ID NO: 131495 - RNA, 18 nt, Artificial Sequence
  Description of Artificial Sequence: Synthetic oligonucleotide
caguuucccuccuaccua

SEQ ID NO: 131496 - RNA, 18 nt, Artificial Sequence
  Description of Artificial Sequence: Synthetic oligonucleotide
uccaacaguuucccuccu

SEQ ID NO: 131497 - RNA, 18 nt, Artificial Sequence
  Description of Artificial Sequence: Synthetic oligonucleotide
gucgguccaacaguuucc

SEQ ID NO: 131498 - RNA, 18 nt, Artificial Sequence
  Description of Artificial Sequence: Synthetic oligonucleotide
caggagucgguccaacag

SEQ ID NO: 131499 - RNA, 18 nt, Artificial Sequence
  Description of Artificial Sequence: Synthetic oligonucleotide
gggcaggagucgguccaa

SEQ ID NO: 131500 - RNA, 18 nt, Artificial Sequence
  Description of Artificial Sequence: Synthetic oligonucleotide
ggucaguguugagcaggg

SEQ ID NO: 131501 - RNA, 18 nt, Artificial Sequence
  Description of Artificial Sequence: Synthetic oligonucleotide
gggucaguguugagcagg

SEQ ID NO: 131502 - RNA, 18 nt, Artificial Sequence
  Description of Artificial Sequence: Synthetic oligonucleotide
cuccaaccacucagaggg

SEQ ID NO: 131503 - RNA, 18 nt, Artificial Sequence
  Description of Artificial Sequence: Synthetic oligonucleotide
acugccuccaaccacuca

SEQ ID NO: 131504 - RNA, 18 nt, Artificial Sequence
  Description of Artificial Sequence: Synthetic oligonucleotide
gggcacugccuccaacca

SEQ ID NO: 131505 - RNA, 18 nt, Artificial Sequence
  Description of Artificial Sequence: Synthetic oligonucleotide
ggauuucugggcacuggg

SEQ ID NO: 131506 - RNA, 18 nt, Artificial Sequence
  Description of Artificial Sequence: Synthetic oligonucleotide
uggugggauuucugggca

SEQ ID NO: 131507 - RNA, 18 nt, Artificial Sequence
  Description of Artificial Sequence: Synthetic oligonucleotide
acuaauggugggauuucu

SEQ ID NO: 131508 - RNA, 18 nt, Artificial Sequence
  Description of Artificial Sequence: Synthetic oligonucleotide
caaucacuaaugguggga

SEQ ID NO: 131509 - RNA, 18 nt, Artificial Sequence
  Description of Artificial Sequence: Synthetic oligonucleotide
aaaaacaaucacuaaugg

SEQ ID NO: 131510 - RNA, 18 nt, Artificial Sequence
  Description of Artificial Sequence: Synthetic oligonucleotide
ucauaaaaaacaaucacu

SEQ ID NO: 131511 - RNA, 18 nt, Artificial Sequence
  Description of Artificial Sequence: Synthetic oligonucleotide
cuuucucauaaaaaacaa

SEQ ID NO: 131512 - RNA, 18 nt, Artificial Sequence
  Description of Artificial Sequence: Synthetic oligonucleotide
cgccucuuucucauaaaa

SEQ ID NO: 131513 - RNA, 18 nt, Artificial Sequence
  Description of Artificial Sequence: Synthetic oligonucleotide
cuccacgccucuuucuca

SEQ ID NO: 131514 - RNA, 18 nt, Artificial Sequence
  Description of Artificial Sequence: Synthetic oligonucleotide
uacuucuccacgccucuu

SEQ ID NO: 131515 - RNA, 18 nt, Artificial Sequence
  Description of Artificial Sequence: Synthetic oligonucleotide
cccaauacuucuccacgc

SEQ ID NO: 131516 - RNA, 18 nt, Artificial Sequence
  Description of Artificial Sequence: Synthetic oligonucleotide
auugccccaauacuucuc

SEQ ID NO: 131517 - RNA, 18 nt, Artificial Sequence
  Description of Artificial Sequence: Synthetic oligonucleotide
gacacauugccccaauac

SEQ ID NO: 131518 - RNA, 18 nt, Artificial Sequence
  Description of Artificial Sequence: Synthetic oligonucleotide
ucccugacacauugcccc

SEQ ID NO: 131519 - RNA, 18 nt, Artificial Sequence
  Description of Artificial Sequence: Synthetic oligonucleotide
auuccucccugacacauu

SEQ ID NO: 131520 - RNA, 18 nt, Artificial Sequence
  Description of Artificial Sequence: Synthetic oligonucleotide
uggugauuccucccugac

SEQ ID NO: 131521 - RNA, 18 nt, Artificial Sequence
  Description of Artificial Sequence: Synthetic oligonucleotide
ggauguggugauuccucc

SEQ ID NO: 131522 - RNA, 18 nt, Artificial Sequence
  Description of Artificial Sequence: Synthetic oligonucleotide
cguagggauguggugauu

SEQ ID NO: 131523 - RNA, 18 nt, Artificial Sequence
  Description of Artificial Sequence: Synthetic oligonucleotide
acugccguagggaugugg

SEQ ID NO: 131524 - RNA, 18 nt, Artificial Sequence
  Description of Artificial Sequence: Synthetic oligonucleotide
cugggacugccguaggga

SEQ ID NO: 131525 - RNA, 18 nt, Artificial Sequence
  Description of Artificial Sequence: Synthetic oligonucleotide
cuuggcugggacugccgu

SEQ ID NO: 131526 - RNA, 18 nt, Artificial Sequence
  Description of Artificial Sequence: Synthetic oligonucleotide
gggcuuggcugggacugc

SEQ ID NO: 131527 - RNA, 18 nt, Artificial Sequence
  Description of Artificial Sequence: Synthetic oligonucleotide
gucuccgcugggauuggg

SEQ ID NO: 131528 - RNA, 18 nt, Artificial Sequence
  Description of Artificial Sequence: Synthetic oligonucleotide
gcacagucuccgcuggga

SEQ ID NO: 131529 - RNA, 18 nt, Artificial Sequence
  Description of Artificial Sequence: Synthetic oligonucleotide
gcagggcacagucuccgc

SEQ ID NO: 131530 - RNA, 18 nt, Artificial Sequence
  Description of Artificial Sequence: Synthetic oligonucleotide
ucugagcagggcacaguc

SEQ ID NO: 131531 - RNA, 18 nt, Artificial Sequence
  Description of Artificial Sequence: Synthetic oligonucleotide
ggagcucugagcagggca

SEQ ID NO: 131532 - RNA, 18 nt, Artificial Sequence
  Description of Artificial Sequence: Synthetic oligonucleotide
gcuugggagcucugagca

SEQ ID NO: 131533 - RNA, 18 nt, Artificial Sequence
  Description of Artificial Sequence: Synthetic oligonucleotide
ggaaggcuugggagcucu

SEQ ID NO: 131534 - RNA, 18 nt, Artificial Sequence
  Description of Artificial Sequence: Synthetic oligonucleotide
gggaaggcuugggagcuc

SEQ ID NO: 131535 - RNA, 18 nt, Artificial Sequence
  Description of Artificial Sequence: Synthetic oligonucleotide
cuugagugaggugguggg

SEQ ID NO: 131536 - RNA, 18 nt, Artificial Sequence
  Description of Artificial Sequence: Synthetic oligonucleotide
gggcacuugagugaggug

SEQ ID NO: 131537 - RNA, 18 nt, Artificial Sequence
  Description of Artificial Sequence: Synthetic oligonucleotide
ccgucuggcagggauuuc

SEQ ID NO: 131538 - RNA, 18 nt, Artificial Sequence
  Description of Artificial Sequence: Synthetic oligonucleotide
cugagccgucuggcaggg

SEQ ID NO: 131539 - RNA, 18 nt, Artificial Sequence
  Description of Artificial Sequence: Synthetic oligonucleotide
ccaggcugagccgucugg

SEQ ID NO: 131540 - RNA, 18 nt, Artificial Sequence
  Description of Artificial Sequence: Synthetic oligonucleotide
gcagaccaggcugagccg

SEQ ID NO: 131541 - RNA, 18 nt, Artificial Sequence
  Description of Artificial Sequence: Synthetic oligonucleotide
uuaccgcagaccaggcug

SEQ ID NO: 131542 - RNA, 18 nt, Artificial Sequence
  Description of Artificial Sequence: Synthetic oligonucleotide
cugccuuaccgcagacca

SEQ ID NO: 131543 - RNA, 18 nt, Artificial Sequence
  Description of Artificial Sequence: Synthetic oligonucleotide
ccucccugccuuaccgca

SEQ ID NO: 131544 - RNA, 18 nt, Artificial Sequence
  Description of Artificial Sequence: Synthetic oligonucleotide
uccagccucccugccuua

SEQ ID NO: 131545 - RNA, 18 nt, Artificial Sequence
  Description of Artificial Sequence: Synthetic oligonucleotide
augguuccagccucccug

SEQ ID NO: 131546 - RNA, 18 nt, Artificial Sequence
  Description of Artificial Sequence: Synthetic oligonucleotide
cagaaaugguuccagccu

SEQ ID NO: 131547 - RNA, 18 nt, Artificial Sequence
  Description of Artificial Sequence: Synthetic oligonucleotide
augcccagaaaugguucc

SEQ ID NO: 131548 - RNA, 18 nt, Artificial Sequence
  Description of Artificial Sequence: Synthetic oligonucleotide
ccacaaugcccagaaaug

SEQ ID NO: 131549 - RNA, 18 nt, Artificial Sequence
  Description of Artificial Sequence: Synthetic oligonucleotide
aaugaccacaaugcccag

SEQ ID NO: 131550 - RNA, 18 nt, Artificial Sequence
  Description of Artificial Sequence: Synthetic oligonucleotide
gugggaaugaccacaaug

SEQ ID NO: 131551 - RNA, 18 nt, Artificial Sequence
  Description of Artificial Sequence: Synthetic oligonucleotide
acacagugggaaugacca

SEQ ID NO: 131552 - RNA, 18 nt, Artificial Sequence
  Description of Artificial Sequence: Synthetic oligonucleotide
gaggaacacagugggaau

SEQ ID NO: 131553 - RNA, 18 nt, Artificial Sequence
  Description of Artificial Sequence: Synthetic oligonucleotide
agguggaggaacacagug

SEQ ID NO: 131554 - RNA, 18 nt, Artificial Sequence
  Description of Artificial Sequence: Synthetic oligonucleotide
ggaggagguggaggaaca

SEQ ID NO: 131555 - RNA, 18 nt, Artificial Sequence
  Description of Artificial Sequence: Synthetic oligonucleotide
uggagggaggagguggag

SEQ ID NO: 131556 - RNA, 18 nt, Artificial Sequence
  Description of Artificial Sequence: Synthetic oligonucleotide
aacgcuggagggaggagg

SEQ ID NO: 131557 - RNA, 18 nt, Artificial Sequence
  Description of Artificial Sequence: Synthetic oligonucleotide
ugagcaacgcuggaggga

SEQ ID NO: 131558 - RNA, 18 nt, Artificial Sequence
  Description of Artificial Sequence: Synthetic oligonucleotide
aggucugagcaacgcugg

SEQ ID NO: 131559 - RNA, 18 nt, Artificial Sequence
  Description of Artificial Sequence: Synthetic oligonucleotide
gacagaggucugagcaac

SEQ ID NO: 131560 - RNA, 18 nt, Artificial Sequence
  Description of Artificial Sequence: Synthetic oligonucleotide
cccaagacagaggucuga

SEQ ID NO: 131561 - RNA, 18 nt, Artificial Sequence
  Description of Artificial Sequence: Synthetic oligonucleotide
uuucucccaagacagagg

SEQ ID NO: 131562 - RNA, 18 nt, Artificial Sequence
  Description of Artificial Sequence: Synthetic oligonucleotide
caaccuuucucccaagac

SEQ ID NO: 131563 - RNA, 18 nt, Artificial Sequence
  Description of Artificial Sequence: Synthetic oligonucleotide
uaucucaaccuuucuccc

SEQ ID NO: 131564 - RNA, 18 nt, Artificial Sequence
  Description of Artificial Sequence: Synthetic oligonucleotide
auucuuaucucaaccuuu

SEQ ID NO: 131565 - RNA, 18 nt, Artificial Sequence
  Description of Artificial Sequence: Synthetic oligonucleotide
gggacauucuuaucucaa

SEQ ID NO: 131566 - RNA, 18 nt, Artificial Sequence
  Description of Artificial Sequence: Synthetic oligonucleotide
uccaugggacauucuuau

SEQ ID NO: 131567 - RNA, 18 nt, Artificial Sequence
  Description of Artificial Sequence: Synthetic oligonucleotide
ggcacuccaugggacauu

SEQ ID NO: 131568 - RNA, 18 nt, Artificial Sequence
  Description of Artificial Sequence: Synthetic oligonucleotide
cccacggcacuccauggg

SEQ ID NO: 131569 - RNA, 18 nt, Artificial Sequence
  Description of Artificial Sequence: Synthetic oligonucleotide
uguugcccacggcacucc

SEQ ID NO: 131570 - RNA, 18 nt, Artificial Sequence
  Description of Artificial Sequence: Synthetic oligonucleotide
gccacuguugcccacggc

SEQ ID NO: 131571 - RNA, 18 nt, Artificial Sequence
  Description of Artificial Sequence: Synthetic oligonucleotide
gaagggccacuguugccc

SEQ ID NO: 131572 - RNA, 18 nt, Artificial Sequence
  Description of Artificial Sequence: Synthetic oligonucleotide
cccaugaagggccacugu

SEQ ID NO: 131573 - RNA, 18 nt, Artificial Sequence
  Description of Artificial Sequence: Synthetic oligonucleotide
uuguucccaugaagggcc

SEQ ID NO: 131574 - RNA, 18 nt, Artificial Sequence
  Description of Artificial Sequence: Synthetic oligonucleotide
acagauuguucccaugaa

SEQ ID NO: 131575 - RNA, 18 nt, Artificial Sequence
  Description of Artificial Sequence: Synthetic oligonucleotide
cuccaacagauuguuccc

SEQ ID NO: 131576 - RNA, 18 nt, Artificial Sequence
  Description of Artificial Sequence: Synthetic oligonucleotide
cccugcuccaacagauug

SEQ ID NO: 131577 - RNA, 18 nt, Artificial Sequence
  Description of Artificial Sequence: Synthetic oligonucleotide
ugacccccugcuccaaca

SEQ ID NO: 131578 - RNA, 18 nt, Artificial Sequence
  Description of Artificial Sequence: Synthetic oligonucleotide
agaacugacccccugcuc

SEQ ID NO: 131579 - RNA, 18 nt, Artificial Sequence
  Description of Artificial Sequence: Synthetic oligonucleotide
agcagagaacugaccccc

SEQ ID NO: 131580 - RNA, 18 nt, Artificial Sequence
  Description of Artificial Sequence: Synthetic oligonucleotide
uucccagcagagaacuga

SEQ ID NO: 131581 - RNA, 18 nt, Artificial Sequence
  Description of Artificial Sequence: Synthetic oligonucleotide
guagauucccagcagaga

SEQ ID NO: 131582 - RNA, 18 nt, Artificial Sequence
  Description of Artificial Sequence: Synthetic oligonucleotide
ggguagauucccagcaga

SEQ ID NO: 131583 - RNA, 18 nt, Artificial Sequence
  Description of Artificial Sequence: Synthetic oligonucleotide
uuucuccuccagaaaggg

SEQ ID NO: 131584 - RNA, 18 nt, Artificial Sequence
  Description of Artificial Sequence: Synthetic oligonucleotide
auggguuucuccuccaga

SEQ ID NO: 131585 - RNA, 18 nt, Artificial Sequence
  Description of Artificial Sequence: Synthetic oligonucleotide
guggaauggguuucuccu

SEQ ID NO: 131586 - RNA, 18 nt, Artificial Sequence
  Description of Artificial Sequence: Synthetic oligonucleotide
uuaagguggaauggguuu

SEQ ID NO: 131587 - RNA, 18 nt, Artificial Sequence
  Description of Artificial Sequence: Synthetic oligonucleotide
aguuauuaagguggaaug

SEQ ID NO: 131588 - RNA, 18 nt, Artificial Sequence
  Description of Artificial Sequence: Synthetic oligonucleotide
aauaaaguuauuaaggug

SEQ ID NO: 131589 - RNA, 18 nt, Artificial Sequence
  Description of Artificial Sequence: Synthetic oligonucleotide
auuacaauaaaguuauua

SEQ ID NO: 131590 - RNA, 18 nt, Artificial Sequence
  Description of Artificial Sequence: Synthetic oligonucleotide
cucacauuacaauaaagu

SEQ ID NO: 131591 - RNA, 18 nt, Artificial Sequence
  Description of Artificial Sequence: Synthetic oligonucleotide
uguuucucacauuacaau

SEQ ID NO: 131592 - RNA, 18 nt, Artificial Sequence
  Description of Artificial Sequence: Synthetic oligonucleotide
uuuuguguuucucacauu

SEQ ID NO: 131593 - RNA, 18 nt, Artificial Sequence
  Description of Artificial Sequence: Synthetic oligonucleotide
cuuuguuuuguguuucuc

SEQ ID NO: 131594 - RNA, 18 nt, Artificial Sequence
  Description of Artificial Sequence: Synthetic oligonucleotide
guaaacuuuguuuugugu

SEQ ID NO: 131595 - RNA, 18 nt, Artificial Sequence
  Description of Artificial Sequence: Synthetic oligonucleotide
aaaaaguaaacuuuguuu

SEQ ID NO: 131596 - RNA, 18 nt, Artificial Sequence
  Description of Artificial Sequence: Synthetic oligonucleotide
agucaaaaaaguaaacuu

SEQ ID NO: 131597 - RNA, 18 nt, Artificial Sequence
  Description of Artificial Sequence: Synthetic oligonucleotide
cuuagagucaaaaaagua

SEQ ID NO: 131598 - RNA, 18 nt, Artificial Sequence
  Description of Artificial Sequence: Synthetic oligonucleotide
gucagcuuagagucaaaa

SEQ ID NO: 131599 - RNA, 18 nt, Artificial Sequence
  Description of Artificial Sequence: Synthetic oligonucleotide
aucaugucagcuuagagu

SEQ ID NO: 131600 - RNA, 18 nt, Artificial Sequence
  Description of Artificial Sequence: Synthetic oligonucleotide
cuaauaucaugucagcuu

SEQ ID NO: 131601 - RNA, 18 nt, Artificial Sequence
  Description of Artificial Sequence: Synthetic oligonucleotide
auuuucuaauaucauguc

SEQ ID NO: 131602 - RNA, 18 nt, Artificial Sequence
  Description of Artificial Sequence: Synthetic oligonucleotide
gagagauuuucuaauauc

SEQ ID NO: 131603 - RNA, 18 nt, Artificial Sequence
  Description of Artificial Sequence: Synthetic oligonucleotide
agagcgagagauuuucua

SEQ ID NO: 131604 - RNA, 18 nt, Artificial Sequence
  Description of Artificial Sequence: Synthetic oligonucleotide
aaaagagagcgagagauu

SEQ ID NO: 131605 - RNA, 18 nt, Artificial Sequence
  Description of Artificial Sequence: Synthetic oligonucleotide
aaaaaaaaagagagcgag

SEQ ID NO: 131606 - RNA, 18 nt, Artificial Sequence
  Description of Artificial Sequence: Synthetic oligonucleotide
aaaaaaaaaaaaaagaga

SEQ ID NO: 131607 - RNA, 18 nt, Artificial Sequence
  Description of Artificial Sequence: Synthetic oligonucleotide
aaaaaaaaaaaaaaaaaa

SEQ ID NO: 131608 - RNA, 18 nt, Artificial Sequence
  Description of Artificial Sequence: Synthetic oligonucleotide
aaaaaaaaaaaaaaaaaa

SEQ ID NO: 131609 - RNA, 18 nt, Artificial Sequence
  Description of Artificial Sequence: Synthetic oligonucleotide
uagccaaaaaaaaaaaaa

SEQ ID NO: 131610 - RNA, 18 nt, Artificial Sequence
  Description of Artificial Sequence: Synthetic oligonucleotide
ucaaguagccaaaaaaaa

SEQ ID NO: 131611 - RNA, 18 nt, Artificial Sequence
  Description of Artificial Sequence: Synthetic oligonucleotide
acaacucaaguagccaaa

SEQ ID NO: 131612 - RNA, 18 nt, Artificial Sequence
  Description of Artificial Sequence: Synthetic oligonucleotide
ggaccacaacucaaguag

SEQ ID NO: 131613 - RNA, 18 nt, Artificial Sequence
  Description of Artificial Sequence: Synthetic oligonucleotide
uuuuaggaccacaacuca

SEQ ID NO: 131614 - RNA, 18 nt, Artificial Sequence
  Description of Artificial Sequence: Synthetic oligonucleotide
uuauguuuuaggaccaca

SEQ ID NO: 131615 - RNA, 18 nt, Artificial Sequence
  Description of Artificial Sequence: Synthetic oligonucleotide
agauuuuauguuuuagga

SEQ ID NO: 131616 - RNA, 18 nt, Artificial Sequence
  Description of Artificial Sequence: Synthetic oligonucleotide
ccaucagauuuuauguuu

SEQ ID NO: 131617 - RNA, 18 nt, Artificial Sequence
  Description of Artificial Sequence: Synthetic oligonucleotide
uuuguccaucagauuuua

SEQ ID NO: 131618 - RNA, 18 nt, Artificial Sequence
  Description of Artificial Sequence: Synthetic oligonucleotide
cucuguuuguccaucaga

SEQ ID NO: 131619 - RNA, 18 nt, Artificial Sequence
  Description of Artificial Sequence: Synthetic oligonucleotide
caacccucuguuugucca

SEQ ID NO: 131620 - RNA, 18 nt, Artificial Sequence
  Description of Artificial Sequence: Synthetic oligonucleotide
cccagcaacccucuguuu

SEQ ID NO: 131621 - RNA, 18 nt, Artificial Sequence
  Description of Artificial Sequence: Synthetic oligonucleotide
guccccccagcaacccuc

SEQ ID NO: 131622 - RNA, 18 nt, Artificial Sequence
  Description of Artificial Sequence: Synthetic oligonucleotide
cgcuuguccccccagcaa

SEQ ID NO: 131623 - RNA, 18 nt, Artificial Sequence
  Description of Artificial Sequence: Synthetic oligonucleotide
gcccacgcuugucccccc

SEQ ID NO: 131624 - RNA, 18 nt, Artificial Sequence
  Description of Artificial Sequence: Synthetic oligonucleotide
auugugcccacgcuuguc

SEQ ID NO: 131625 - RNA, 18 nt, Artificial Sequence
  Description of Artificial Sequence: Synthetic oligonucleotide
gggaaauugugcccacgc

SEQ ID NO: 131626 - RNA, 18 nt, Artificial Sequence
  Description of Artificial Sequence: Synthetic oligonucleotide
aagaucagggugucuugg

SEQ ID NO: 131627 - RNA, 18 nt, Artificial Sequence
  Description of Artificial Sequence: Synthetic oligonucleotide
gccugaagaucagggugu

SEQ ID NO: 131628 - RNA, 18 nt, Artificial Sequence
  Description of Artificial Sequence: Synthetic oligonucleotide
gacccgccugaagaucag

SEQ ID NO: 131629 - RNA, 18 nt, Artificial Sequence
  Description of Artificial Sequence: Synthetic oligonucleotide
ccugagacccgccugaag

SEQ ID NO: 131630 - RNA, 18 nt, Artificial Sequence
  Description of Artificial Sequence: Synthetic oligonucleotide
aagcuccugagacccgcc

SEQ ID NO: 131631 - RNA, 18 nt, Artificial Sequence
  Description of Artificial Sequence: Synthetic oligonucleotide
uuuagaagcuccugagac

SEQ ID NO: 131632 - RNA, 18 nt, Artificial Sequence
  Description of Artificial Sequence: Synthetic oligonucleotide
ggauuuuuagaagcuccu

SEQ ID NO: 131633 - RNA, 18 nt, Artificial Sequence
  Description of Artificial Sequence: Synthetic oligonucleotide
caugcggauuuuuagaag

SEQ ID NO: 131634 - RNA, 18 nt, Artificial Sequence
  Description of Artificial Sequence: Synthetic oligonucleotide
agagccaugcggauuuuu

SEQ ID NO: 131635 - RNA, 18 nt, Artificial Sequence
  Description of Artificial Sequence: Synthetic oligonucleotide
ucaggagagccaugcgga

SEQ ID NO: 131636 - RNA, 18 nt, Artificial Sequence
  Description of Artificial Sequence: Synthetic oligonucleotide
cacucucaggagagccau

SEQ ID NO: 131637 - RNA, 18 nt, Artificial Sequence
  Description of Artificial Sequence: Synthetic oligonucleotide
cuguccacucucaggaga

SEQ ID NO: 131638 - RNA, 18 nt, Artificial Sequence
  Description of Artificial Sequence: Synthetic oligonucleotide
cuccucuguccacucuca

SEQ ID NO: 131639 - RNA, 18 nt, Artificial Sequence
  Description of Artificial Sequence: Synthetic oligonucleotide
cuccucuccucuguccac

SEQ ID NO: 131640 - RNA, 18 nt, Artificial Sequence
  Description of Artificial Sequence: Synthetic oligonucleotide
acccucuccucuccucug

SEQ ID NO: 131641 - RNA, 18 nt, Artificial Sequence
  Description of Artificial Sequence: Synthetic oligonucleotide
uucugacccucuccucuc

SEQ ID NO: 131642 - RNA, 18 nt, Artificial Sequence
  Description of Artificial Sequence: Synthetic oligonucleotide
uucauuucugacccucuc

SEQ ID NO: 131643 - RNA, 18 nt, Artificial Sequence
  Description of Artificial Sequence: Synthetic oligonucleotide
gagcguucauuucugacc

SEQ ID NO: 131644 - RNA, 18 nt, Artificial Sequence
  Description of Artificial Sequence: Synthetic oligonucleotide
uagaagagcguucauuuc

SEQ ID NO: 131645 - RNA, 18 nt, Artificial Sequence
  Description of Artificial Sequence: Synthetic oligonucleotide
agaaauagaagagcguuc

SEQ ID NO: 131646 - RNA, 18 nt, Artificial Sequence
  Description of Artificial Sequence: Synthetic oligonucleotide
ugacaagaaauagaagag

SEQ ID NO: 131647 - RNA, 18 nt, Artificial Sequence
  Description of Artificial Sequence: Synthetic oligonucleotide
gguaaugacaagaaauag

SEQ ID NO: 131648 - RNA, 18 nt, Artificial Sequence
  Description of Artificial Sequence: Synthetic oligonucleotide
ggcuugguaaugacaaga

SEQ ID NO: 131649 - RNA, 18 nt, Artificial Sequence
  Description of Artificial Sequence: Synthetic oligonucleotide
uaauuggcuugguaauga

SEQ ID NO: 131650 - RNA, 18 nt, Artificial Sequence
  Description of Artificial Sequence: Synthetic oligonucleotide
aaaaguaauuggcuuggu

SEQ ID NO: 131651 - RNA, 18 nt, Artificial Sequence
  Description of Artificial Sequence: Synthetic oligonucleotide
uuggcaaaaguaauuggc

SEQ ID NO: 131652 - RNA, 18 nt, Artificial Sequence
  Description of Artificial Sequence: Synthetic oligonucleotide
aaaauuuggcaaaaguaa

SEQ ID NO: 131653 - RNA, 18 nt, Artificial Sequence
  Description of Artificial Sequence: Synthetic oligonucleotide
acagaaaaauuuggcaaa

SEQ ID NO: 131654 - RNA, 18 nt, Artificial Sequence
  Description of Artificial Sequence: Synthetic oligonucleotide
agaucacagaaaaauuug

SEQ ID NO: 131655 - RNA, 18 nt, Artificial Sequence
  Description of Artificial Sequence: Synthetic oligonucleotide
agggcagaucacagaaaa

SEQ ID NO: 131656 - RNA, 18 nt, Artificial Sequence
  Description of Artificial Sequence: Synthetic oligonucleotide
uaaucagggcagaucaca

SEQ ID NO: 131657 - RNA, 18 nt, Artificial Sequence
  Description of Artificial Sequence: Synthetic oligonucleotide
caucuuaaucagggcaga

SEQ ID NO: 131658 - RNA, 18 nt, Artificial Sequence
  Description of Artificial Sequence: Synthetic oligonucleotide
caauucaucuuaaucagg

SEQ ID NO: 131659 - RNA, 18 nt, Artificial Sequence
  Description of Artificial Sequence: Synthetic oligonucleotide
uuucacaauucaucuuaa

SEQ ID NO: 131660 - RNA, 18 nt, Artificial Sequence
  Description of Artificial Sequence: Synthetic oligonucleotide
guaaauuucacaauucau

SEQ ID NO: 131661 - RNA, 18 nt, Artificial Sequence
  Description of Artificial Sequence: Synthetic oligonucleotide
uugauguaaauuucacaa

SEQ ID NO: 131662 - RNA, 18 nt, Artificial Sequence
  Description of Artificial Sequence: Synthetic oligonucleotide
auugcuugauguaaauuu

SEQ ID NO: 131663 - RNA, 18 nt, Artificial Sequence
  Description of Artificial Sequence: Synthetic oligonucleotide
ugauaauugcuugaugua

SEQ ID NO: 131664 - RNA, 18 nt, Artificial Sequence
  Description of Artificial Sequence: Synthetic oligonucleotide
cgcuuugauaauugcuug

SEQ ID NO: 131665 - RNA, 18 nt, Artificial Sequence
  Description of Artificial Sequence: Synthetic oligonucleotide
cagcccgcuuugauaauu

SEQ ID NO: 131666 - RNA, 18 nt, Artificial Sequence
  Description of Artificial Sequence: Synthetic oligonucleotide
ggacccagcccgcuuuga

SEQ ID NO: 131667 - RNA, 18 nt, Artificial Sequence
  Description of Artificial Sequence: Synthetic oligonucleotide
ugaugggacccagcccgc

SEQ ID NO: 131668 - RNA, 18 nt, Artificial Sequence
  Description of Artificial Sequence: Synthetic oligonucleotide
cguucugaugggacccag

SEQ ID NO: 131669 - RNA, 18 nt, Artificial Sequence
  Description of Artificial Sequence: Synthetic oligonucleotide
ugggucguucugauggga

SEQ ID NO: 131670 - RNA, 18 nt, Artificial Sequence
  Description of Artificial Sequence: Synthetic oligonucleotide
agaugugggucguucuga

SEQ ID NO: 131671 - RNA, 18 nt, Artificial Sequence
  Description of Artificial Sequence: Synthetic oligonucleotide
cagaaagaugugggucgu

SEQ ID NO: 131672 - RNA, 18 nt, Artificial Sequence
  Description of Artificial Sequence: Synthetic oligonucleotide
acccacagaaagaugugg

SEQ ID NO: 131673 - RNA, 18 nt, Artificial Sequence
  Description of Artificial Sequence: Synthetic oligonucleotide
uucacacccacagaaaga

SEQ ID NO: 131674 - RNA, 18 nt, Artificial Sequence
  Description of Artificial Sequence: Synthetic oligonucleotide
ugacauucacacccacag

SEQ ID NO: 131675 - RNA, 18 nt, Artificial Sequence
  Description of Artificial Sequence: Synthetic oligonucleotide
ccuaaugacauucacacc

SEQ ID NO: 131676 - RNA, 18 nt, Artificial Sequence
  Description of Artificial Sequence: Synthetic oligonucleotide
caagaccuaaugacauuc

SEQ ID NO: 131677 - RNA, 18 nt, Artificial Sequence
  Description of Artificial Sequence: Synthetic oligonucleotide
cagcgcaagaccuaauga

SEQ ID NO: 131678 - RNA, 18 nt, Artificial Sequence
  Description of Artificial Sequence: Synthetic oligonucleotide
gggucagcgcaagaccua

SEQ ID NO: 131679 - RNA, 18 nt, Artificial Sequence
  Description of Artificial Sequence: Synthetic oligonucleotide
ucaggcggcagugauggg

SEQ ID NO: 131680 - RNA, 18 nt, Artificial Sequence
  Description of Artificial Sequence: Synthetic oligonucleotide
ccccaucaggcggcagug

SEQ ID NO: 131681 - RNA, 18 nt, Artificial Sequence
  Description of Artificial Sequence: Synthetic oligonucleotide
cuuugccccaucaggcgg

SEQ ID NO: 131682 - RNA, 18 nt, Artificial Sequence
  Description of Artificial Sequence: Synthetic oligonucleotide
uguuucuuugccccauca

SEQ ID NO: 131683 - RNA, 18 nt, Artificial Sequence
  Description of Artificial Sequence: Synthetic oligonucleotide
uuuuuuguuucuuugccc

SEQ ID NO: 131684 - RNA, 18 nt, Artificial Sequence
  Description of Artificial Sequence: Synthetic oligonucleotide
aaauguuuuuuguuucuu

SEQ ID NO: 131685 - RNA, 18 nt, Artificial Sequence
  Description of Artificial Sequence: Synthetic oligonucleotide
guaagaaauguuuuuugu

SEQ ID NO: 131686 - RNA, 18 nt, Artificial Sequence
  Description of Artificial Sequence: Synthetic oligonucleotide
gaagaguaagaaauguuu

SEQ ID NO: 131687 - RNA, 18 nt, Artificial Sequence
  Description of Artificial Sequence: Synthetic oligonucleotide
acacagaagaguaagaaa

SEQ ID NO: 131688 - RNA, 18 nt, Artificial Sequence
  Description of Artificial Sequence: Synthetic oligonucleotide
uuaaaacacagaagagua

SEQ ID NO: 131689 - RNA, 18 nt, Artificial Sequence
  Description of Artificial Sequence: Synthetic oligonucleotide
uuuuguuaaaacacagaa

SEQ ID NO: 131690 - RNA, 18 nt, Artificial Sequence
  Description of Artificial Sequence: Synthetic oligonucleotide
uaaacuuuuguuaaaaca

SEQ ID NO: 131691 - RNA, 18 nt, Artificial Sequence
  Description of Artificial Sequence: Synthetic oligonucleotide
uuuuauaaacuuuuguua

SEQ ID NO: 131692 - RNA, 18 nt, Artificial Sequence
  Description of Artificial Sequence: Synthetic oligonucleotide
uuuuguuuuauaaacuuu

SEQ ID NO: 131693 - RNA, 18 nt, Artificial Sequence
  Description of Artificial Sequence: Synthetic oligonucleotide
auuuauuuuguuuuauaa

SEQ ID NO: 131694 - RNA, 18 nt, Artificial Sequence
  Description of Artificial Sequence: Synthetic oligonucleotide
gcgccauuuauuuuguuu

SEQ ID NO: 131695 - RNA, 18 nt, Artificial Sequence
  Description of Artificial Sequence: Synthetic oligonucleotide
cauaugcgccauuuauuu

SEQ ID NO: 131696 - RNA, 18 nt, Artificial Sequence
  Description of Artificial Sequence: Synthetic oligonucleotide
gaaaacauaugcgccauu

SEQ ID NO: 131697 - RNA, 18 nt, Artificial Sequence
  Description of Artificial Sequence: Synthetic oligonucleotide
ucugccuuccuuucaaac

SEQ ID NO: 131698 - RNA, 18 nt, Artificial Sequence
  Description of Artificial Sequence: Synthetic oligonucleotide
cccucucugccuuccuuu

SEQ ID NO: 131699 - RNA, 18 nt, Artificial Sequence
  Description of Artificial Sequence: Synthetic oligonucleotide
cagugcccucucugccuu

SEQ ID NO: 131700 - RNA, 18 nt, Artificial Sequence
  Description of Artificial Sequence: Synthetic oligonucleotide
ccucccagugcccucucu

SEQ ID NO: 131701 - RNA, 18 nt, Artificial Sequence
  Description of Artificial Sequence: Synthetic oligonucleotide
ugccuccucccagugccc

SEQ ID NO: 131702 - RNA, 18 nt, Artificial Sequence
  Description of Artificial Sequence: Synthetic oligonucleotide
cccacugccuccucccag

SEQ ID NO: 131703 - RNA, 18 nt, Artificial Sequence
  Description of Artificial Sequence: Synthetic oligonucleotide
gcccucccacugccuccu

SEQ ID NO: 131704 - RNA, 18 nt, Artificial Sequence
  Description of Artificial Sequence: Synthetic oligonucleotide
ccuccgcccucccacugc

SEQ ID NO: 131705 - RNA, 18 nt, Artificial Sequence
  Description of Artificial Sequence: Synthetic oligonucleotide
cccgcccuccgcccuccc

SEQ ID NO: 131706 - RNA, 18 nt, Artificial Sequence
  Description of Artificial Sequence: Synthetic oligonucleotide
aggcccccgcccuccgcc

SEQ ID NO: 131707 - RNA, 18 nt, Artificial Sequence
  Description of Artificial Sequence: Synthetic oligonucleotide
cccgaaggcccccgcccu

SEQ ID NO: 131708 - RNA, 18 nt, Artificial Sequence
  Description of Artificial Sequence: Synthetic oligonucleotide
cccaccccgaaggccccc

SEQ ID NO: 131709 - RNA, 18 nt, Artificial Sequence
  Description of Artificial Sequence: Synthetic oligonucleotide
gggcgcccaccccgaagg

SEQ ID NO: 131710 - RNA, 18 nt, Artificial Sequence
  Description of Artificial Sequence: Synthetic oligonucleotide
acccugggcgcccacccc

SEQ ID NO: 131711 - RNA, 18 nt, Artificial Sequence
  Description of Artificial Sequence: Synthetic oligonucleotide
gcccuacccugggcgccc

SEQ ID NO: 131712 - RNA, 18 nt, Artificial Sequence
  Description of Artificial Sequence: Synthetic oligonucleotide
caccugcccuacccuggg

SEQ ID NO: 131713 - RNA, 18 nt, Artificial Sequence
  Description of Artificial Sequence: Synthetic oligonucleotide
gcggccaccugcccuacc

SEQ ID NO: 131714 - RNA, 18 nt, Artificial Sequence
  Description of Artificial Sequence: Synthetic oligonucleotide
acgccgcggccaccugcc

SEQ ID NO: 131715 - RNA, 18 nt, Artificial Sequence
  Description of Artificial Sequence: Synthetic oligonucleotide
ccuccacgccgcggccac

SEQ ID NO: 131716 - RNA, 18 nt, Artificial Sequence
  Description of Artificial Sequence: Synthetic oligonucleotide
cccugccuccacgccgcg

SEQ ID NO: 131717 - RNA, 18 nt, Artificial Sequence
  Description of Artificial Sequence: Synthetic oligonucleotide
auucucccugccuccacg

SEQ ID NO: 131718 - RNA, 18 nt, Artificial Sequence
  Description of Artificial Sequence: Synthetic oligonucleotide
gucgcauucucccugccu

SEQ ID NO: 131719 - RNA, 18 nt, Artificial Sequence
  Description of Artificial Sequence: Synthetic oligonucleotide
ggagagucgcauucuccc

SEQ ID NO: 131720 - RNA, 18 nt, Artificial Sequence
  Description of Artificial Sequence: Synthetic oligonucleotide
guuuuggagagucgcauu

SEQ ID NO: 131721 - RNA, 18 nt, Artificial Sequence
  Description of Artificial Sequence: Synthetic oligonucleotide
cgaggguuuuggagaguc

SEQ ID NO: 131722 - RNA, 18 nt, Artificial Sequence
  Description of Artificial Sequence: Synthetic oligonucleotide
gucgacgaggguuuugga

SEQ ID NO: 131723 - RNA, 18 nt, Artificial Sequence
  Description of Artificial Sequence: Synthetic oligonucleotide
uccaugucgacgaggguu

SEQ ID NO: 131724 - RNA, 18 nt, Artificial Sequence
  Description of Artificial Sequence: Synthetic oligonucleotide
ccauguccaugucgacga

SEQ ID NO: 131725 - RNA, 18 nt, Artificial Sequence
  Description of Artificial Sequence: Synthetic oligonucleotide
gucggccauguccauguc

SEQ ID NO: 131726 - RNA, 18 nt, Artificial Sequence
  Description of Artificial Sequence: Synthetic oligonucleotide
cuguagucggccaugucc

SEQ ID NO: 131727 - RNA, 18 nt, Artificial Sequence
  Description of Artificial Sequence: Synthetic oligonucleotide
cagcacuguagucggcca

SEQ ID NO: 131728 - RNA, 18 nt, Artificial Sequence
  Description of Artificial Sequence: Synthetic oligonucleotide
cagugcagcacuguaguc

SEQ ID NO: 131729 - RNA, 18 nt, Artificial Sequence
  Description of Artificial Sequence: Synthetic oligonucleotide
ggguccagugcagcacug

SEQ ID NO: 131730 - RNA, 18 nt, Artificial Sequence
  Description of Artificial Sequence: Synthetic oligonucleotide
aggcuggguccagugcag

SEQ ID NO: 131731 - RNA, 18 nt, Artificial Sequence
  Description of Artificial Sequence: Synthetic oligonucleotide
gguguaggcuggguccag

SEQ ID NO: 131732 - RNA, 18 nt, Artificial Sequence
  Description of Artificial Sequence: Synthetic oligonucleotide
agggugguguaggcuggg

SEQ ID NO: 131733 - RNA, 18 nt, Artificial Sequence
  Description of Artificial Sequence: Synthetic oligonucleotide
auuccagggugguguagg

SEQ ID NO: 131734 - RNA, 18 nt, Artificial Sequence
  Description of Artificial Sequence: Synthetic oligonucleotide
cucaaauuccaggguggu

SEQ ID NO: 131735 - RNA, 18 nt, Artificial Sequence
  Description of Artificial Sequence: Synthetic oligonucleotide
acauucucaaauuccagg

SEQ ID NO: 131736 - RNA, 18 nt, Artificial Sequence
  Description of Artificial Sequence: Synthetic oligonucleotide
ccugcacauucucaaauu

SEQ ID NO: 131737 - RNA, 18 nt, Artificial Sequence
  Description of Artificial Sequence: Synthetic oligonucleotide
caacaccugcacauucuc

SEQ ID NO: 131738 - RNA, 18 nt, Artificial Sequence
  Description of Artificial Sequence: Synthetic oligonucleotide
aucgucaacaccugcaca

SEQ ID NO: 131739 - RNA, 18 nt, Artificial Sequence
  Description of Artificial Sequence: Synthetic oligonucleotide
ugcccaucgucaacaccu

SEQ ID NO: 131740 - RNA, 18 nt, Artificial Sequence
  Description of Artificial Sequence: Synthetic oligonucleotide
ugggcacaucugccccca

SEQ ID NO: 131741 - RNA, 18 nt, Artificial Sequence
  Description of Artificial Sequence: Synthetic oligonucleotide
acaccugggcacaucugc

SEQ ID NO: 131742 - RNA, 18 nt, Artificial Sequence
  Description of Artificial Sequence: Synthetic oligonucleotide
cuggcacaccugggcaca

SEQ ID NO: 131743 - RNA, 18 nt, Artificial Sequence
  Description of Artificial Sequence: Synthetic oligonucleotide
ccccacuggcacaccugg

SEQ ID NO: 131744 - RNA, 18 nt, Artificial Sequence
  Description of Artificial Sequence: Synthetic oligonucleotide
ccugcccccacuggcaca

SEQ ID NO: 131745 - RNA, 18 nt, Artificial Sequence
  Description of Artificial Sequence: Synthetic oligonucleotide
gcacaccugcccccacug

SEQ ID NO: 131746 - RNA, 18 nt, Artificial Sequence
  Description of Artificial Sequence: Synthetic oligonucleotide
cccaggcacaccugcccc

SEQ ID NO: 131747 - RNA, 18 nt, Artificial Sequence
  Description of Artificial Sequence: Synthetic oligonucleotide
cuggacccaggcacaccu

SEQ ID NO: 131748 - RNA, 18 nt, Artificial Sequence
  Description of Artificial Sequence: Synthetic oligonucleotide
ugcuccuggacccaggca

SEQ ID NO: 131749 - RNA, 18 nt, Artificial Sequence
  Description of Artificial Sequence: Synthetic oligonucleotide
agaucugcuccuggaccc

SEQ ID NO: 131750 - RNA, 18 nt, Artificial Sequence
  Description of Artificial Sequence: Synthetic oligonucleotide
gccaaagaucugcuccug

SEQ ID NO: 131751 - RNA, 18 nt, Artificial Sequence
  Description of Artificial Sequence: Synthetic oligonucleotide
ugagugccaaagaucugc

SEQ ID NO: 131752 - RNA, 18 nt, Artificial Sequence
  Description of Artificial Sequence: Synthetic oligonucleotide
aaaguugagugccaaaga

SEQ ID NO: 131753 - RNA, 18 nt, Artificial Sequence
  Description of Artificial Sequence: Synthetic oligonucleotide
accccaaaguugagugcc

SEQ ID NO: 131754 - RNA, 18 nt, Artificial Sequence
  Description of Artificial Sequence: Synthetic oligonucleotide
cucccaccccaaaguuga

SEQ ID NO: 131755 - RNA, 18 nt, Artificial Sequence
  Description of Artificial Sequence: Synthetic oligonucleotide
uucuccucccaccccaaa

SEQ ID NO: 131756 - RNA, 18 nt, Artificial Sequence
  Description of Artificial Sequence: Synthetic oligonucleotide
uaucauucuccucccacc

SEQ ID NO: 131757 - RNA, 18 nt, Artificial Sequence
  Description of Artificial Sequence: Synthetic oligonucleotide
uuuuguaucauucuccuc

SEQ ID NO: 131758 - RNA, 18 nt, Artificial Sequence
  Description of Artificial Sequence: Synthetic oligonucleotide
uaccauuuuguaucauuc

SEQ ID NO: 131759 - RNA, 18 nt, Artificial Sequence
  Description of Artificial Sequence: Synthetic oligonucleotide
caaccuaccauuuuguau

SEQ ID NO: 131760 - RNA, 18 nt, Artificial Sequence
  Description of Artificial Sequence: Synthetic oligonucleotide
aggaccaaccuaccauuu

SEQ ID NO: 131761 - RNA, 18 nt, Artificial Sequence
  Description of Artificial Sequence: Synthetic oligonucleotide
ccuguaggaccaaccuac

SEQ ID NO: 131762 - RNA, 18 nt, Artificial Sequence
  Description of Artificial Sequence: Synthetic oligonucleotide
gcuggccuguaggaccaa

SEQ ID NO: 131763 - RNA, 18 nt, Artificial Sequence
  Description of Artificial Sequence: Synthetic oligonucleotide
ccugugcuggccuguagg

SEQ ID NO: 131764 - RNA, 18 nt, Artificial Sequence
  Description of Artificial Sequence: Synthetic oligonucleotide
caacaccugugcuggccu

SEQ ID NO: 131765 - RNA, 18 nt, Artificial Sequence
  Description of Artificial Sequence: Synthetic oligonucleotide
cuuggcaacaccugugcu

SEQ ID NO: 131766 - RNA, 18 nt, Artificial Sequence
  Description of Artificial Sequence: Synthetic oligonucleotide
cuucacuuggcaacaccu

SEQ ID NO: 131767 - RNA, 18 nt, Artificial Sequence
  Description of Artificial Sequence: Synthetic oligonucleotide
augggcuucacuuggcaa

SEQ ID NO: 131768 - RNA, 18 nt, Artificial Sequence
  Description of Artificial Sequence: Synthetic oligonucleotide
ggcacaugggcuucacuu

SEQ ID NO: 131769 - RNA, 18 nt, Artificial Sequence
  Description of Artificial Sequence: Synthetic oligonucleotide
gccugggcacaugggcuu

SEQ ID NO: 131770 - RNA, 18 nt, Artificial Sequence
  Description of Artificial Sequence: Synthetic oligonucleotide
acugugccugggcacaug

SEQ ID NO: 131771 - RNA, 18 nt, Artificial Sequence
  Description of Artificial Sequence: Synthetic oligonucleotide
ugaucacugugccugggc

SEQ ID NO: 131772 - RNA, 18 nt, Artificial Sequence
  Description of Artificial Sequence: Synthetic oligonucleotide
gccugugaucacugugcc

SEQ ID NO: 131773 - RNA, 18 nt, Artificial Sequence
  Description of Artificial Sequence: Synthetic oligonucleotide
agaaugccugugaucacu

SEQ ID NO: 131774 - RNA, 18 nt, Artificial Sequence
  Description of Artificial Sequence: Synthetic oligonucleotide
cacccagaaugccuguga

SEQ ID NO: 131775 - RNA, 18 nt, Artificial Sequence
  Description of Artificial Sequence: Synthetic oligonucleotide
cccuucacccagaaugcc

SEQ ID NO: 131776 - RNA, 18 nt, Artificial Sequence
  Description of Artificial Sequence: Synthetic oligonucleotide
ggccucccuucacccaga

SEQ ID NO: 131777 - RNA, 18 nt, Artificial Sequence
  Description of Artificial Sequence: Synthetic oligonucleotide
uugcaggccucccuucac

SEQ ID NO: 131778 - RNA, 18 nt, Artificial Sequence
  Description of Artificial Sequence: Synthetic oligonucleotide
ggcccuugcaggccuccc

SEQ ID NO: 131779 - RNA, 18 nt, Artificial Sequence
  Description of Artificial Sequence: Synthetic oligonucleotide
aaauuggcccuugcaggc

SEQ ID NO: 131780 - RNA, 18 nt, Artificial Sequence
  Description of Artificial Sequence: Synthetic oligonucleotide
gcuggaaauuggcccuug

SEQ ID NO: 131781 - RNA, 18 nt, Artificial Sequence
  Description of Artificial Sequence: Synthetic oligonucleotide
cuuuugcuggaaauuggc

SEQ ID NO: 131782 - RNA, 18 nt, Artificial Sequence
  Description of Artificial Sequence: Synthetic oligonucleotide
aucgacuuuugcuggaaa

SEQ ID NO: 131783 - RNA, 18 nt, Artificial Sequence
  Description of Artificial Sequence: Synthetic oligonucleotide
ccgggaucgacuuuugcu

SEQ ID NO: 131784 - RNA, 18 nt, Artificial Sequence
  Description of Artificial Sequence: Synthetic oligonucleotide
aauagccgggaucgacuu

SEQ ID NO: 131785 - RNA, 18 nt, Artificial Sequence
  Description of Artificial Sequence: Synthetic oligonucleotide
ggaggaauagccgggauc

SEQ ID NO: 131786 - RNA, 18 nt, Artificial Sequence
  Description of Artificial Sequence: Synthetic oligonucleotide
gccugggaggaauagccg

SEQ ID NO: 131787 - RNA, 18 nt, Artificial Sequence
  Description of Artificial Sequence: Synthetic oligonucleotide
gaagggccugggaggaau

SEQ ID NO: 131788 - RNA, 18 nt, Artificial Sequence
  Description of Artificial Sequence: Synthetic oligonucleotide
gacuggaagggccuggga

SEQ ID NO: 131789 - RNA, 18 nt, Artificial Sequence
  Description of Artificial Sequence: Synthetic oligonucleotide
gugaggacuggaagggcc

SEQ ID NO: 131790 - RNA, 18 nt, Artificial Sequence
  Description of Artificial Sequence: Synthetic oligonucleotide
aggcagugaggacuggaa

SEQ ID NO: 131791 - RNA, 18 nt, Artificial Sequence
  Description of Artificial Sequence: Synthetic oligonucleotide
cugugaggcagugaggac

SEQ ID NO: 131792 - RNA, 18 nt, Artificial Sequence
  Description of Artificial Sequence: Synthetic oligonucleotide
agccacugugaggcagug

SEQ ID NO: 131793 - RNA, 18 nt, Artificial Sequence
  Description of Artificial Sequence: Synthetic oligonucleotide
agcagagccacugugagg

SEQ ID NO: 131794 - RNA, 18 nt, Artificial Sequence
  Description of Artificial Sequence: Synthetic oligonucleotide
cgccaagcagagccacug

SEQ ID NO: 131795 - RNA, 18 nt, Artificial Sequence
  Description of Artificial Sequence: Synthetic oligonucleotide
ccaagcgccaagcagagc

SEQ ID NO: 131796 - RNA, 18 nt, Artificial Sequence
  Description of Artificial Sequence: Synthetic oligonucleotide
cugugccaagcgccaagc

SEQ ID NO: 131797 - RNA, 18 nt, Artificial Sequence
  Description of Artificial Sequence: Synthetic oligonucleotide
cgucacugugccaagcgc

SEQ ID NO: 131798 - RNA, 18 nt, Artificial Sequence
  Description of Artificial Sequence: Synthetic oligonucleotide
caucacgucacugugcca

SEQ ID NO: 131799 - RNA, 18 nt, Artificial Sequence
  Description of Artificial Sequence: Synthetic oligonucleotide
cucaccaucacgucacug

SEQ ID NO: 131800 - RNA, 18 nt, Artificial Sequence
  Description of Artificial Sequence: Synthetic oligonucleotide
gggagcucaccaucacgu

SEQ ID NO: 131801 - RNA, 18 nt, Artificial Sequence
  Description of Artificial Sequence: Synthetic oligonucleotide
gcuggagcugggcaccaa

SEQ ID NO: 131802 - RNA, 18 nt, Artificial Sequence
  Description of Artificial Sequence: Synthetic oligonucleotide
gaaucgcuggagcugggc

SEQ ID NO: 131803 - RNA, 18 nt, Artificial Sequence
  Description of Artificial Sequence: Synthetic oligonucleotide
gggcugaaucgcuggagc

SEQ ID NO: 131804 - RNA, 18 nt, Artificial Sequence
  Description of Artificial Sequence: Synthetic oligonucleotide
gugcugggcugaaucgcu

SEQ ID NO: 131805 - RNA, 18 nt, Artificial Sequence
  Description of Artificial Sequence: Synthetic oligonucleotide
gggccgugcugggcugaa

SEQ ID NO: 131806 - RNA, 18 nt, Artificial Sequence
  Description of Artificial Sequence: Synthetic oligonucleotide
ucugaaccuaggcccaag

SEQ ID NO: 131807 - RNA, 18 nt, Artificial Sequence
  Description of Artificial Sequence: Synthetic oligonucleotide
gucucucugaaccuaggc

SEQ ID NO: 131808 - RNA, 18 nt, Artificial Sequence
  Description of Artificial Sequence: Synthetic oligonucleotide
uugccgucucucugaacc

SEQ ID NO: 131809 - RNA, 18 nt, Artificial Sequence
  Description of Artificial Sequence: Synthetic oligonucleotide
aucccuugccgucucucu

SEQ ID NO: 131810 - RNA, 18 nt, Artificial Sequence
  Description of Artificial Sequence: Synthetic oligonucleotide
acaacaucccuugccguc

SEQ ID NO: 131811 - RNA, 18 nt, Artificial Sequence
  Description of Artificial Sequence: Synthetic oligonucleotide
gggauacaacaucccuug

SEQ ID NO: 131812 - RNA, 18 nt, Artificial Sequence
  Description of Artificial Sequence: Synthetic oligonucleotide
cuccagggauacaacauc

SEQ ID NO: 131813 - RNA, 18 nt, Artificial Sequence
  Description of Artificial Sequence: Synthetic oligonucleotide
accaucuccagggauaca

SEQ ID NO: 131814 - RNA, 18 nt, Artificial Sequence
  Description of Artificial Sequence: Synthetic oligonucleotide
caaccaccaucuccaggg

SEQ ID NO: 131815 - RNA, 18 nt, Artificial Sequence
  Description of Artificial Sequence: Synthetic oligonucleotide
gucuccaaccaccaucuc

SEQ ID NO: 131816 - RNA, 18 nt, Artificial Sequence
  Description of Artificial Sequence: Synthetic oligonucleotide
guuaugucuccaaccacc

SEQ ID NO: 131817 - RNA, 18 nt, Artificial Sequence
  Description of Artificial Sequence: Synthetic oligonucleotide
augcgguuaugucuccaa

SEQ ID NO: 131818 - RNA, 18 nt, Artificial Sequence
  Description of Artificial Sequence: Synthetic oligonucleotide
gagaaaugcgguuauguc

SEQ ID NO: 131819 - RNA, 18 nt, Artificial Sequence
  Description of Artificial Sequence: Synthetic oligonucleotide
acaccgagaaaugcgguu

SEQ ID NO: 131820 - RNA, 18 nt, Artificial Sequence
  Description of Artificial Sequence: Synthetic oligonucleotide
caaagacaccgagaaaug

SEQ ID NO: 131821 - RNA, 18 nt, Artificial Sequence
  Description of Artificial Sequence: Synthetic oligonucleotide
agucccaaagacaccgag

SEQ ID NO: 131822 - RNA, 18 nt, Artificial Sequence
  Description of Artificial Sequence: Synthetic oligonucleotide
aggaaagucccaaagaca

SEQ ID NO: 131823 - RNA, 18 nt, Artificial Sequence
  Description of Artificial Sequence: Synthetic oligonucleotide
ucccuaggaaagucccaa

SEQ ID NO: 131824 - RNA, 18 nt, Artificial Sequence
  Description of Artificial Sequence: Synthetic oligonucleotide
ucauuucccuaggaaagu

SEQ ID NO: 131825 - RNA, 18 nt, Artificial Sequence
  Description of Artificial Sequence: Synthetic oligonucleotide
caauuucauuucccuagg

SEQ ID NO: 131826 - RNA, 18 nt, Artificial Sequence
  Description of Artificial Sequence: Synthetic oligonucleotide
agugccaauuucauuucc

SEQ ID NO: 131827 - RNA, 18 nt, Artificial Sequence
  Description of Artificial Sequence: Synthetic oligonucleotide
cccuaagugccaauuuca

SEQ ID NO: 131828 - RNA, 18 nt, Artificial Sequence
  Description of Artificial Sequence: Synthetic oligonucleotide
auuuucccuaagugccaa

SEQ ID NO: 131829 - RNA, 18 nt, Artificial Sequence
  Description of Artificial Sequence: Synthetic oligonucleotide
gcuccauuuucccuaagu

SEQ ID NO: 131830 - RNA, 18 nt, Artificial Sequence
  Description of Artificial Sequence: Synthetic oligonucleotide
ugagagcuccauuuuccc

SEQ ID NO: 131831 - RNA, 18 nt, Artificial Sequence
  Description of Artificial Sequence: Synthetic oligonucleotide
cgaacgcacacacaacac

SEQ ID NO: 131832 - RNA, 18 nt, Artificial Sequence
  Description of Artificial Sequence: Synthetic oligonucleotide
acacacgaacgcacacac

SEQ ID NO: 131833 - RNA, 18 nt, Artificial Sequence
  Description of Artificial Sequence: Synthetic oligonucleotide
cuaucacacacgaacgca

SEQ ID NO: 131834 - RNA, 18 nt, Artificial Sequence
  Description of Artificial Sequence: Synthetic oligonucleotide
acucacuaucacacacga

SEQ ID NO: 131835 - RNA, 18 nt, Artificial Sequence
  Description of Artificial Sequence: Synthetic oligonucleotide
uggaaacucacuaucaca

SEQ ID NO: 131836 - RNA, 18 nt, Artificial Sequence
  Description of Artificial Sequence: Synthetic oligonucleotide
cuacauggaaacucacua

SEQ ID NO: 131837 - RNA, 18 nt, Artificial Sequence
  Description of Artificial Sequence: Synthetic oligonucleotide
acaaccuacauggaaacu

SEQ ID NO: 131838 - RNA, 18 nt, Artificial Sequence
  Description of Artificial Sequence: Synthetic oligonucleotide
cccauacaaccuacaugg

SEQ ID NO: 131839 - RNA, 18 nt, Artificial Sequence
  Description of Artificial Sequence: Synthetic oligonucleotide
ccccacccauacaaccua

SEQ ID NO: 131840 - RNA, 18 nt, Artificial Sequence
  Description of Artificial Sequence: Synthetic oligonucleotide
caucaccccacccauaca

SEQ ID NO: 131841 - RNA, 18 nt, Artificial Sequence
  Description of Artificial Sequence: Synthetic oligonucleotide
gaaggcaucaccccaccc

SEQ ID NO: 131842 - RNA, 18 nt, Artificial Sequence
  Description of Artificial Sequence: Synthetic oligonucleotide
uuccugaaggcaucaccc

SEQ ID NO: 131843 - RNA, 18 nt, Artificial Sequence
  Description of Artificial Sequence: Synthetic oligonucleotide
auggguuccugaaggcau

SEQ ID NO: 131844 - RNA, 18 nt, Artificial Sequence
  Description of Artificial Sequence: Synthetic oligonucleotide
ugcaaauggguuccugaa

SEQ ID NO: 131845 - RNA, 18 nt, Artificial Sequence
  Description of Artificial Sequence: Synthetic oligonucleotide
acauaugcaaauggguuc

SEQ ID NO: 131846 - RNA, 18 nt, Artificial Sequence
  Description of Artificial Sequence: Synthetic oligonucleotide
aacacacauaugcaaaug

SEQ ID NO: 131847 - RNA, 18 nt, Artificial Sequence
  Description of Artificial Sequence: Synthetic oligonucleotide
aaaugaacacacauaugc

SEQ ID NO: 131848 - RNA, 18 nt, Artificial Sequence
  Description of Artificial Sequence: Synthetic oligonucleotide
gagacaaaugaacacaca

SEQ ID NO: 131849 - RNA, 18 nt, Artificial Sequence
  Description of Artificial Sequence: Synthetic oligonucleotide
acacagagacaaaugaac

SEQ ID NO: 131850 - RNA, 18 nt, Artificial Sequence
  Description of Artificial Sequence: Synthetic oligonucleotide
cucacacacagagacaaa

SEQ ID NO: 131851 - RNA, 18 nt, Artificial Sequence
  Description of Artificial Sequence: Synthetic oligonucleotide
cagaacucacacacagag

SEQ ID NO: 131852 - RNA, 18 nt, Artificial Sequence
  Description of Artificial Sequence: Synthetic oligonucleotide
agacccagaacucacaca

SEQ ID NO: 131853 - RNA, 18 nt, Artificial Sequence
  Description of Artificial Sequence: Synthetic oligonucleotide
aaaauagacccagaacuc

SEQ ID NO: 131854 - RNA, 18 nt, Artificial Sequence
  Description of Artificial Sequence: Synthetic oligonucleotide
aaaggaaaauagacccag

SEQ ID NO: 131855 - RNA, 18 nt, Artificial Sequence
  Description of Artificial Sequence: Synthetic oligonucleotide
aauacaaaggaaaauaga

SEQ ID NO: 131856 - RNA, 18 nt, Artificial Sequence
  Description of Artificial Sequence: Synthetic oligonucleotide
caaugaauacaaaggaaa

SEQ ID NO: 131857 - RNA, 18 nt, Artificial Sequence
  Description of Artificial Sequence: Synthetic oligonucleotide
ccacucaaugaauacaaa

SEQ ID NO: 131858 - RNA, 18 nt, Artificial Sequence
  Description of Artificial Sequence: Synthetic oligonucleotide
cagacccacucaaugaau

SEQ ID NO: 131859 - RNA, 18 nt, Artificial Sequence
  Description of Artificial Sequence: Synthetic oligonucleotide
aaacacagacccacucaa

SEQ ID NO: 131860 - RNA, 18 nt, Artificial Sequence
  Description of Artificial Sequence: Synthetic oligonucleotide
gacacaaacacagaccca

SEQ ID NO: 131861 - RNA, 18 nt, Artificial Sequence
  Description of Artificial Sequence: Synthetic oligonucleotide
ccuaagacacaaacacag

SEQ ID NO: 131862 - RNA, 18 nt, Artificial Sequence
  Description of Artificial Sequence: Synthetic oligonucleotide
caacuccuaagacacaaa

SEQ ID NO: 131863 - RNA, 18 nt, Artificial Sequence
  Description of Artificial Sequence: Synthetic oligonucleotide
acgggcaacuccuaagac

SEQ ID NO: 131864 - RNA, 18 nt, Artificial Sequence
  Description of Artificial Sequence: Synthetic oligonucleotide
ucaacacgggcaacuccu

SEQ ID NO: 131865 - RNA, 18 nt, Artificial Sequence
  Description of Artificial Sequence: Synthetic oligonucleotide
caagaucaacacgggcaa

SEQ ID NO: 131866 - RNA, 18 nt, Artificial Sequence
  Description of Artificial Sequence: Synthetic oligonucleotide
auaagcaagaucaacacg

SEQ ID NO: 131867 - RNA, 18 nt, Artificial Sequence
  Description of Artificial Sequence: Synthetic oligonucleotide
cauacauaagcaagauca

SEQ ID NO: 131868 - RNA, 18 nt, Artificial Sequence
  Description of Artificial Sequence: Synthetic oligonucleotide
acuuacauacauaagcaa

SEQ ID NO: 131869 - RNA, 18 nt, Artificial Sequence
  Description of Artificial Sequence: Synthetic oligonucleotide
uacacacuuacauacaua

SEQ ID NO: 131870 - RNA, 18 nt, Artificial Sequence
  Description of Artificial Sequence: Synthetic oligonucleotide
acacauacacacuuacau

SEQ ID NO: 131871 - RNA, 18 nt, Artificial Sequence
  Description of Artificial Sequence: Synthetic oligonucleotide
uacacacacauacacacu

SEQ ID NO: 131872 - RNA, 18 nt, Artificial Sequence
  Description of Artificial Sequence: Synthetic oligonucleotide
acaaguacacacacauac

SEQ ID NO: 131873 - RNA, 18 nt, Artificial Sequence
  Description of Artificial Sequence: Synthetic oligonucleotide
cagacacaaguacacaca

SEQ ID NO: 131874 - RNA, 18 nt, Artificial Sequence
  Description of Artificial Sequence: Synthetic oligonucleotide
auccacagacacaaguac

SEQ ID NO: 131875 - RNA, 18 nt, Artificial Sequence
  Description of Artificial Sequence: Synthetic oligonucleotide
caaacauccacagacaca

SEQ ID NO: 131876 - RNA, 18 nt, Artificial Sequence
  Description of Artificial Sequence: Synthetic oligonucleotide
auguacaaacauccacag

SEQ ID NO: 131877 - RNA, 18 nt, Artificial Sequence
  Description of Artificial Sequence: Synthetic oligonucleotide
cacacauguacaaacauc

SEQ ID NO: 131878 - RNA, 18 nt, Artificial Sequence
  Description of Artificial Sequence: Synthetic oligonucleotide
cacagcacacauguacaa

SEQ ID NO: 131879 - RNA, 18 nt, Artificial Sequence
  Description of Artificial Sequence: Synthetic oligonucleotide
gcacacacagcacacaug

SEQ ID NO: 131880 - RNA, 18 nt, Artificial Sequence
  Description of Artificial Sequence: Synthetic oligonucleotide
gacccgcacacacagcac

SEQ ID NO: 131881 - RNA, 18 nt, Artificial Sequence
  Description of Artificial Sequence: Synthetic oligonucleotide
ucuaugacccgcacacac

SEQ ID NO: 131882 - RNA, 18 nt, Artificial Sequence
  Description of Artificial Sequence: Synthetic oligonucleotide
ugugcucuaugacccgca

SEQ ID NO: 131883 - RNA, 18 nt, Artificial Sequence
  Description of Artificial Sequence: Synthetic oligonucleotide
acgcaugugcucuaugac

SEQ ID NO: 131884 - RNA, 18 nt, Artificial Sequence
  Description of Artificial Sequence: Synthetic oligonucleotide
cacaaacgcaugugcucu

SEQ ID NO: 131885 - RNA, 18 nt, Artificial Sequence
  Description of Artificial Sequence: Synthetic oligonucleotide
gcaugcacaaacgcaugu

SEQ ID NO: 131886 - RNA, 18 nt, Artificial Sequence
  Description of Artificial Sequence: Synthetic oligonucleotide
gguccgcaugcacaaacg

SEQ ID NO: 131887 - RNA, 18 nt, Artificial Sequence
  Description of Artificial Sequence: Synthetic oligonucleotide
caacagguccgcaugcac

SEQ ID NO: 131888 - RNA, 18 nt, Artificial Sequence
  Description of Artificial Sequence: Synthetic oligonucleotide
cacuccaacagguccgca

SEQ ID NO: 131889 - RNA, 18 nt, Artificial Sequence
  Description of Artificial Sequence: Synthetic oligonucleotide
cagggcacuccaacaggu

SEQ ID NO: 131890 - RNA, 18 nt, Artificial Sequence
  Description of Artificial Sequence: Synthetic oligonucleotide
aagaacagggcacuccaa

SEQ ID NO: 131891 - RNA, 18 nt, Artificial Sequence
  Description of Artificial Sequence: Synthetic oligonucleotide
gcaggaagaacagggcac

SEQ ID NO: 131892 - RNA, 18 nt, Artificial Sequence
  Description of Artificial Sequence: Synthetic oligonucleotide
aagaugcaggaagaacag

SEQ ID NO: 131893 - RNA, 18 nt, Artificial Sequence
  Description of Artificial Sequence: Synthetic oligonucleotide
ggauaaagaugcaggaag

SEQ ID NO: 131894 - RNA, 18 nt, Artificial Sequence
  Description of Artificial Sequence: Synthetic oligonucleotide
auacaggauaaagaugca

SEQ ID NO: 131895 - RNA, 18 nt, Artificial Sequence
  Description of Artificial Sequence: Synthetic oligonucleotide
cgcccauacaggauaaag

SEQ ID NO: 131896 - RNA, 18 nt, Artificial Sequence
  Description of Artificial Sequence: Synthetic oligonucleotide
caaaacgcccauacagga

SEQ ID NO: 131897 - RNA, 18 nt, Artificial Sequence
  Description of Artificial Sequence: Synthetic oligonucleotide
cacgacaaaacgcccaua

SEQ ID NO: 131898 - RNA, 18 nt, Artificial Sequence
  Description of Artificial Sequence: Synthetic oligonucleotide
gggcacacgacaaaacgc

SEQ ID NO: 131899 - RNA, 18 nt, Artificial Sequence
  Description of Artificial Sequence: Synthetic oligonucleotide
aauaugggcacacgacaa

SEQ ID NO: 131900 - RNA, 18 nt, Artificial Sequence
  Description of Artificial Sequence: Synthetic oligonucleotide
guacaaauaugggcacac

SEQ ID NO: 131901 - RNA, 18 nt, Artificial Sequence
  Description of Artificial Sequence: Synthetic oligonucleotide
agcagguacaaauauggg

SEQ ID NO: 131902 - RNA, 18 nt, Artificial Sequence
  Description of Artificial Sequence: Synthetic oligonucleotide
uacacagcagguacaaau

SEQ ID NO: 131903 - RNA, 18 nt, Artificial Sequence
  Description of Artificial Sequence: Synthetic oligonucleotide
auauauacacagcaggua

SEQ ID NO: 131904 - RNA, 18 nt, Artificial Sequence
  Description of Artificial Sequence: Synthetic oligonucleotide
acugcauauauacacagc

SEQ ID NO: 131905 - RNA, 18 nt, Artificial Sequence
  Description of Artificial Sequence: Synthetic oligonucleotide
agggaacugcauauauac

SEQ ID NO: 131906 - RNA, 18 nt, Artificial Sequence
  Description of Artificial Sequence: Synthetic oligonucleotide
agcacagggaacugcaua

SEQ ID NO: 131907 - RNA, 18 nt, Artificial Sequence
  Description of Artificial Sequence: Synthetic oligonucleotide
cccgcagcacagggaacu

SEQ ID NO: 131908 - RNA, 18 nt, Artificial Sequence
  Description of Artificial Sequence: Synthetic oligonucleotide
ccccgcccgcagcacagg

SEQ ID NO: 131909 - RNA, 18 nt, Artificial Sequence
  Description of Artificial Sequence: Synthetic oligonucleotide
cugacccccgcccgcagc

SEQ ID NO: 131910 - RNA, 18 nt, Artificial Sequence
  Description of Artificial Sequence: Synthetic oligonucleotide
gaccgcugacccccgccc

SEQ ID NO: 131911 - RNA, 18 nt, Artificial Sequence
  Description of Artificial Sequence: Synthetic oligonucleotide
ccagagaccgcugacccc

SEQ ID NO: 131912 - RNA, 18 nt, Artificial Sequence
  Description of Artificial Sequence: Synthetic oligonucleotide
gcacaccagagaccgcug

SEQ ID NO: 131913 - RNA, 18 nt, Artificial Sequence
  Description of Artificial Sequence: Synthetic oligonucleotide
gucgugcacaccagagac

SEQ ID NO: 131914 - RNA, 18 nt, Artificial Sequence
  Description of Artificial Sequence: Synthetic oligonucleotide
gugcagucgugcacacca

SEQ ID NO: 131915 - RNA, 18 nt, Artificial Sequence
  Description of Artificial Sequence: Synthetic oligonucleotide
ggucugugcagucgugca

SEQ ID NO: 131916 - RNA, 18 nt, Artificial Sequence
  Description of Artificial Sequence: Synthetic oligonucleotide
auuugggucugugcaguc

SEQ ID NO: 131917 - RNA, 18 nt, Artificial Sequence
  Description of Artificial Sequence: Synthetic oligonucleotide
ccugcauuugggucugug

SEQ ID NO: 131918 - RNA, 18 nt, Artificial Sequence
  Description of Artificial Sequence: Synthetic oligonucleotide
agaguccugcauuugggu

SEQ ID NO: 131919 - RNA, 18 nt, Artificial Sequence
  Description of Artificial Sequence: Synthetic oligonucleotide
acaacagaguccugcauu

SEQ ID NO: 131920 - RNA, 18 nt, Artificial Sequence
  Description of Artificial Sequence: Synthetic oligonucleotide
uggcaacaacagaguccu

SEQ ID NO: 131921 - RNA, 18 nt, Artificial Sequence
  Description of Artificial Sequence: Synthetic oligonucleotide
gugaguggcaacaacaga

SEQ ID NO: 131922 - RNA, 18 nt, Artificial Sequence
  Description of Artificial Sequence: Synthetic oligonucleotide
acuuggugaguggcaaca

SEQ ID NO: 131923 - RNA, 18 nt, Artificial Sequence
  Description of Artificial Sequence: Synthetic oligonucleotide
aucucacuuggugagugg

SEQ ID NO: 131924 - RNA, 18 nt, Artificial Sequence
  Description of Artificial Sequence: Synthetic oligonucleotide
uaugaaucucacuuggug

SEQ ID NO: 131925 - RNA, 18 nt, Artificial Sequence
  Description of Artificial Sequence: Synthetic oligonucleotide
gcugauaugaaucucacu

SEQ ID NO: 131926 - RNA, 18 nt, Artificial Sequence
  Description of Artificial Sequence: Synthetic oligonucleotide
auguugcugauaugaauc

SEQ ID NO: 131927 - RNA, 18 nt, Artificial Sequence
  Description of Artificial Sequence: Synthetic oligonucleotide
cggacauguugcugauau

SEQ ID NO: 131928 - RNA, 18 nt, Artificial Sequence
  Description of Artificial Sequence: Synthetic oligonucleotide
gacgcagcggcaacaaaa

SEQ ID NO: 131929 - RNA, 18 nt, Artificial Sequence
  Description of Artificial Sequence: Synthetic oligonucleotide
ggcgagacgcagcggcaa

SEQ ID NO: 131930 - RNA, 18 nt, Artificial Sequence
  Description of Artificial Sequence: Synthetic oligonucleotide
aaucuggcgagacgcagc

SEQ ID NO: 131931 - RNA, 18 nt, Artificial Sequence
  Description of Artificial Sequence: Synthetic oligonucleotide
gccucaaucuggcgagac

SEQ ID NO: 131932 - RNA, 18 nt, Artificial Sequence
  Description of Artificial Sequence: Synthetic oligonucleotide
gggaugccucaaucuggc

SEQ ID NO: 131933 - RNA, 18 nt, Artificial Sequence
  Description of Artificial Sequence: Synthetic oligonucleotide
augcuccagugaugucgg

SEQ ID NO: 131934 - RNA, 18 nt, Artificial Sequence
  Description of Artificial Sequence: Synthetic oligonucleotide
cagauaugcuccagugau

SEQ ID NO: 131935 - RNA, 18 nt, Artificial Sequence
  Description of Artificial Sequence: Synthetic oligonucleotide
cccuccagauaugcucca

SEQ ID NO: 131936 - RNA, 18 nt, Artificial Sequence
  Description of Artificial Sequence: Synthetic oligonucleotide
uccaccccuccagauaug

SEQ ID NO: 131937 - RNA, 18 nt, Artificial Sequence
  Description of Artificial Sequence: Synthetic oligonucleotide
aacuguccaccccuccag

SEQ ID NO: 131938 - RNA, 18 nt, Artificial Sequence
  Description of Artificial Sequence: Synthetic oligonucleotide
uggagaacuguccacccc

SEQ ID NO: 131939 - RNA, 18 nt, Artificial Sequence
  Description of Artificial Sequence: Synthetic oligonucleotide
cccuguggagaacugucc

SEQ ID NO: 131940 - RNA, 18 nt, Artificial Sequence
  Description of Artificial Sequence: Synthetic oligonucleotide
gacgcagcggcaacaaaa

SEQ ID NO: 131941 - RNA, 18 nt, Artificial Sequence
  Description of Artificial Sequence: Synthetic oligonucleotide
ggcgagacgcagcggcaa

SEQ ID NO: 131942 - RNA, 18 nt, Artificial Sequence
  Description of Artificial Sequence: Synthetic oligonucleotide
aaucuggcgagacgcagc

SEQ ID NO: 131943 - RNA, 18 nt, Artificial Sequence
  Description of Artificial Sequence: Synthetic oligonucleotide
gccucaaucuggcgagac

SEQ ID NO: 131944 - RNA, 18 nt, Artificial Sequence
  Description of Artificial Sequence: Synthetic oligonucleotide
gggaugccucaaucuggc

SEQ ID NO: 131945 - RNA, 18 nt, Artificial Sequence
  Description of Artificial Sequence: Synthetic oligonucleotide
uccagugaugucggaggg

SEQ ID NO: 131946 - RNA, 18 nt, Artificial Sequence
  Description of Artificial Sequence: Synthetic oligonucleotide
ugcuccagugaugucgga

SEQ ID NO: 131947 - RNA, 18 nt, Artificial Sequence
  Description of Artificial Sequence: Synthetic oligonucleotide
agauaugcuccagugaug

SEQ ID NO: 131948 - RNA, 18 nt, Artificial Sequence
  Description of Artificial Sequence: Synthetic oligonucleotide
ccuccagauaugcuccag

SEQ ID NO: 131949 - RNA, 18 nt, Artificial Sequence
  Description of Artificial Sequence: Synthetic oligonucleotide
ccaccccuccagauaugc

SEQ ID NO: 131950 - RNA, 18 nt, Artificial Sequence
  Description of Artificial Sequence: Synthetic oligonucleotide
acuguccaccccuccaga

SEQ ID NO: 131951 - RNA, 18 nt, Artificial Sequence
  Description of Artificial Sequence: Synthetic oligonucleotide
ggagaacuguccaccccu

SEQ ID NO: 131952 - RNA, 18 nt, Artificial Sequence
  Description of Artificial Sequence: Synthetic oligonucleotide
ccuguggagaacugucca

SEQ ID NO: 131953 - RNA, 18 nt, Artificial Sequence
  Description of Artificial Sequence: Synthetic oligonucleotide
ccgggccuccucuuuucc

SEQ ID NO: 131954 - RNA, 18 nt, Artificial Sequence
  Description of Artificial Sequence: Synthetic oligonucleotide
gguuuccgggccuccucu

SEQ ID NO: 131955 - RNA, 18 nt, Artificial Sequence
  Description of Artificial Sequence: Synthetic oligonucleotide
ggguuuccgggccuccuc

SEQ ID NO: 131956 - RNA, 18 nt, Artificial Sequence
  Description of Artificial Sequence: Synthetic oligonucleotide
cucuucccuccaggaggg

SEQ ID NO: 131957 - RNA, 18 nt, Artificial Sequence
  Description of Artificial Sequence: Synthetic oligonucleotide
gggcucuucccuccagga

SEQ ID NO: 131958 - RNA, 18 nt, Artificial Sequence
  Description of Artificial Sequence: Synthetic oligonucleotide
uggccugggaccgauggg

SEQ ID NO: 131959 - RNA, 18 nt, Artificial Sequence
  Description of Artificial Sequence: Synthetic oligonucleotide
gaggcuggccugggaccg

SEQ ID NO: 131960 - RNA, 18 nt, Artificial Sequence
  Description of Artificial Sequence: Synthetic oligonucleotide
ccucugaggcuggccugg

SEQ ID NO: 131961 - RNA, 18 nt, Artificial Sequence
  Description of Artificial Sequence: Synthetic oligonucleotide
ccucuccucugaggcugg

SEQ ID NO: 131962 - RNA, 18 nt, Artificial Sequence
  Description of Artificial Sequence: Synthetic oligonucleotide
ugcccccucuccucugag

SEQ ID NO: 131963 - RNA, 18 nt, Artificial Sequence
  Description of Artificial Sequence: Synthetic oligonucleotide
cugccugcccccucuccu

SEQ ID NO: 131964 - RNA, 18 nt, Artificial Sequence
  Description of Artificial Sequence: Synthetic oligonucleotide
gccagcugccugcccccu

SEQ ID NO: 131965 - RNA, 18 nt, Artificial Sequence
  Description of Artificial Sequence: Synthetic oligonucleotide
ccucagccagcugccugc

SEQ ID NO: 131966 - RNA, 18 nt, Artificial Sequence
  Description of Artificial Sequence: Synthetic oligonucleotide
gcugaccucagccagcug

SEQ ID NO: 131967 - RNA, 18 nt, Artificial Sequence
  Description of Artificial Sequence: Synthetic oligonucleotide
ggcaggcugaccucagcc

SEQ ID NO: 131968 - RNA, 18 nt, Artificial Sequence
  Description of Artificial Sequence: Synthetic oligonucleotide
aggguggcaggcugaccu

SEQ ID NO: 131969 - RNA, 18 nt, Artificial Sequence
  Description of Artificial Sequence: Synthetic oligonucleotide
gaagcaggguggcaggcu

SEQ ID NO: 131970 - RNA, 18 nt, Artificial Sequence
  Description of Artificial Sequence: Synthetic oligonucleotide
agaaggaagcaggguggc

SEQ ID NO: 131971 - RNA, 18 nt, Artificial Sequence
  Description of Artificial Sequence: Synthetic oligonucleotide
gacacagaaggaagcagg

SEQ ID NO: 131972 - RNA, 18 nt, Artificial Sequence
  Description of Artificial Sequence: Synthetic oligonucleotide
uccaagacacagaaggaa

SEQ ID NO: 131973 - RNA, 18 nt, Artificial Sequence
  Description of Artificial Sequence: Synthetic oligonucleotide
guggcuccaagacacaga

SEQ ID NO: 131974 - RNA, 18 nt, Artificial Sequence
  Description of Artificial Sequence: Synthetic oligonucleotide
gcugaguggcuccaagac

SEQ ID NO: 131975 - RNA, 18 nt, Artificial Sequence
  Description of Artificial Sequence: Synthetic oligonucleotide
uacuggcugaguggcucc

SEQ ID NO: 131976 - RNA, 18 nt, Artificial Sequence
  Description of Artificial Sequence: Synthetic oligonucleotide
ccucauacuggcugagug

SEQ ID NO: 131977 - RNA, 18 nt, Artificial Sequence
  Description of Artificial Sequence: Synthetic oligonucleotide
ugcagccucauacuggcu

SEQ ID NO: 131978 - RNA, 18 nt, Artificial Sequence
  Description of Artificial Sequence: Synthetic oligonucleotide
ggagcugcagccucauac

SEQ ID NO: 131979 - RNA, 18 nt, Artificial Sequence
  Description of Artificial Sequence: Synthetic oligonucleotide
cagcuggagcugcagccu

SEQ ID NO: 131980 - RNA, 18 nt, Artificial Sequence
  Description of Artificial Sequence: Synthetic oligonucleotide
gaccucagcuggagcugc

SEQ ID NO: 131981 - RNA, 18 nt, Artificial Sequence
  Description of Artificial Sequence: Synthetic oligonucleotide
uuccagaccucagcugga

SEQ ID NO: 131982 - RNA, 18 nt, Artificial Sequence
  Description of Artificial Sequence: Synthetic oligonucleotide
caagauuccagaccucag

SEQ ID NO: 131983 - RNA, 18 nt, Artificial Sequence
  Description of Artificial Sequence: Synthetic oligonucleotide
gaccacaagauuccagac

SEQ ID NO: 131984 - RNA, 18 nt, Artificial Sequence
  Description of Artificial Sequence: Synthetic oligonucleotide
gagcugaccacaagauuc

SEQ ID NO: 131985 - RNA, 18 nt, Artificial Sequence
  Description of Artificial Sequence: Synthetic oligonucleotide
uagcugagcugaccacaa

SEQ ID NO: 131986 - RNA, 18 nt, Artificial Sequence
  Description of Artificial Sequence: Synthetic oligonucleotide
cacccuagcugagcugac

SEQ ID NO: 131987 - RNA, 18 nt, Artificial Sequence
  Description of Artificial Sequence: Synthetic oligonucleotide
cuccucacccuagcugag

SEQ ID NO: 131988 - RNA, 18 nt, Artificial Sequence
  Description of Artificial Sequence: Synthetic oligonucleotide
gcugccuccucacccuag

SEQ ID NO: 131989 - RNA, 18 nt, Artificial Sequence
  Description of Artificial Sequence: Synthetic oligonucleotide
cagcagcugccuccucac

SEQ ID NO: 131990 - RNA, 18 nt, Artificial Sequence
  Description of Artificial Sequence: Synthetic oligonucleotide
gugcccagcagcugccuc

SEQ ID NO: 131991 - RNA, 18 nt, Artificial Sequence
  Description of Artificial Sequence: Synthetic oligonucleotide
aagcagugcccagcagcu

SEQ ID NO: 131992 - RNA, 18 nt, Artificial Sequence
  Description of Artificial Sequence: Synthetic oligonucleotide
acaacaagcagugcccag

SEQ ID NO: 131993 - RNA, 18 nt, Artificial Sequence
  Description of Artificial Sequence: Synthetic oligonucleotide
agcugacaacaagcagug

SEQ ID NO: 131994 - RNA, 18 nt, Artificial Sequence
  Description of Artificial Sequence: Synthetic oligonucleotide
ugcugagcugacaacaag

SEQ ID NO: 131995 - RNA, 18 nt, Artificial Sequence
  Description of Artificial Sequence: Synthetic oligonucleotide
gcaccugcugagcugaca

SEQ ID NO: 131996 - RNA, 18 nt, Artificial Sequence
  Description of Artificial Sequence: Synthetic oligonucleotide
ggugagcaccugcugagc

SEQ ID NO: 131997 - RNA, 18 nt, Artificial Sequence
  Description of Artificial Sequence: Synthetic oligonucleotide
gggcaggugagcaccugc

SEQ ID NO: 131998 - RNA, 18 nt, Artificial Sequence
  Description of Artificial Sequence: Synthetic oligonucleotide
cacacgugacuggacggc

SEQ ID NO: 131999 - RNA, 18 nt, Artificial Sequence
  Description of Artificial Sequence: Synthetic oligonucleotide
aaggucacacgugacugg

SEQ ID NO: 132000 - RNA, 18 nt, Artificial Sequence
  Description of Artificial Sequence: Synthetic oligonucleotide
ugcccaaggucacacgug

SEQ ID NO: 132001 - RNA, 18 nt, Artificial Sequence
  Description of Artificial Sequence: Synthetic oligonucleotide
ugacaugcccaaggucac

SEQ ID NO: 132002 - RNA, 18 nt, Artificial Sequence
  Description of Artificial Sequence: Synthetic oligonucleotide
ggaggugacaugcccaag

SEQ ID NO: 132003 - RNA, 18 nt, Artificial Sequence
  Description of Artificial Sequence: Synthetic oligonucleotide
gggaggugacaugcccaa

SEQ ID NO: 132004 - RNA, 18 nt, Artificial Sequence
  Description of Artificial Sequence: Synthetic oligonucleotide
acagaagccaggauaggg

SEQ ID NO: 132005 - RNA, 18 nt, Artificial Sequence
  Description of Artificial Sequence: Synthetic oligonucleotide
aagauacagaagccagga

SEQ ID NO: 132006 - RNA, 18 nt, Artificial Sequence
  Description of Artificial Sequence: Synthetic oligonucleotide
uguagaagauacagaagc

SEQ ID NO: 132007 - RNA, 18 nt, Artificial Sequence
  Description of Artificial Sequence: Synthetic oligonucleotide
uguuuuguagaagauaca

SEQ ID NO: 132008 - RNA, 18 nt, Artificial Sequence
  Description of Artificial Sequence: Synthetic oligonucleotide
aagccuguuuuguagaag

SEQ ID NO: 132009 - RNA, 18 nt, Artificial Sequence
  Description of Artificial Sequence: Synthetic oligonucleotide
gaaugaagccuguuuugu

SEQ ID NO: 132010 - RNA, 18 nt, Artificial Sequence
  Description of Artificial Sequence: Synthetic oligonucleotide
gggaaugaagccuguuuu

SEQ ID NO: 132011 - RNA, 18 nt, Artificial Sequence
  Description of Artificial Sequence: Synthetic oligonucleotide
ccagccagcaggccuggg

SEQ ID NO: 132012 - RNA, 18 nt, Artificial Sequence
  Description of Artificial Sequence: Synthetic oligonucleotide
gccguccagccagcaggc

SEQ ID NO: 132013 - RNA, 18 nt, Artificial Sequence
  Description of Artificial Sequence: Synthetic oligonucleotide
uaaaagccguccagccag

SEQ ID NO: 132014 - RNA, 18 nt, Artificial Sequence
  Description of Artificial Sequence: Synthetic oligonucleotide
aggccuaaaagccgucca

SEQ ID NO: 132015 - RNA, 18 nt, Artificial Sequence
  Description of Artificial Sequence: Synthetic oligonucleotide
cagacaggccuaaaagcc

SEQ ID NO: 132016 - RNA, 18 nt, Artificial Sequence
  Description of Artificial Sequence: Synthetic oligonucleotide
guccucagacaggccuaa

SEQ ID NO: 132017 - RNA, 18 nt, Artificial Sequence
  Description of Artificial Sequence: Synthetic oligonucleotide
gcgugguccucagacagg

SEQ ID NO: 132018 - RNA, 18 nt, Artificial Sequence
  Description of Artificial Sequence: Synthetic oligonucleotide
uccuggcgugguccucag

SEQ ID NO: 132019 - RNA, 18 nt, Artificial Sequence
  Description of Artificial Sequence: Synthetic oligonucleotide
ugcgcuccuggcgugguc

SEQ ID NO: 132020 - RNA, 18 nt, Artificial Sequence
  Description of Artificial Sequence: Synthetic oligonucleotide
ugccuugcgcuccuggcg

SEQ ID NO: 132021 - RNA, 18 nt, Artificial Sequence
  Description of Artificial Sequence: Synthetic oligonucleotide
guuuuugccuugcgcucc

SEQ ID NO: 132022 - RNA, 18 nt, Artificial Sequence
  Description of Artificial Sequence: Synthetic oligonucleotide
gguguguuuuugccuugc

SEQ ID NO: 132023 - RNA, 18 nt, Artificial Sequence
  Description of Artificial Sequence: Synthetic oligonucleotide
ucucugguguguuuuugc

SEQ ID NO: 132024 - RNA, 18 nt, Artificial Sequence
  Description of Artificial Sequence: Synthetic oligonucleotide
ugcuaucucugguguguu

SEQ ID NO: 132025 - RNA, 18 nt, Artificial Sequence
  Description of Artificial Sequence: Synthetic oligonucleotide
uuguuugcuaucucuggu

SEQ ID NO: 132026 - RNA, 18 nt, Artificial Sequence
  Description of Artificial Sequence: Synthetic oligonucleotide
gcagcuuguuugcuaucu

SEQ ID NO: 132027 - RNA, 18 nt, Artificial Sequence
  Description of Artificial Sequence: Synthetic oligonucleotide
cagcagcagcuuguuugc

SEQ ID NO: 132028 - RNA, 18 nt, Artificial Sequence
  Description of Artificial Sequence: Synthetic oligonucleotide
uagugcagcagcagcuug

SEQ ID NO: 132029 - RNA, 18 nt, Artificial Sequence
  Description of Artificial Sequence: Synthetic oligonucleotide
ccaccuagugcagcagca

SEQ ID NO: 132030 - RNA, 18 nt, Artificial Sequence
  Description of Artificial Sequence: Synthetic oligonucleotide
acacuccaccuagugcag

SEQ ID NO: 132031 - RNA, 18 nt, Artificial Sequence
  Description of Artificial Sequence: Synthetic oligonucleotide
acacaacacuccaccuag

SEQ ID NO: 132032 - RNA, 18 nt, Artificial Sequence
  Description of Artificial Sequence: Synthetic oligonucleotide
gggccacacaacacucca

SEQ ID NO: 132033 - RNA, 18 nt, Artificial Sequence
  Description of Artificial Sequence: Synthetic oligonucleotide
gcagggcagugguccucg

SEQ ID NO: 132034 - RNA, 18 nt, Artificial Sequence
  Description of Artificial Sequence: Synthetic oligonucleotide
ccagggcagggcaguggu

SEQ ID NO: 132035 - RNA, 18 nt, Artificial Sequence
  Description of Artificial Sequence: Synthetic oligonucleotide
gcagcccagggcagggca

SEQ ID NO: 132036 - RNA, 18 nt, Artificial Sequence
  Description of Artificial Sequence: Synthetic oligonucleotide
gggagcagcccagggcag

SEQ ID NO: 132037 - RNA, 18 nt, Artificial Sequence
  Description of Artificial Sequence: Synthetic oligonucleotide
uccuaggagggucuggac

SEQ ID NO: 132038 - RNA, 18 nt, Artificial Sequence
  Description of Artificial Sequence: Synthetic oligonucleotide
uggccuccuaggaggguc

SEQ ID NO: 132039 - RNA, 18 nt, Artificial Sequence
  Description of Artificial Sequence: Synthetic oligonucleotide
ucauguggccuccuagga

SEQ ID NO: 132040 - RNA, 18 nt, Artificial Sequence
  Description of Artificial Sequence: Synthetic oligonucleotide
cacacucauguggccucc

SEQ ID NO: 132041 - RNA, 18 nt, Artificial Sequence
  Description of Artificial Sequence: Synthetic oligonucleotide
acagucacacucaugugg

SEQ ID NO: 132042 - RNA, 18 nt, Artificial Sequence
  Description of Artificial Sequence: Synthetic oligonucleotide
cgagaacagucacacuca

SEQ ID NO: 132043 - RNA, 18 nt, Artificial Sequence
  Description of Artificial Sequence: Synthetic oligonucleotide
ugggccgagaacagucac

SEQ ID NO: 132044 - RNA, 18 nt, Artificial Sequence
  Description of Artificial Sequence: Synthetic oligonucleotide
agacuugggccgagaaca

SEQ ID NO: 132045 - RNA, 18 nt, Artificial Sequence
  Description of Artificial Sequence: Synthetic oligonucleotide
gagaaagacuugggccga

SEQ ID NO: 132046 - RNA, 18 nt, Artificial Sequence
  Description of Artificial Sequence: Synthetic oligonucleotide
ggaacgagaaagacuugg

SEQ ID NO: 132047 - RNA, 18 nt, Artificial Sequence
  Description of Artificial Sequence: Synthetic oligonucleotide
ucugaggaacgagaaaga

SEQ ID NO: 132048 - RNA, 18 nt, Artificial Sequence
  Description of Artificial Sequence: Synthetic oligonucleotide
aauucucugaggaacgag

SEQ ID NO: 132049 - RNA, 18 nt, Artificial Sequence
  Description of Artificial Sequence: Synthetic oligonucleotide
ccgcaaauucucugagga

SEQ ID NO: 132050 - RNA, 18 nt, Artificial Sequence
  Description of Artificial Sequence: Synthetic oligonucleotide
gggccccgcaaauucucu

SEQ ID NO: 132051 - RNA, 18 nt, Artificial Sequence
  Description of Artificial Sequence: Synthetic oligonucleotide
cagcuugugugcccaggg

SEQ ID NO: 132052 - RNA, 18 nt, Artificial Sequence
  Description of Artificial Sequence: Synthetic oligonucleotide
ucucagcuugugugccca

SEQ ID NO: 132053 - RNA, 18 nt, Artificial Sequence
  Description of Artificial Sequence: Synthetic oligonucleotide
guggaucucagcuugugu

SEQ ID NO: 132054 - RNA, 18 nt, Artificial Sequence
  Description of Artificial Sequence: Synthetic oligonucleotide
gcuggguggaucucagcu

SEQ ID NO: 132055 - RNA, 18 nt, Artificial Sequence
  Description of Artificial Sequence: Synthetic oligonucleotide
ccagggcuggguggaucu

SEQ ID NO: 132056 - RNA, 18 nt, Artificial Sequence
  Description of Artificial Sequence: Synthetic oligonucleotide
agggaccagggcugggug

SEQ ID NO: 132057 - RNA, 18 nt, Artificial Sequence
  Description of Artificial Sequence: Synthetic oligonucleotide
ugccaagggaccagggcu

SEQ ID NO: 132058 - RNA, 18 nt, Artificial Sequence
  Description of Artificial Sequence: Synthetic oligonucleotide
guucuugccaagggacca

SEQ ID NO: 132059 - RNA, 18 nt, Artificial Sequence
  Description of Artificial Sequence: Synthetic oligonucleotide
ccucaguucuugccaagg

SEQ ID NO: 132060 - RNA, 18 nt, Artificial Sequence
  Description of Artificial Sequence: Synthetic oligonucleotide
cugucccucaguucuugc

SEQ ID NO: 132061 - RNA, 18 nt, Artificial Sequence
  Description of Artificial Sequence: Synthetic oligonucleotide
agguccugucccucaguu

SEQ ID NO: 132062 - RNA, 18 nt, Artificial Sequence
  Description of Artificial Sequence: Synthetic oligonucleotide
gaaccagguccugucccu

SEQ ID NO: 132063 - RNA, 18 nt, Artificial Sequence
  Description of Artificial Sequence: Synthetic oligonucleotide
ccccagaaccagguccug

SEQ ID NO: 132064 - RNA, 18 nt, Artificial Sequence
  Description of Artificial Sequence: Synthetic oligonucleotide
auuuuccccagaaccagg

SEQ ID NO: 132065 - RNA, 18 nt, Artificial Sequence
  Description of Artificial Sequence: Synthetic oligonucleotide
ccugcauuuuccccagaa

SEQ ID NO: 132066 - RNA, 18 nt, Artificial Sequence
  Description of Artificial Sequence: Synthetic oligonucleotide
auuccccugcauuuuccc

SEQ ID NO: 132067 - RNA, 18 nt, Artificial Sequence
  Description of Artificial Sequence: Synthetic oligonucleotide
gaaacauuccccugcauu

SEQ ID NO: 132068 - RNA, 18 nt, Artificial Sequence
  Description of Artificial Sequence: Synthetic oligonucleotide
agggagaaacauuccccu

SEQ ID NO: 132069 - RNA, 18 nt, Artificial Sequence
  Description of Artificial Sequence: Synthetic oligonucleotide
guggaagggagaaacauu

SEQ ID NO: 132070 - RNA, 18 nt, Artificial Sequence
  Description of Artificial Sequence: Synthetic oligonucleotide
gggcuguggaagggagaa

SEQ ID NO: 132071 - RNA, 18 nt, Artificial Sequence
  Description of Artificial Sequence: Synthetic oligonucleotide
ccuccuaacucgcaaggg

SEQ ID NO: 132072 - RNA, 18 nt, Artificial Sequence
  Description of Artificial Sequence: Synthetic oligonucleotide
cggccuccuaacucgcaa

SEQ ID NO: 132073 - RNA, 18 nt, Artificial Sequence
  Description of Artificial Sequence: Synthetic oligonucleotide
ggagccggccuccuaacu

SEQ ID NO: 132074 - RNA, 18 nt, Artificial Sequence
  Description of Artificial Sequence: Synthetic oligonucleotide
gggugggagccggccucc

SEQ ID NO: 132075 - RNA, 18 nt, Artificial Sequence
  Description of Artificial Sequence: Synthetic oligonucleotide
accuggccaccuucuggg

SEQ ID NO: 132076 - RNA, 18 nt, Artificial Sequence
  Description of Artificial Sequence: Synthetic oligonucleotide
gaaaaccuggccaccuuc

SEQ ID NO: 132077 - RNA, 18 nt, Artificial Sequence
  Description of Artificial Sequence: Synthetic oligonucleotide
ggcaugaaaaccuggcca

SEQ ID NO: 132078 - RNA, 18 nt, Artificial Sequence
  Description of Artificial Sequence: Synthetic oligonucleotide
aggaaggcaugaaaaccu

SEQ ID NO: 132079 - RNA, 18 nt, Artificial Sequence
  Description of Artificial Sequence: Synthetic oligonucleotide
ucucuaggaaggcaugaa

SEQ ID NO: 132080 - RNA, 18 nt, Artificial Sequence
  Description of Artificial Sequence: Synthetic oligonucleotide
agcuuucucuaggaaggc

SEQ ID NO: 132081 - RNA, 18 nt, Artificial Sequence
  Description of Artificial Sequence: Synthetic oligonucleotide
gccccagcuuucucuagg

SEQ ID NO: 132082 - RNA, 18 nt, Artificial Sequence
  Description of Artificial Sequence: Synthetic oligonucleotide
cacgagccccagcuuucu

SEQ ID NO: 132083 - RNA, 18 nt, Artificial Sequence
  Description of Artificial Sequence: Synthetic oligonucleotide
gaggccacgagccccagc

SEQ ID NO: 132084 - RNA, 18 nt, Artificial Sequence
  Description of Artificial Sequence: Synthetic oligonucleotide
ugguggaggccacgagcc

SEQ ID NO: 132085 - RNA, 18 nt, Artificial Sequence
  Description of Artificial Sequence: Synthetic oligonucleotide
uccugugguggaggccac

SEQ ID NO: 132086 - RNA, 18 nt, Artificial Sequence
  Description of Artificial Sequence: Synthetic oligonucleotide
cgucuuccugugguggag

SEQ ID NO: 132087 - RNA, 18 nt, Artificial Sequence
  Description of Artificial Sequence: Synthetic oligonucleotide
gucugcgucuuccugugg

SEQ ID NO: 132088 - RNA, 18 nt, Artificial Sequence
  Description of Artificial Sequence: Synthetic oligonucleotide
ugagggucugcgucuucc

SEQ ID NO: 132089 - RNA, 18 nt, Artificial Sequence
  Description of Artificial Sequence: Synthetic oligonucleotide
guuucugagggucugcgu

SEQ ID NO: 132090 - RNA, 18 nt, Artificial Sequence
  Description of Artificial Sequence: Synthetic oligonucleotide
gacuuguuucugaggguc

SEQ ID NO: 132091 - RNA, 18 nt, Artificial Sequence
  Description of Artificial Sequence: Synthetic oligonucleotide
ucacagacuuguuucuga

SEQ ID NO: 132092 - RNA, 18 nt, Artificial Sequence
  Description of Artificial Sequence: Synthetic oligonucleotide
ugacuucacagacuuguu

SEQ ID NO: 132093 - RNA, 18 nt, Artificial Sequence
  Description of Artificial Sequence: Synthetic oligonucleotide
gguugugacuucacagac

SEQ ID NO: 132094 - RNA, 18 nt, Artificial Sequence
  Description of Artificial Sequence: Synthetic oligonucleotide
gggcugguugugacuuca

SEQ ID NO: 132095 - RNA, 18 nt, Artificial Sequence
  Description of Artificial Sequence: Synthetic oligonucleotide
ucacaucuguaaacuggg

SEQ ID NO: 132096 - RNA, 18 nt, Artificial Sequence
  Description of Artificial Sequence: Synthetic oligonucleotide
aguuucacaucuguaaac

SEQ ID NO: 132097 - RNA, 18 nt, Artificial Sequence
  Description of Artificial Sequence: Synthetic oligonucleotide
gcuucaguuucacaucug

SEQ ID NO: 132098 - RNA, 18 nt, Artificial Sequence
  Description of Artificial Sequence: Synthetic oligonucleotide
uuggagcuucaguuucac

SEQ ID NO: 132099 - RNA, 18 nt, Artificial Sequence
  Description of Artificial Sequence: Synthetic oligonucleotide
acuuuuuggagcuucagu

SEQ ID NO: 132100 - RNA, 18 nt, Artificial Sequence
  Description of Artificial Sequence: Synthetic oligonucleotide
uccugacuuuuuggagcu

SEQ ID NO: 132101 - RNA, 18 nt, Artificial Sequence
  Description of Artificial Sequence: Synthetic oligonucleotide
ugaccuccugacuuuuug

SEQ ID NO: 132102 - RNA, 18 nt, Artificial Sequence
  Description of Artificial Sequence: Synthetic oligonucleotide
cucagugaccuccugacu

SEQ ID NO: 132103 - RNA, 18 nt, Artificial Sequence
  Description of Artificial Sequence: Synthetic oligonucleotide
ccccacucagugaccucc

SEQ ID NO: 132104 - RNA, 18 nt, Artificial Sequence
  Description of Artificial Sequence: Synthetic oligonucleotide
caccuccccacucaguga

SEQ ID NO: 132105 - RNA, 18 nt, Artificial Sequence
  Description of Artificial Sequence: Synthetic oligonucleotide
uccaucaccuccccacuc

SEQ ID NO: 132106 - RNA, 18 nt, Artificial Sequence
  Description of Artificial Sequence: Synthetic oligonucleotide
cccacuccaucaccuccc

SEQ ID NO: 132107 - RNA, 18 nt, Artificial Sequence
  Description of Artificial Sequence: Synthetic oligonucleotide
cuguucccacuccaucac

SEQ ID NO: 132108 - RNA, 18 nt, Artificial Sequence
  Description of Artificial Sequence: Synthetic oligonucleotide
gccucagccagaucuggg

SEQ ID NO: 132109 - RNA, 18 nt, Artificial Sequence
  Description of Artificial Sequence: Synthetic oligonucleotide
cuucggccucagccagau

SEQ ID NO: 132110 - RNA, 18 nt, Artificial Sequence
  Description of Artificial Sequence: Synthetic oligonucleotide
cagggcuucggccucagc

SEQ ID NO: 132111 - RNA, 18 nt, Artificial Sequence
  Description of Artificial Sequence: Synthetic oligonucleotide
cucuccagggcuucggcc

SEQ ID NO: 132112 - RNA, 18 nt, Artificial Sequence
  Description of Artificial Sequence: Synthetic oligonucleotide
gggaucucuccagggcuu

SEQ ID NO: 132113 - RNA, 18 nt, Artificial Sequence
  Description of Artificial Sequence: Synthetic oligonucleotide
cuaagggagccuugcggg

SEQ ID NO: 132114 - RNA, 18 nt, Artificial Sequence
  Description of Artificial Sequence: Synthetic oligonucleotide
caucuaagggagccuugc

SEQ ID NO: 132115 - RNA, 18 nt, Artificial Sequence
  Description of Artificial Sequence: Synthetic oligonucleotide
ucaggcaucuaagggagc

SEQ ID NO: 132116 - RNA, 18 nt, Artificial Sequence
  Description of Artificial Sequence: Synthetic oligonucleotide
gaaugucaggcaucuaag

SEQ ID NO: 132117 - RNA, 18 nt, Artificial Sequence
  Description of Artificial Sequence: Synthetic oligonucleotide
gaacagaaugucaggcau

SEQ ID NO: 132118 - RNA, 18 nt, Artificial Sequence
  Description of Artificial Sequence: Synthetic oligonucleotide
aggaagaacagaauguca

SEQ ID NO: 132119 - RNA, 18 nt, Artificial Sequence
  Description of Artificial Sequence: Synthetic oligonucleotide
gcuucaggaagaacagaa

SEQ ID NO: 132120 - RNA, 18 nt, Artificial Sequence
  Description of Artificial Sequence: Synthetic oligonucleotide
gugaggcuucaggaagaa

SEQ ID NO: 132121 - RNA, 18 nt, Artificial Sequence
  Description of Artificial Sequence: Synthetic oligonucleotide
agggagugaggcuucagg

SEQ ID NO: 132122 - RNA, 18 nt, Artificial Sequence
  Description of Artificial Sequence: Synthetic oligonucleotide
gagguuggugccuucuga

SEQ ID NO: 132123 - RNA, 18 nt, Artificial Sequence
  Description of Artificial Sequence: Synthetic oligonucleotide
gcguugagguuggugccu

SEQ ID NO: 132124 - RNA, 18 nt, Artificial Sequence
  Description of Artificial Sequence: Synthetic oligonucleotide
ugggcgcguugagguugg

SEQ ID NO: 132125 - RNA, 18 nt, Artificial Sequence
  Description of Artificial Sequence: Synthetic oligonucleotide
gcuguugggcgcguugag

SEQ ID NO: 132126 - RNA, 18 nt, Artificial Sequence
  Description of Artificial Sequence: Synthetic oligonucleotide
cccaggcuguugggcgcg

SEQ ID NO: 132127 - RNA, 18 nt, Artificial Sequence
  Description of Artificial Sequence: Synthetic oligonucleotide
ugacacccaggcuguugg

SEQ ID NO: 132128 - RNA, 18 nt, Artificial Sequence
  Description of Artificial Sequence: Synthetic oligonucleotide
ggcgcugacacccaggcu

SEQ ID NO: 132129 - RNA, 18 nt, Artificial Sequence
  Description of Artificial Sequence: Synthetic oligonucleotide
cacagggcgcugacaccc

SEQ ID NO: 132130 - RNA, 18 nt, Artificial Sequence
  Description of Artificial Sequence: Synthetic oligonucleotide
uggcacacagggcgcuga

SEQ ID NO: 132131 - RNA, 18 nt, Artificial Sequence
  Description of Artificial Sequence: Synthetic oligonucleotide
gcagauggcacacagggc

SEQ ID NO: 132132 - RNA, 18 nt, Artificial Sequence
  Description of Artificial Sequence: Synthetic oligonucleotide
uccccgcagauggcacac

SEQ ID NO: 132133 - RNA, 18 nt, Artificial Sequence
  Description of Artificial Sequence: Synthetic oligonucleotide
cccgguccccgcagaugg

SEQ ID NO: 132134 - RNA, 18 nt, Artificial Sequence
  Description of Artificial Sequence: Synthetic oligonucleotide
cguggcccgguccccgca

SEQ ID NO: 132135 - RNA, 18 nt, Artificial Sequence
  Description of Artificial Sequence: Synthetic oligonucleotide
uugcccguggcccggucc

SEQ ID NO: 132136 - RNA, 18 nt, Artificial Sequence
  Description of Artificial Sequence: Synthetic oligonucleotide
aguguuugcccguggccc

SEQ ID NO: 132137 - RNA, 18 nt, Artificial Sequence
  Description of Artificial Sequence: Synthetic oligonucleotide
accguaguguuugcccgu

SEQ ID NO: 132138 - RNA, 18 nt, Artificial Sequence
  Description of Artificial Sequence: Synthetic oligonucleotide
gaggcaccguaguguuug

SEQ ID NO: 132139 - RNA, 18 nt, Artificial Sequence
  Description of Artificial Sequence: Synthetic oligonucleotide
agcucgaggcaccguagu

SEQ ID NO: 132140 - RNA, 18 nt, Artificial Sequence
  Description of Artificial Sequence: Synthetic oligonucleotide
gucacagcucgaggcacc

SEQ ID NO: 132141 - RNA, 18 nt, Artificial Sequence
  Description of Artificial Sequence: Synthetic oligonucleotide
cagccgucacagcucgag

SEQ ID NO: 132142 - RNA, 18 nt, Artificial Sequence
  Description of Artificial Sequence: Synthetic oligonucleotide
ccuugcagccgucacagc

SEQ ID NO: 132143 - RNA, 18 nt, Artificial Sequence
  Description of Artificial Sequence: Synthetic oligonucleotide
gaagcccuugcagccguc

SEQ ID NO: 132144 - RNA, 18 nt, Artificial Sequence
  Description of Artificial Sequence: Synthetic oligonucleotide
cggaagaagcccuugcag

SEQ ID NO: 132145 - RNA, 18 nt, Artificial Sequence
  Description of Artificial Sequence: Synthetic oligonucleotide
uccuccggaagaagcccu

SEQ ID NO: 132146 - RNA, 18 nt, Artificial Sequence
  Description of Artificial Sequence: Synthetic oligonucleotide
cacgcuccuccggaagaa

SEQ ID NO: 132147 - RNA, 18 nt, Artificial Sequence
  Description of Artificial Sequence: Synthetic oligonucleotide
uuccgcacgcuccuccgg

SEQ ID NO: 132148 - RNA, 18 nt, Artificial Sequence
  Description of Artificial Sequence: Synthetic oligonucleotide
gguucuuccgcacgcucc

SEQ ID NO: 132149 - RNA, 18 nt, Artificial Sequence
  Description of Artificial Sequence: Synthetic oligonucleotide
caugugguucuuccgcac

SEQ ID NO: 132150 - RNA, 18 nt, Artificial Sequence
  Description of Artificial Sequence: Synthetic oligonucleotide
gaguacaugugguucuuc

SEQ ID NO: 132151 - RNA, 18 nt, Artificial Sequence
  Description of Artificial Sequence: Synthetic oligonucleotide
ugcaggaguacauguggu

SEQ ID NO: 132152 - RNA, 18 nt, Artificial Sequence
  Description of Artificial Sequence: Synthetic oligonucleotide
uuggugccuucugauggg

SEQ ID NO: 132153 - RNA, 18 nt, Artificial Sequence
  Description of Artificial Sequence: Synthetic oligonucleotide
gguuggugccuucugaug

SEQ ID NO: 132154 - RNA, 18 nt, Artificial Sequence
  Description of Artificial Sequence: Synthetic oligonucleotide
guugagguuggugccuuc

SEQ ID NO: 132155 - RNA, 18 nt, Artificial Sequence
  Description of Artificial Sequence: Synthetic oligonucleotide
ggcgcguugagguuggug

SEQ ID NO: 132156 - RNA, 18 nt, Artificial Sequence
  Description of Artificial Sequence: Synthetic oligonucleotide
uguugggcgcguugaggu

SEQ ID NO: 132157 - RNA, 18 nt, Artificial Sequence
  Description of Artificial Sequence: Synthetic oligonucleotide
caggcuguugggcgcguu

SEQ ID NO: 132158 - RNA, 18 nt, Artificial Sequence
  Description of Artificial Sequence: Synthetic oligonucleotide
acacccaggcuguugggc

SEQ ID NO: 132159 - RNA, 18 nt, Artificial Sequence
  Description of Artificial Sequence: Synthetic oligonucleotide
cgcugacacccaggcugu

SEQ ID NO: 132160 - RNA, 18 nt, Artificial Sequence
  Description of Artificial Sequence: Synthetic oligonucleotide
cagggcgcugacacccag

SEQ ID NO: 132161 - RNA, 18 nt, Artificial Sequence
  Description of Artificial Sequence: Synthetic oligonucleotide
gcacacagggcgcugaca

SEQ ID NO: 132162 - RNA, 18 nt, Artificial Sequence
  Description of Artificial Sequence: Synthetic oligonucleotide
agauggcacacagggcgc

SEQ ID NO: 132163 - RNA, 18 nt, Artificial Sequence
  Description of Artificial Sequence: Synthetic oligonucleotide
cccgcagauggcacacag

SEQ ID NO: 132164 - RNA, 18 nt, Artificial Sequence
  Description of Artificial Sequence: Synthetic oligonucleotide
cgguccccgcagauggca

SEQ ID NO: 132165 - RNA, 18 nt, Artificial Sequence
  Description of Artificial Sequence: Synthetic oligonucleotide
uggcccgguccccgcaga

SEQ ID NO: 132166 - RNA, 18 nt, Artificial Sequence
  Description of Artificial Sequence: Synthetic oligonucleotide
gcccguggcccggucccc

SEQ ID NO: 132167 - RNA, 18 nt, Artificial Sequence
  Description of Artificial Sequence: Synthetic oligonucleotide
uguuugcccguggcccgg

SEQ ID NO: 132168 - RNA, 18 nt, Artificial Sequence
  Description of Artificial Sequence: Synthetic oligonucleotide
cguaguguuugcccgugg

SEQ ID NO: 132169 - RNA, 18 nt, Artificial Sequence
  Description of Artificial Sequence: Synthetic oligonucleotide
ggcaccguaguguuugcc

SEQ ID NO: 132170 - RNA, 18 nt, Artificial Sequence
  Description of Artificial Sequence: Synthetic oligonucleotide
cucgaggcaccguagugu

SEQ ID NO: 132171 - RNA, 18 nt, Artificial Sequence
  Description of Artificial Sequence: Synthetic oligonucleotide
cacagcucgaggcaccgu

SEQ ID NO: 132172 - RNA, 18 nt, Artificial Sequence
  Description of Artificial Sequence: Synthetic oligonucleotide
gccgucacagcucgaggc

SEQ ID NO: 132173 - RNA, 18 nt, Artificial Sequence
  Description of Artificial Sequence: Synthetic oligonucleotide
uugcagccgucacagcuc

SEQ ID NO: 132174 - RNA, 18 nt, Artificial Sequence
  Description of Artificial Sequence: Synthetic oligonucleotide
agcccuugcagccgucac

SEQ ID NO: 132175 - RNA, 18 nt, Artificial Sequence
  Description of Artificial Sequence: Synthetic oligonucleotide
gaagaagcccuugcagcc

SEQ ID NO: 132176 - RNA, 18 nt, Artificial Sequence
  Description of Artificial Sequence: Synthetic oligonucleotide
cuccggaagaagcccuug

SEQ ID NO: 132177 - RNA, 18 nt, Artificial Sequence
  Description of Artificial Sequence: Synthetic oligonucleotide
cgcuccuccggaagaagc

SEQ ID NO: 132178 - RNA, 18 nt, Artificial Sequence
  Description of Artificial Sequence: Synthetic oligonucleotide
ccgcacgcuccuccggaa

SEQ ID NO: 132179 - RNA, 18 nt, Artificial Sequence
  Description of Artificial Sequence: Synthetic oligonucleotide
uucuuccgcacgcuccuc

SEQ ID NO: 132180 - RNA, 18 nt, Artificial Sequence
  Description of Artificial Sequence: Synthetic oligonucleotide
ugugguucuuccgcacgc

SEQ ID NO: 132181 - RNA, 18 nt, Artificial Sequence
  Description of Artificial Sequence: Synthetic oligonucleotide
guacaugugguucuuccg

SEQ ID NO: 132182 - RNA, 18 nt, Artificial Sequence
  Description of Artificial Sequence: Synthetic oligonucleotide
caggaguacaugugguuc

SEQ ID NO: 132183 - RNA, 18 nt, Artificial Sequence
  Description of Artificial Sequence: Synthetic oligonucleotide
cugaagaaauugaggcuc

SEQ ID NO: 132184 - RNA, 18 nt, Artificial Sequence
  Description of Artificial Sequence: Synthetic oligonucleotide
cccagcugaagaaauuga

SEQ ID NO: 132185 - RNA, 18 nt, Artificial Sequence
  Description of Artificial Sequence: Synthetic oligonucleotide
cauuucccagcugaagaa

SEQ ID NO: 132186 - RNA, 18 nt, Artificial Sequence
  Description of Artificial Sequence: Synthetic oligonucleotide
gugcccauuucccagcug

SEQ ID NO: 132187 - RNA, 18 nt, Artificial Sequence
  Description of Artificial Sequence: Synthetic oligonucleotide
caagugugcccauuuccc

SEQ ID NO: 132188 - RNA, 18 nt, Artificial Sequence
  Description of Artificial Sequence: Synthetic oligonucleotide
gagcccaagugugcccau

SEQ ID NO: 132189 - RNA, 18 nt, Artificial Sequence
  Description of Artificial Sequence: Synthetic oligonucleotide
gccaugagcccaagugug

SEQ ID NO: 132190 - RNA, 18 nt, Artificial Sequence
  Description of Artificial Sequence: Synthetic oligonucleotide
gggccaugagcccaagug

SEQ ID NO: 132191 - RNA, 18 nt, Artificial Sequence
  Description of Artificial Sequence: Synthetic oligonucleotide
gagaagacagaccuuggg

SEQ ID NO: 132192 - RNA, 18 nt, Artificial Sequence
  Description of Artificial Sequence: Synthetic oligonucleotide
ucagggagaagacagacc

SEQ ID NO: 132193 - RNA, 18 nt, Artificial Sequence
  Description of Artificial Sequence: Synthetic oligonucleotide
cccacucagggagaagac

SEQ ID NO: 132194 - RNA, 18 nt, Artificial Sequence
  Description of Artificial Sequence: Synthetic oligonucleotide
accuacccacucagggag

SEQ ID NO: 132195 - RNA, 18 nt, Artificial Sequence
  Description of Artificial Sequence: Synthetic oligonucleotide
cugggaccuacccacuca

SEQ ID NO: 132196 - RNA, 18 nt, Artificial Sequence
  Description of Artificial Sequence: Synthetic oligonucleotide
ugucucugggaccuaccc

SEQ ID NO: 132197 - RNA, 18 nt, Artificial Sequence
  Description of Artificial Sequence: Synthetic oligonucleotide
gcagcugucucugggacc

SEQ ID NO: 132198 - RNA, 18 nt, Artificial Sequence
  Description of Artificial Sequence: Synthetic oligonucleotide
gaagggcagcugucucug

SEQ ID NO: 132199 - RNA, 18 nt, Artificial Sequence
  Description of Artificial Sequence: Synthetic oligonucleotide
gcccugaagggcagcugu

SEQ ID NO: 132200 - RNA, 18 nt, Artificial Sequence
  Description of Artificial Sequence: Synthetic oligonucleotide
ugaaggcccugaagggca

SEQ ID NO: 132201 - RNA, 18 nt, Artificial Sequence
  Description of Artificial Sequence: Synthetic oligonucleotide
agccuugaaggcccugaa

SEQ ID NO: 132202 - RNA, 18 nt, Artificial Sequence
  Description of Artificial Sequence: Synthetic oligonucleotide
agaagagccuugaaggcc

SEQ ID NO: 132203 - RNA, 18 nt, Artificial Sequence
  Description of Artificial Sequence: Synthetic oligonucleotide
aaaccagaagagccuuga

SEQ ID NO: 132204 - RNA, 18 nt, Artificial Sequence
  Description of Artificial Sequence: Synthetic oligonucleotide
uuacaaaaccagaagagc

SEQ ID NO: 132205 - RNA, 18 nt, Artificial Sequence
  Description of Artificial Sequence: Synthetic oligonucleotide
gucuuuuacaaaaccaga

SEQ ID NO: 132206 - RNA, 18 nt, Artificial Sequence
  Description of Artificial Sequence: Synthetic oligonucleotide
acaaagucuuuuacaaaa

SEQ ID NO: 132207 - RNA, 18 nt, Artificial Sequence
  Description of Artificial Sequence: Synthetic oligonucleotide
gauucacaaagucuuuua

SEQ ID NO: 132208 - RNA, 18 nt, Artificial Sequence
  Description of Artificial Sequence: Synthetic oligonucleotide
ucuuggauucacaaaguc

SEQ ID NO: 132209 - RNA, 18 nt, Artificial Sequence
  Description of Artificial Sequence: Synthetic oligonucleotide
gcucuucuuggauucaca

SEQ ID NO: 132210 - RNA, 18 nt, Artificial Sequence
  Description of Artificial Sequence: Synthetic oligonucleotide
uagaugcucuucuuggau

SEQ ID NO: 132211 - RNA, 18 nt, Artificial Sequence
  Description of Artificial Sequence: Synthetic oligonucleotide
uagaauagaugcucuucu

SEQ ID NO: 132212 - RNA, 18 nt, Artificial Sequence
  Description of Artificial Sequence: Synthetic oligonucleotide
guuccuagaauagaugcu

SEQ ID NO: 132213 - RNA, 18 nt, Artificial Sequence
  Description of Artificial Sequence: Synthetic oligonucleotide
augugguuccuagaauag

SEQ ID NO: 132214 - RNA, 18 nt, Artificial Sequence
  Description of Artificial Sequence: Synthetic oligonucleotide
aguaaaugugguuccuag

SEQ ID NO: 132215 - RNA, 18 nt, Artificial Sequence
  Description of Artificial Sequence: Synthetic oligonucleotide
ugaucaguaaaugugguu

SEQ ID NO: 132216 - RNA, 18 nt, Artificial Sequence
  Description of Artificial Sequence: Synthetic oligonucleotide
cuugaugaucaguaaaug

SEQ ID NO: 132217 - RNA, 18 nt, Artificial Sequence
  Description of Artificial Sequence: Synthetic oligonucleotide
aguagcuugaugaucagu

SEQ ID NO: 132218 - RNA, 18 nt, Artificial Sequence
  Description of Artificial Sequence: Synthetic oligonucleotide
cagccaguagcuugauga

SEQ ID NO: 132219 - RNA, 18 nt, Artificial Sequence
  Description of Artificial Sequence: Synthetic oligonucleotide
aacggcagccaguagcuu

SEQ ID NO: 132220 - RNA, 18 nt, Artificial Sequence
  Description of Artificial Sequence: Synthetic oligonucleotide
caauaaacggcagccagu

SEQ ID NO: 132221 - RNA, 18 nt, Artificial Sequence
  Description of Artificial Sequence: Synthetic oligonucleotide
gagcucaauaaacggcag

SEQ ID NO: 132222 - RNA, 18 nt, Artificial Sequence
  Description of Artificial Sequence: Synthetic oligonucleotide
gauaagagcucaauaaac

SEQ ID NO: 132223 - RNA, 18 nt, Artificial Sequence
  Description of Artificial Sequence: Synthetic oligonucleotide
cauaugauaagagcucaa

SEQ ID NO: 132224 - RNA, 18 nt, Artificial Sequence
  Description of Artificial Sequence: Synthetic oligonucleotide
ccuggcauaugauaagag

SEQ ID NO: 132225 - RNA, 18 nt, Artificial Sequence
  Description of Artificial Sequence: Synthetic oligonucleotide
uugugccuggcauaugau

SEQ ID NO: 132226 - RNA, 18 nt, Artificial Sequence
  Description of Artificial Sequence: Synthetic oligonucleotide
uaguauugugccuggcau

SEQ ID NO: 132227 - RNA, 18 nt, Artificial Sequence
  Description of Artificial Sequence: Synthetic oligonucleotide
agacuuaguauugugccu

SEQ ID NO: 132228 - RNA, 18 nt, Artificial Sequence
  Description of Artificial Sequence: Synthetic oligonucleotide
cacaaagacuuaguauug

SEQ ID NO: 132229 - RNA, 18 nt, Artificial Sequence
  Description of Artificial Sequence: Synthetic oligonucleotide
auacacacaaagacuuag

SEQ ID NO: 132230 - RNA, 18 nt, Artificial Sequence
  Description of Artificial Sequence: Synthetic oligonucleotide
gguaaauacacacaaaga

SEQ ID NO: 132231 - RNA, 18 nt, Artificial Sequence
  Description of Artificial Sequence: Synthetic oligonucleotide
ggauggguaaauacacac

SEQ ID NO: 132232 - RNA, 18 nt, Artificial Sequence
  Description of Artificial Sequence: Synthetic oligonucleotide
gggauggguaaauacaca

SEQ ID NO: 132233 - RNA, 18 nt, Artificial Sequence
  Description of Artificial Sequence: Synthetic oligonucleotide
caacaaugggcucaaggg

SEQ ID NO: 132234 - RNA, 18 nt, Artificial Sequence
  Description of Artificial Sequence: Synthetic oligonucleotide
aaaaacaacaaugggcuc

SEQ ID NO: 132235 - RNA, 18 nt, Artificial Sequence
  Description of Artificial Sequence: Synthetic oligonucleotide
augggaaaaacaacaaug

SEQ ID NO: 132236 - RNA, 18 nt, Artificial Sequence
  Description of Artificial Sequence: Synthetic oligonucleotide
auggaaugggaaaaacaa

SEQ ID NO: 132237 - RNA, 18 nt, Artificial Sequence
  Description of Artificial Sequence: Synthetic oligonucleotide
gccccauggaaugggaaa

SEQ ID NO: 132238 - RNA, 18 nt, Artificial Sequence
  Description of Artificial Sequence: Synthetic oligonucleotide
gagaggccccauggaaug

SEQ ID NO: 132239 - RNA, 18 nt, Artificial Sequence
  Description of Artificial Sequence: Synthetic oligonucleotide
uucaggagaggccccaug

SEQ ID NO: 132240 - RNA, 18 nt, Artificial Sequence
  Description of Artificial Sequence: Synthetic oligonucleotide
gaggcuucaggagaggcc

SEQ ID NO: 132241 - RNA, 18 nt, Artificial Sequence
  Description of Artificial Sequence: Synthetic oligonucleotide
cuacugaggcuucaggag

SEQ ID NO: 132242 - RNA, 18 nt, Artificial Sequence
  Description of Artificial Sequence: Synthetic oligonucleotide
cucaucuacugaggcuuc

SEQ ID NO: 132243 - RNA, 18 nt, Artificial Sequence
  Description of Artificial Sequence: Synthetic oligonucleotide
acgggcucaucuacugag

SEQ ID NO: 132244 - RNA, 18 nt, Artificial Sequence
  Description of Artificial Sequence: Synthetic oligonucleotide
ggaagacgggcucaucua

SEQ ID NO: 132245 - RNA, 18 nt, Artificial Sequence
  Description of Artificial Sequence: Synthetic oligonucleotide
agacuggaagacgggcuc

SEQ ID NO: 132246 - RNA, 18 nt, Artificial Sequence
  Description of Artificial Sequence: Synthetic oligonucleotide
gcaccagacuggaagacg

SEQ ID NO: 132247 - RNA, 18 nt, Artificial Sequence
  Description of Artificial Sequence: Synthetic oligonucleotide
aaacagcaccagacugga

SEQ ID NO: 132248 - RNA, 18 nt, Artificial Sequence
  Description of Artificial Sequence: Synthetic oligonucleotide
cccaaaaacagcaccaga

SEQ ID NO: 132249 - RNA, 18 nt, Artificial Sequence
  Description of Artificial Sequence: Synthetic oligonucleotide
uuugucccaaaaacagca

SEQ ID NO: 132250 - RNA, 18 nt, Artificial Sequence
  Description of Artificial Sequence: Synthetic oligonucleotide
uccuauuugucccaaaaa

SEQ ID NO: 132251 - RNA, 18 nt, Artificial Sequence
  Description of Artificial Sequence: Synthetic oligonucleotide
caaucuccuauuuguccc

SEQ ID NO: 132252 - RNA, 18 nt, Artificial Sequence
  Description of Artificial Sequence: Synthetic oligonucleotide
gggucaaucuccuauuug

SEQ ID NO: 132253 - RNA, 18 nt, Artificial Sequence
  Description of Artificial Sequence: Synthetic oligonucleotide
uagguggaacggccuggg

SEQ ID NO: 132254 - RNA, 18 nt, Artificial Sequence
  Description of Artificial Sequence: Synthetic oligonucleotide
ggguagguggaacggccu

SEQ ID NO: 132255 - RNA, 18 nt, Artificial Sequence
  Description of Artificial Sequence: Synthetic oligonucleotide
uugguggaagccccuggg

SEQ ID NO: 132256 - RNA, 18 nt, Artificial Sequence
  Description of Artificial Sequence: Synthetic oligonucleotide
ggguugguggaagccccu

SEQ ID NO: 132257 - RNA, 18 nt, Artificial Sequence
  Description of Artificial Sequence: Synthetic oligonucleotide
ccuugggaagacuuuggg

SEQ ID NO: 132258 - RNA, 18 nt, Artificial Sequence
  Description of Artificial Sequence: Synthetic oligonucleotide
caaggccuugggaagacu

SEQ ID NO: 132259 - RNA, 18 nt, Artificial Sequence
  Description of Artificial Sequence: Synthetic oligonucleotide
cucuccaaggccuuggga

SEQ ID NO: 132260 - RNA, 18 nt, Artificial Sequence
  Description of Artificial Sequence: Synthetic oligonucleotide
gagggcucuccaaggccu

SEQ ID NO: 132261 - RNA, 18 nt, Artificial Sequence
  Description of Artificial Sequence: Synthetic oligonucleotide
cgaaagagggcucuccaa

SEQ ID NO: 132262 - RNA, 18 nt, Artificial Sequence
  Description of Artificial Sequence: Synthetic oligonucleotide
gcuuucgaaagagggcuc

SEQ ID NO: 132263 - RNA, 18 nt, Artificial Sequence
  Description of Artificial Sequence: Synthetic oligonucleotide
gagaugcuuucgaaagag

SEQ ID NO: 132264 - RNA, 18 nt, Artificial Sequence
  Description of Artificial Sequence: Synthetic oligonucleotide
aacaggagaugcuuucga

SEQ ID NO: 132265 - RNA, 18 nt, Artificial Sequence
  Description of Artificial Sequence: Synthetic oligonucleotide
cccagaacaggagaugcu

SEQ ID NO: 132266 - RNA, 18 nt, Artificial Sequence
  Description of Artificial Sequence: Synthetic oligonucleotide
cauuacccagaacaggag

SEQ ID NO: 132267 - RNA, 18 nt, Artificial Sequence
  Description of Artificial Sequence: Synthetic oligonucleotide
auugucauuacccagaac

SEQ ID NO: 132268 - RNA, 18 nt, Artificial Sequence
  Description of Artificial Sequence: Synthetic oligonucleotide
uuauuauugucauuaccc

SEQ ID NO: 132269 - RNA, 18 nt, Artificial Sequence
  Description of Artificial Sequence: Synthetic oligonucleotide
ugauuuuauuauugucau

SEQ ID NO: 132270 - RNA, 18 nt, Artificial Sequence
  Description of Artificial Sequence: Synthetic oligonucleotide
ugcuaugauuuuauuauu

SEQ ID NO: 132271 - RNA, 18 nt, Artificial Sequence
  Description of Artificial Sequence: Synthetic oligonucleotide
acagcugcuaugauuuua

SEQ ID NO: 132272 - RNA, 18 nt, Artificial Sequence
  Description of Artificial Sequence: Synthetic oligonucleotide
aauugacagcugcuauga

SEQ ID NO: 132273 - RNA, 18 nt, Artificial Sequence
  Description of Artificial Sequence: Synthetic oligonucleotide
cucgcaauugacagcugc

SEQ ID NO: 132274 - RNA, 18 nt, Artificial Sequence
  Description of Artificial Sequence: Synthetic oligonucleotide
caaaugccuagcccucca

SEQ ID NO: 132275 - RNA, 18 nt, Artificial Sequence
  Description of Artificial Sequence: Synthetic oligonucleotide
uugggcaaaugccuagcc

SEQ ID NO: 132276 - RNA, 18 nt, Artificial Sequence
  Description of Artificial Sequence: Synthetic oligonucleotide
ugaccuugggcaaaugcc

SEQ ID NO: 132277 - RNA, 18 nt, Artificial Sequence
  Description of Artificial Sequence: Synthetic oligonucleotide
cugguugaccuugggcaa

SEQ ID NO: 132278 - RNA, 18 nt, Artificial Sequence
  Description of Artificial Sequence: Synthetic oligonucleotide
ucaagcugguugaccuug

SEQ ID NO: 132279 - RNA, 18 nt, Artificial Sequence
  Description of Artificial Sequence: Synthetic oligonucleotide
gugauucaagcugguuga

SEQ ID NO: 132280 - RNA, 18 nt, Artificial Sequence
  Description of Artificial Sequence: Synthetic oligonucleotide
ugccagugauucaagcug

SEQ ID NO: 132281 - RNA, 18 nt, Artificial Sequence
  Description of Artificial Sequence: Synthetic oligonucleotide
ggcucugccagugauuca

SEQ ID NO: 132282 - RNA, 18 nt, Artificial Sequence
  Description of Artificial Sequence: Synthetic oligonucleotide
acccuggcucugccagug

SEQ ID NO: 132283 - RNA, 18 nt, Artificial Sequence
  Description of Artificial Sequence: Synthetic oligonucleotide
uguuaacccuggcucugc

SEQ ID NO: 132284 - RNA, 18 nt, Artificial Sequence
  Description of Artificial Sequence: Synthetic oligonucleotide
cugaauguuaacccuggc

SEQ ID NO: 132285 - RNA, 18 nt, Artificial Sequence
  Description of Artificial Sequence: Synthetic oligonucleotide
gggcccugaauguuaacc

SEQ ID NO: 132286 - RNA, 18 nt, Artificial Sequence
  Description of Artificial Sequence: Synthetic oligonucleotide
accguggugauggguggg

SEQ ID NO: 132287 - RNA, 18 nt, Artificial Sequence
  Description of Artificial Sequence: Synthetic oligonucleotide
caccguggugaugggugg

SEQ ID NO: 132288 - RNA, 18 nt, Artificial Sequence
  Description of Artificial Sequence: Synthetic oligonucleotide
ugccacaccguggugaug

SEQ ID NO: 132289 - RNA, 18 nt, Artificial Sequence
  Description of Artificial Sequence: Synthetic oligonucleotide
ggcagugccacaccgugg

SEQ ID NO: 132290 - RNA, 18 nt, Artificial Sequence
  Description of Artificial Sequence: Synthetic oligonucleotide
guagaggcagugccacac

SEQ ID NO: 132291 - RNA, 18 nt, Artificial Sequence
  Description of Artificial Sequence: Synthetic oligonucleotide
aggaaguagaggcagugc

SEQ ID NO: 132292 - RNA, 18 nt, Artificial Sequence
  Description of Artificial Sequence: Synthetic oligonucleotide
gggauaggaaguagaggc

SEQ ID NO: 132293 - RNA, 18 nt, Artificial Sequence
  Description of Artificial Sequence: Synthetic oligonucleotide
aagccucucucuggaggg

SEQ ID NO: 132294 - RNA, 18 nt, Artificial Sequence
  Description of Artificial Sequence: Synthetic oligonucleotide
cauaagccucucucugga

SEQ ID NO: 132295 - RNA, 18 nt, Artificial Sequence
  Description of Artificial Sequence: Synthetic oligonucleotide
guucacauaagccucucu

SEQ ID NO: 132296 - RNA, 18 nt, Artificial Sequence
  Description of Artificial Sequence: Synthetic oligonucleotide
acucgguucacauaagcc

SEQ ID NO: 132297 - RNA, 18 nt, Artificial Sequence
  Description of Artificial Sequence: Synthetic oligonucleotide
uuaauacucgguucacau

SEQ ID NO: 132298 - RNA, 18 nt, Artificial Sequence
  Description of Artificial Sequence: Synthetic oligonucleotide
cagaguuaauacucgguu

SEQ ID NO: 132299 - RNA, 18 nt, Artificial Sequence
  Description of Artificial Sequence: Synthetic oligonucleotide
uggcucagaguuaauacu

SEQ ID NO: 132300 - RNA, 18 nt, Artificial Sequence
  Description of Artificial Sequence: Synthetic oligonucleotide
gguuauggcucagaguua

SEQ ID NO: 132301 - RNA, 18 nt, Artificial Sequence
  Description of Artificial Sequence: Synthetic oligonucleotide
cuccugguuauggcucag

SEQ ID NO: 132302 - RNA, 18 nt, Artificial Sequence
  Description of Artificial Sequence: Synthetic oligonucleotide
gcaggcuccugguuaugg

SEQ ID NO: 132303 - RNA, 18 nt, Artificial Sequence
  Description of Artificial Sequence: Synthetic oligonucleotide
ccauagcaggcuccuggu

SEQ ID NO: 132304 - RNA, 18 nt, Artificial Sequence
  Description of Artificial Sequence: Synthetic oligonucleotide
agaacccauagcaggcuc

SEQ ID NO: 132305 - RNA, 18 nt, Artificial Sequence
  Description of Artificial Sequence: Synthetic oligonucleotide
agcucagaacccauagca

SEQ ID NO: 132306 - RNA, 18 nt, Artificial Sequence
  Description of Artificial Sequence: Synthetic oligonucleotide
auaaaagcucagaaccca

SEQ ID NO: 132307 - RNA, 18 nt, Artificial Sequence
  Description of Artificial Sequence: Synthetic oligonucleotide
auccuauaaaagcucaga

SEQ ID NO: 132308 - RNA, 18 nt, Artificial Sequence
  Description of Artificial Sequence: Synthetic oligonucleotide
accacauccuauaaaagc

SEQ ID NO: 132309 - RNA, 18 nt, Artificial Sequence
  Description of Artificial Sequence: Synthetic oligonucleotide
uuuccaccacauccuaua

SEQ ID NO: 132310 - RNA, 18 nt, Artificial Sequence
  Description of Artificial Sequence: Synthetic oligonucleotide
ugcuauuuccaccacauc

SEQ ID NO: 132311 - RNA, 18 nt, Artificial Sequence
  Description of Artificial Sequence: Synthetic oligonucleotide
agcccugcuauuuccacc

SEQ ID NO: 132312 - RNA, 18 nt, Artificial Sequence
  Description of Artificial Sequence: Synthetic oligonucleotide
accagagcccugcuauuu

SEQ ID NO: 132313 - RNA, 18 nt, Artificial Sequence
  Description of Artificial Sequence: Synthetic oligonucleotide
ggaguaccagagcccugc

SEQ ID NO: 132314 - RNA, 18 nt, Artificial Sequence
  Description of Artificial Sequence: Synthetic oligonucleotide
ccucuggaguaccagagc

SEQ ID NO: 132315 - RNA, 18 nt, Artificial Sequence
  Description of Artificial Sequence: Synthetic oligonucleotide
cuugaccucuggaguacc

SEQ ID NO: 132316 - RNA, 18 nt, Artificial Sequence
  Description of Artificial Sequence: Synthetic oligonucleotide
ggaaccuugaccucugga

SEQ ID NO: 132317 - RNA, 18 nt, Artificial Sequence
  Description of Artificial Sequence: Synthetic oligonucleotide
aguugggaaccuugaccu

SEQ ID NO: 132318 - RNA, 18 nt, Artificial Sequence
  Description of Artificial Sequence: Synthetic oligonucleotide
agcugaguugggaaccuu

SEQ ID NO: 132319 - RNA, 18 nt, Artificial Sequence
  Description of Artificial Sequence: Synthetic oligonucleotide
guuagagcugaguuggga

SEQ ID NO: 132320 - RNA, 18 nt, Artificial Sequence
  Description of Artificial Sequence: Synthetic oligonucleotide
uugguguuagagcugagu

SEQ ID NO: 132321 - RNA, 18 nt, Artificial Sequence
  Description of Artificial Sequence: Synthetic oligonucleotide
gcugguugguguuagagc

SEQ ID NO: 132322 - RNA, 18 nt, Artificial Sequence
  Description of Artificial Sequence: Synthetic oligonucleotide
gcucugcugguugguguu

SEQ ID NO: 132323 - RNA, 18 nt, Artificial Sequence
  Description of Artificial Sequence: Synthetic oligonucleotide
gggucgcucugcugguug

SEQ ID NO: 132324 - RNA, 18 nt, Artificial Sequence
  Description of Artificial Sequence: Synthetic oligonucleotide
guccugggucgcucugcu

SEQ ID NO: 132325 - RNA, 18 nt, Artificial Sequence
  Description of Artificial Sequence: Synthetic oligonucleotide
augugguccugggucgcu

SEQ ID NO: 132326 - RNA, 18 nt, Artificial Sequence
  Description of Artificial Sequence: Synthetic oligonucleotide
gcaacaugugguccuggg

SEQ ID NO: 132327 - RNA, 18 nt, Artificial Sequence
  Description of Artificial Sequence: Synthetic oligonucleotide
gagaggcaacaugugguc

SEQ ID NO: 132328 - RNA, 18 nt, Artificial Sequence
  Description of Artificial Sequence: Synthetic oligonucleotide
gcucagagaggcaacaug

SEQ ID NO: 132329 - RNA, 18 nt, Artificial Sequence
  Description of Artificial Sequence: Synthetic oligonucleotide
cugaggcucagagaggca

SEQ ID NO: 132330 - RNA, 18 nt, Artificial Sequence
  Description of Artificial Sequence: Synthetic oligonucleotide
gaaaacugaggcucagag

SEQ ID NO: 132331 - RNA, 18 nt, Artificial Sequence
  Description of Artificial Sequence: Synthetic oligonucleotide
caugggaaaacugaggcu

SEQ ID NO: 132332 - RNA, 18 nt, Artificial Sequence
  Description of Artificial Sequence: Synthetic oligonucleotide
cuaaacaugggaaaacug

SEQ ID NO: 132333 - RNA, 18 nt, Artificial Sequence
  Description of Artificial Sequence: Synthetic oligonucleotide
uccugcuaaacaugggaa

SEQ ID NO: 132334 - RNA, 18 nt, Artificial Sequence
  Description of Artificial Sequence: Synthetic oligonucleotide
uccuguccugcuaaacau

SEQ ID NO: 132335 - RNA, 18 nt, Artificial Sequence
  Description of Artificial Sequence: Synthetic oligonucleotide
cccaguccuguccugcua

SEQ ID NO: 132336 - RNA, 18 nt, Artificial Sequence
  Description of Artificial Sequence: Synthetic oligonucleotide
aagagcccaguccugucc

SEQ ID NO: 132337 - RNA, 18 nt, Artificial Sequence
  Description of Artificial Sequence: Synthetic oligonucleotide
ucucuaagagcccagucc

SEQ ID NO: 132338 - RNA, 18 nt, Artificial Sequence
  Description of Artificial Sequence: Synthetic oligonucleotide
ugaacucucuaagagccc

SEQ ID NO: 132339 - RNA, 18 nt, Artificial Sequence
  Description of Artificial Sequence: Synthetic oligonucleotide
ugcuaugaacucucuaag

SEQ ID NO: 132340 - RNA, 18 nt, Artificial Sequence
  Description of Artificial Sequence: Synthetic oligonucleotide
aaaggugcuaugaacucu

SEQ ID NO: 132341 - RNA, 18 nt, Artificial Sequence
  Description of Artificial Sequence: Synthetic oligonucleotide
gcuggaaaggugcuauga

SEQ ID NO: 132342 - RNA, 18 nt, Artificial Sequence
  Description of Artificial Sequence: Synthetic oligonucleotide
caggagcuggaaaggugc

SEQ ID NO: 132343 - RNA, 18 nt, Artificial Sequence
  Description of Artificial Sequence: Synthetic oligonucleotide
cccaccaggagcuggaaa

SEQ ID NO: 132344 - RNA, 18 nt, Artificial Sequence
  Description of Artificial Sequence: Synthetic oligonucleotide
uugaacccaccaggagcu

SEQ ID NO: 132345 - RNA, 18 nt, Artificial Sequence
  Description of Artificial Sequence: Synthetic oligonucleotide
cucucuugaacccaccag

SEQ ID NO: 132346 - RNA, 18 nt, Artificial Sequence
  Description of Artificial Sequence: Synthetic oligonucleotide
gaguucucucuugaaccc

SEQ ID NO: 132347 - RNA, 18 nt, Artificial Sequence
  Description of Artificial Sequence: Synthetic oligonucleotide
cccgggaguucucucuug

SEQ ID NO: 132348 - RNA, 18 nt, Artificial Sequence
  Description of Artificial Sequence: Synthetic oligonucleotide
uucaucccgggaguucuc

SEQ ID NO: 132349 - RNA, 18 nt, Artificial Sequence
  Description of Artificial Sequence: Synthetic oligonucleotide
aucucuucaucccgggag

SEQ ID NO: 132350 - RNA, 18 nt, Artificial Sequence
  Description of Artificial Sequence: Synthetic oligonucleotide
cucucaucucuucauccc

SEQ ID NO: 132351 - RNA, 18 nt, Artificial Sequence
  Description of Artificial Sequence: Synthetic oligonucleotide
cagugcucucaucucuuc

SEQ ID NO: 132352 - RNA, 18 nt, Artificial Sequence
  Description of Artificial Sequence: Synthetic oligonucleotide
aaccucagugcucucauc

SEQ ID NO: 132353 - RNA, 18 nt, Artificial Sequence
  Description of Artificial Sequence: Synthetic oligonucleotide
cccccaaccucagugcuc

SEQ ID NO: 132354 - RNA, 18 nt, Artificial Sequence
  Description of Artificial Sequence: Synthetic oligonucleotide
uugaccccccaaccucag

SEQ ID NO: 132355 - RNA, 18 nt, Artificial Sequence
  Description of Artificial Sequence: Synthetic oligonucleotide
uccaguugaccccccaac

SEQ ID NO: 132356 - RNA, 18 nt, Artificial Sequence
  Description of Artificial Sequence: Synthetic oligonucleotide
ggcuauccaguugacccc

SEQ ID NO: 132357 - RNA, 18 nt, Artificial Sequence
  Description of Artificial Sequence: Synthetic oligonucleotide
gcccuggcuauccaguug

SEQ ID NO: 132358 - RNA, 18 nt, Artificial Sequence
  Description of Artificial Sequence: Synthetic oligonucleotide
cuagggcccuggcuaucc

SEQ ID NO: 132359 - RNA, 18 nt, Artificial Sequence
  Description of Artificial Sequence: Synthetic oligonucleotide
cagaacuagggcccuggc

SEQ ID NO: 132360 - RNA, 18 nt, Artificial Sequence
  Description of Artificial Sequence: Synthetic oligonucleotide
uaggacagaacuagggcc

SEQ ID NO: 132361 - RNA, 18 nt, Artificial Sequence
  Description of Artificial Sequence: Synthetic oligonucleotide
ccucuuaggacagaacua

SEQ ID NO: 132362 - RNA, 18 nt, Artificial Sequence
  Description of Artificial Sequence: Synthetic oligonucleotide
uuccuccucuuaggacag

SEQ ID NO: 132363 - RNA, 18 nt, Artificial Sequence
  Description of Artificial Sequence: Synthetic oligonucleotide
acaacuuccuccucuuag

SEQ ID NO: 132364 - RNA, 18 nt, Artificial Sequence
  Description of Artificial Sequence: Synthetic oligonucleotide
aagacacaacuuccuccu

SEQ ID NO: 132365 - RNA, 18 nt, Artificial Sequence
  Description of Artificial Sequence: Synthetic oligonucleotide
uggagaagacacaacuuc

SEQ ID NO: 132366 - RNA, 18 nt, Artificial Sequence
  Description of Artificial Sequence: Synthetic oligonucleotide
uuggauggagaagacaca

SEQ ID NO: 132367 - RNA, 18 nt, Artificial Sequence
  Description of Artificial Sequence: Synthetic oligonucleotide
gaugguuggauggagaag

SEQ ID NO: 132368 - RNA, 18 nt, Artificial Sequence
  Description of Artificial Sequence: Synthetic oligonucleotide
cacgcacugccggcuaaa

SEQ ID NO: 132369 - RNA, 18 nt, Artificial Sequence
  Description of Artificial Sequence: Synthetic oligonucleotide
uccaccacgcacugccgg

SEQ ID NO: 132370 - RNA, 18 nt, Artificial Sequence
  Description of Artificial Sequence: Synthetic oligonucleotide
cuuuguccaccacgcacu

SEQ ID NO: 132371 - RNA, 18 nt, Artificial Sequence
  Description of Artificial Sequence: Synthetic oligonucleotide
cuugucuuuguccaccac

SEQ ID NO: 132372 - RNA, 18 nt, Artificial Sequence
  Description of Artificial Sequence: Synthetic oligonucleotide
uuccucuugucuuugucc

SEQ ID NO: 132373 - RNA, 18 nt, Artificial Sequence
  Description of Artificial Sequence: Synthetic oligonucleotide
acugguuccucuugucuu

SEQ ID NO: 132374 - RNA, 18 nt, Artificial Sequence
  Description of Artificial Sequence: Synthetic oligonucleotide
gcggcacugguuccucuu

SEQ ID NO: 132375 - RNA, 18 nt, Artificial Sequence
  Description of Artificial Sequence: Synthetic oligonucleotide
caguagcggcacugguuc

SEQ ID NO: 132376 - RNA, 18 nt, Artificial Sequence
  Description of Artificial Sequence: Synthetic oligonucleotide
gccugcaguagcggcacu

SEQ ID NO: 132377 - RNA, 18 nt, Artificial Sequence
  Description of Artificial Sequence: Synthetic oligonucleotide
cuugagccugcaguagcg

SEQ ID NO: 132378 - RNA, 18 nt, Artificial Sequence
  Description of Artificial Sequence: Synthetic oligonucleotide
cauuucuugagccugcag

SEQ ID NO: 132379 - RNA, 18 nt, Artificial Sequence
  Description of Artificial Sequence: Synthetic oligonucleotide
ggaagcauuucuugagcc

SEQ ID NO: 132380 - RNA, 18 nt, Artificial Sequence
  Description of Artificial Sequence: Synthetic oligonucleotide
agcccggaagcauuucuu

SEQ ID NO: 132381 - RNA, 18 nt, Artificial Sequence
  Description of Artificial Sequence: Synthetic oligonucleotide
augccagcccggaagcau

SEQ ID NO: 132382 - RNA, 18 nt, Artificial Sequence
  Description of Artificial Sequence: Synthetic oligonucleotide
ucuucaugccagcccgga

SEQ ID NO: 132383 - RNA, 18 nt, Artificial Sequence
  Description of Artificial Sequence: Synthetic oligonucleotide
uuccuucuucaugccagc

SEQ ID NO: 132384 - RNA, 18 nt, Artificial Sequence
  Description of Artificial Sequence: Synthetic oligonucleotide
caccacgcacugccggcu

SEQ ID NO: 132385 - RNA, 18 nt, Artificial Sequence
  Description of Artificial Sequence: Synthetic oligonucleotide
uuguccaccacgcacugc

SEQ ID NO: 132386 - RNA, 18 nt, Artificial Sequence
  Description of Artificial Sequence: Synthetic oligonucleotide
ugucuuuguccaccacgc

SEQ ID NO: 132387 - RNA, 18 nt, Artificial Sequence
  Description of Artificial Sequence: Synthetic oligonucleotide
ccucuugucuuuguccac

SEQ ID NO: 132388 - RNA, 18 nt, Artificial Sequence
  Description of Artificial Sequence: Synthetic oligonucleotide
ugguuccucuugucuuug

SEQ ID NO: 132389 - RNA, 18 nt, Artificial Sequence
  Description of Artificial Sequence: Synthetic oligonucleotide
ggcacugguuccucuugu

SEQ ID NO: 132390 - RNA, 18 nt, Artificial Sequence
  Description of Artificial Sequence: Synthetic oligonucleotide
guagcggcacugguuccu

SEQ ID NO: 132391 - RNA, 18 nt, Artificial Sequence
  Description of Artificial Sequence: Synthetic oligonucleotide
cugcaguagcggcacugg

SEQ ID NO: 132392 - RNA, 18 nt, Artificial Sequence
  Description of Artificial Sequence: Synthetic oligonucleotide
ugagccugcaguagcggc

SEQ ID NO: 132393 - RNA, 18 nt, Artificial Sequence
  Description of Artificial Sequence: Synthetic oligonucleotide
uuucuugagccugcagua

SEQ ID NO: 132394 - RNA, 18 nt, Artificial Sequence
  Description of Artificial Sequence: Synthetic oligonucleotide
aagcauuucuugagccug

SEQ ID NO: 132395 - RNA, 18 nt, Artificial Sequence
  Description of Artificial Sequence: Synthetic oligonucleotide
cccggaagcauuucuuga

SEQ ID NO: 132396 - RNA, 18 nt, Artificial Sequence
  Description of Artificial Sequence: Synthetic oligonucleotide
gccagcccggaagcauuu

SEQ ID NO: 132397 - RNA, 18 nt, Artificial Sequence
  Description of Artificial Sequence: Synthetic oligonucleotide
uucaugccagcccggaag

SEQ ID NO: 132398 - RNA, 18 nt, Artificial Sequence
  Description of Artificial Sequence: Synthetic oligonucleotide
ccuucuucaugccagccc

SEQ ID NO: 132399 - RNA, 18 nt, Artificial Sequence
  Description of Artificial Sequence: Synthetic oligonucleotide
gcugugggugcagguggg

SEQ ID NO: 132400 - RNA, 18 nt, Artificial Sequence
  Description of Artificial Sequence: Synthetic oligonucleotide
gggagcugugggugcagg

SEQ ID NO: 132401 - RNA, 18 nt, Artificial Sequence
  Description of Artificial Sequence: Synthetic oligonucleotide
uuguaaaugacugucggg

SEQ ID NO: 132402 - RNA, 18 nt, Artificial Sequence
  Description of Artificial Sequence: Synthetic oligonucleotide
uacaguuguaaaugacug

SEQ ID NO: 132403 - RNA, 18 nt, Artificial Sequence
  Description of Artificial Sequence: Synthetic oligonucleotide
guggcuacaguuguaaau

SEQ ID NO: 132404 - RNA, 18 nt, Artificial Sequence
  Description of Artificial Sequence: Synthetic oligonucleotide
aaaguguggcuacaguug

SEQ ID NO: 132405 - RNA, 18 nt, Artificial Sequence
  Description of Artificial Sequence: Synthetic oligonucleotide
gucauaaaguguggcuac

SEQ ID NO: 132406 - RNA, 18 nt, Artificial Sequence
  Description of Artificial Sequence: Synthetic oligonucleotide
acugagucauaaagugug

SEQ ID NO: 132407 - RNA, 18 nt, Artificial Sequence
  Description of Artificial Sequence: Synthetic oligonucleotide
cugccacugagucauaaa

SEQ ID NO: 132408 - RNA, 18 nt, Artificial Sequence
  Description of Artificial Sequence: Synthetic oligonucleotide
gggccugccacugaguca

SEQ ID NO: 132409 - RNA, 18 nt, Artificial Sequence
  Description of Artificial Sequence: Synthetic oligonucleotide
uuagccagucacccuggg

SEQ ID NO: 132410 - RNA, 18 nt, Artificial Sequence
  Description of Artificial Sequence: Synthetic oligonucleotide
agccauuagccagucacc

SEQ ID NO: 132411 - RNA, 18 nt, Artificial Sequence
  Description of Artificial Sequence: Synthetic oligonucleotide
uucucagccauuagccag

SEQ ID NO: 132412 - RNA, 18 nt, Artificial Sequence
  Description of Artificial Sequence: Synthetic oligonucleotide
cccucuucucagccauua

SEQ ID NO: 132413 - RNA, 18 nt, Artificial Sequence
  Description of Artificial Sequence: Synthetic oligonucleotide
gcccucccucuucucagc

SEQ ID NO: 132414 - RNA, 18 nt, Artificial Sequence
  Description of Artificial Sequence: Synthetic oligonucleotide
uccaggcccucccucuuc

SEQ ID NO: 132415 - RNA, 18 nt, Artificial Sequence
  Description of Artificial Sequence: Synthetic oligonucleotide
agauuuccaggcccuccc

SEQ ID NO: 132416 - RNA, 18 nt, Artificial Sequence
  Description of Artificial Sequence: Synthetic oligonucleotide
uggucagauuuccaggcc

SEQ ID NO: 132417 - RNA, 18 nt, Artificial Sequence
  Description of Artificial Sequence: Synthetic oligonucleotide
cccuauggucagauuucc

SEQ ID NO: 132418 - RNA, 18 nt, Artificial Sequence
  Description of Artificial Sequence: Synthetic oligonucleotide
ccgcucccuauggucaga

SEQ ID NO: 132419 - RNA, 18 nt, Artificial Sequence
  Description of Artificial Sequence: Synthetic oligonucleotide
cccagccgcucccuaugg

SEQ ID NO: 132420 - RNA, 18 nt, Artificial Sequence
  Description of Artificial Sequence: Synthetic oligonucleotide
ccaagcccagccgcuccc

SEQ ID NO: 132421 - RNA, 18 nt, Artificial Sequence
  Description of Artificial Sequence: Synthetic oligonucleotide
caagaccaagcccagccg

SEQ ID NO: 132422 - RNA, 18 nt, Artificial Sequence
  Description of Artificial Sequence: Synthetic oligonucleotide
uuucucaagaccaagccc

SEQ ID NO: 132423 - RNA, 18 nt, Artificial Sequence
  Description of Artificial Sequence: Synthetic oligonucleotide
gaaucuuucucaagacca

SEQ ID NO: 132424 - RNA, 18 nt, Artificial Sequence
  Description of Artificial Sequence: Synthetic oligonucleotide
ucucugaaucuuucucaa

SEQ ID NO: 132425 - RNA, 18 nt, Artificial Sequence
  Description of Artificial Sequence: Synthetic oligonucleotide
uuaucucucugaaucuuu

SEQ ID NO: 132426 - RNA, 18 nt, Artificial Sequence
  Description of Artificial Sequence: Synthetic oligonucleotide
ggagcuuaucucucugaa

SEQ ID NO: 132427 - RNA, 18 nt, Artificial Sequence
  Description of Artificial Sequence: Synthetic oligonucleotide
gagugggagcuuaucucu

SEQ ID NO: 132428 - RNA, 18 nt, Artificial Sequence
  Description of Artificial Sequence: Synthetic oligonucleotide
gccaagagugggagcuua

SEQ ID NO: 132429 - RNA, 18 nt, Artificial Sequence
  Description of Artificial Sequence: Synthetic oligonucleotide
gaggagccaagaguggga

SEQ ID NO: 132430 - RNA, 18 nt, Artificial Sequence
  Description of Artificial Sequence: Synthetic oligonucleotide
agccugaggagccaagag

SEQ ID NO: 132431 - RNA, 18 nt, Artificial Sequence
  Description of Artificial Sequence: Synthetic oligonucleotide
cugggagccugaggagcc

SEQ ID NO: 132432 - RNA, 18 nt, Artificial Sequence
  Description of Artificial Sequence: Synthetic oligonucleotide
gguugcugggagccugag

SEQ ID NO: 132433 - RNA, 18 nt, Artificial Sequence
  Description of Artificial Sequence: Synthetic oligonucleotide
guggugguugcugggagc

SEQ ID NO: 132434 - RNA, 18 nt, Artificial Sequence
  Description of Artificial Sequence: Synthetic oligonucleotide
ggguggugguugcuggga

SEQ ID NO: 132435 - RNA, 18 nt, Artificial Sequence
  Description of Artificial Sequence: Synthetic oligonucleotide
gcagacaggcaggcaggg

SEQ ID NO: 132436 - RNA, 18 nt, Artificial Sequence
  Description of Artificial Sequence: Synthetic oligonucleotide
guggcgcagacaggcagg

SEQ ID NO: 132437 - RNA, 18 nt, Artificial Sequence
  Description of Artificial Sequence: Synthetic oligonucleotide
uugugguggcgcagacag

SEQ ID NO: 132438 - RNA, 18 nt, Artificial Sequence
  Description of Artificial Sequence: Synthetic oligonucleotide
cugcuuugugguggcgca

SEQ ID NO: 132439 - RNA, 18 nt, Artificial Sequence
  Description of Artificial Sequence: Synthetic oligonucleotide
cguggcugcuuuguggug

SEQ ID NO: 132440 - RNA, 18 nt, Artificial Sequence
  Description of Artificial Sequence: Synthetic oligonucleotide
cacaacguggcugcuuug

SEQ ID NO: 132441 - RNA, 18 nt, Artificial Sequence
  Description of Artificial Sequence: Synthetic oligonucleotide
acacacacaacguggcug

SEQ ID NO: 132442 - RNA, 18 nt, Artificial Sequence
  Description of Artificial Sequence: Synthetic oligonucleotide
cacacacacacacaacgu

SEQ ID NO: 132443 - RNA, 18 nt, Artificial Sequence
  Description of Artificial Sequence: Synthetic oligonucleotide
acacacacacacacacac

SEQ ID NO: 132444 - RNA, 18 nt, Artificial Sequence
  Description of Artificial Sequence: Synthetic oligonucleotide
cacacacacacacacaca

SEQ ID NO: 132445 - RNA, 18 nt, Artificial Sequence
  Description of Artificial Sequence: Synthetic oligonucleotide
acacacacacacacacac

SEQ ID NO: 132446 - RNA, 18 nt, Artificial Sequence
  Description of Artificial Sequence: Synthetic oligonucleotide
cacacacacacacacaca

SEQ ID NO: 132447 - RNA, 18 nt, Artificial Sequence
  Description of Artificial Sequence: Synthetic oligonucleotide
uuaaacacacacacacac

SEQ ID NO: 132448 - RNA, 18 nt, Artificial Sequence
  Description of Artificial Sequence: Synthetic oligonucleotide
uuauauuaaacacacaca

SEQ ID NO: 132449 - RNA, 18 nt, Artificial Sequence
  Description of Artificial Sequence: Synthetic oligonucleotide
aaauauuauauuaaacac

SEQ ID NO: 132450 - RNA, 18 nt, Artificial Sequence
  Description of Artificial Sequence: Synthetic oligonucleotide
guucgaaauauuauauua

SEQ ID NO: 132451 - RNA, 18 nt, Artificial Sequence
  Description of Artificial Sequence: Synthetic oligonucleotide
cuaacguucgaaauauua

SEQ ID NO: 132452 - RNA, 18 nt, Artificial Sequence
  Description of Artificial Sequence: Synthetic oligonucleotide
uuguccuaacguucgaaa

SEQ ID NO: 132453 - RNA, 18 nt, Artificial Sequence
  Description of Artificial Sequence: Synthetic oligonucleotide
uaugcuuguccuaacguu

SEQ ID NO: 132454 - RNA, 18 nt, Artificial Sequence
  Description of Artificial Sequence: Synthetic oligonucleotide
uucucuaugcuuguccua

SEQ ID NO: 132455 - RNA, 18 nt, Artificial Sequence
  Description of Artificial Sequence: Synthetic oligonucleotide
uaucauucucuaugcuug

SEQ ID NO: 132456 - RNA, 18 nt, Artificial Sequence
  Description of Artificial Sequence: Synthetic oligonucleotide
ugcaauaucauucucuau

SEQ ID NO: 132457 - RNA, 18 nt, Artificial Sequence
  Description of Artificial Sequence: Synthetic oligonucleotide
auguuugcaauaucauuc

SEQ ID NO: 132458 - RNA, 18 nt, Artificial Sequence
  Description of Artificial Sequence: Synthetic oligonucleotide
cucagauguuugcaauau

SEQ ID NO: 132459 - RNA, 18 nt, Artificial Sequence
  Description of Artificial Sequence: Synthetic oligonucleotide
gaguacucagauguuugc

SEQ ID NO: 132460 - RNA, 18 nt, Artificial Sequence
  Description of Artificial Sequence: Synthetic oligonucleotide
auagugaguacucagaug

SEQ ID NO: 132461 - RNA, 18 nt, Artificial Sequence
  Description of Artificial Sequence: Synthetic oligonucleotide
uugggauagugaguacuc

SEQ ID NO: 132462 - RNA, 18 nt, Artificial Sequence
  Description of Artificial Sequence: Synthetic oligonucleotide
uaaaguugggauagugag

SEQ ID NO: 132463 - RNA, 18 nt, Artificial Sequence
  Description of Artificial Sequence: Synthetic oligonucleotide
uuuuguaaaguugggaua

SEQ ID NO: 132464 - RNA, 18 nt, Artificial Sequence
  Description of Artificial Sequence: Synthetic oligonucleotide
gucccuuuuguaaaguug

SEQ ID NO: 132465 - RNA, 18 nt, Artificial Sequence
  Description of Artificial Sequence: Synthetic oligonucleotide
uggcugucccuuuuguaa

SEQ ID NO: 132466 - RNA, 18 nt, Artificial Sequence
  Description of Artificial Sequence: Synthetic oligonucleotide
uccucuggcugucccuuu

SEQ ID NO: 132467 - RNA, 18 nt, Artificial Sequence
  Description of Artificial Sequence: Synthetic oligonucleotide
cgggcuccucuggcuguc

SEQ ID NO: 132468 - RNA, 18 nt, Artificial Sequence
  Description of Artificial Sequence: Synthetic oligonucleotide
ggcaucgggcuccucugg

SEQ ID NO: 132469 - RNA, 18 nt, Artificial Sequence
  Description of Artificial Sequence: Synthetic oligonucleotide
gcucaggcaucgggcucc

SEQ ID NO: 132470 - RNA, 18 nt, Artificial Sequence
  Description of Artificial Sequence: Synthetic oligonucleotide
cggaagcucaggcaucgg

SEQ ID NO: 132471 - RNA, 18 nt, Artificial Sequence
  Description of Artificial Sequence: Synthetic oligonucleotide
gggaccggaagcucaggc

SEQ ID NO: 132472 - RNA, 18 nt, Artificial Sequence
  Description of Artificial Sequence: Synthetic oligonucleotide
ucccugggaccggaagcu

SEQ ID NO: 132473 - RNA, 18 nt, Artificial Sequence
  Description of Artificial Sequence: Synthetic oligonucleotide
auuugucccugggaccgg

SEQ ID NO: 132474 - RNA, 18 nt, Artificial Sequence
  Description of Artificial Sequence: Synthetic oligonucleotide
gggcauuugucccuggga

SEQ ID NO: 132475 - RNA, 18 nt, Artificial Sequence
  Description of Artificial Sequence: Synthetic oligonucleotide
aauacuaagggaacuggg

SEQ ID NO: 132476 - RNA, 18 nt, Artificial Sequence
  Description of Artificial Sequence: Synthetic oligonucleotide
gaaugaauacuaagggaa

SEQ ID NO: 132477 - RNA, 18 nt, Artificial Sequence
  Description of Artificial Sequence: Synthetic oligonucleotide
cccacgaaugaauacuaa

SEQ ID NO: 132478 - RNA, 18 nt, Artificial Sequence
  Description of Artificial Sequence: Synthetic oligonucleotide
ugauacccacgaaugaau

SEQ ID NO: 132479 - RNA, 18 nt, Artificial Sequence
  Description of Artificial Sequence: Synthetic oligonucleotide
ucacgugauacccacgaa

SEQ ID NO: 132480 - RNA, 18 nt, Artificial Sequence
  Description of Artificial Sequence: Synthetic oligonucleotide
ggagaucacgugauaccc

SEQ ID NO: 132481 - RNA, 18 nt, Artificial Sequence
  Description of Artificial Sequence: Synthetic oligonucleotide
acuuuggagaucacguga

SEQ ID NO: 132482 - RNA, 18 nt, Artificial Sequence
  Description of Artificial Sequence: Synthetic oligonucleotide
ugaagacuuuggagauca

SEQ ID NO: 132483 - RNA, 18 nt, Artificial Sequence
  Description of Artificial Sequence: Synthetic oligonucleotide
gaaugugaagacuuugga

SEQ ID NO: 132484 - RNA, 18 nt, Artificial Sequence
  Description of Artificial Sequence: Synthetic oligonucleotide
uucuagaaugugaagacu

SEQ ID NO: 132485 - RNA, 18 nt, Artificial Sequence
  Description of Artificial Sequence: Synthetic oligonucleotide
acuaaccucagcaucagc

SEQ ID NO: 132486 - RNA, 18 nt, Artificial Sequence
  Description of Artificial Sequence: Synthetic oligonucleotide
uccagacuaaccucagca

SEQ ID NO: 132487 - RNA, 18 nt, Artificial Sequence
  Description of Artificial Sequence: Synthetic oligonucleotide
uguacuccagacuaaccu

SEQ ID NO: 132488 - RNA, 18 nt, Artificial Sequence
  Description of Artificial Sequence: Synthetic oligonucleotide
cugcauguacuccagacu

SEQ ID NO: 132489 - RNA, 18 nt, Artificial Sequence
  Description of Artificial Sequence: Synthetic oligonucleotide
aggagcugcauguacucc

SEQ ID NO: 132490 - RNA, 18 nt, Artificial Sequence
  Description of Artificial Sequence: Synthetic oligonucleotide
ucagcaggagcugcaugu

SEQ ID NO: 132491 - RNA, 18 nt, Artificial Sequence
  Description of Artificial Sequence: Synthetic oligonucleotide
guccaucagcaggagcug

SEQ ID NO: 132492 - RNA, 18 nt, Artificial Sequence
  Description of Artificial Sequence: Synthetic oligonucleotide
guuuuguccaucagcagg

SEQ ID NO: 132493 - RNA, 18 nt, Artificial Sequence
  Description of Artificial Sequence: Synthetic oligonucleotide
ugaugguuuuguccauca

SEQ ID NO: 132494 - RNA, 18 nt, Artificial Sequence
  Description of Artificial Sequence: Synthetic oligonucleotide
ugccuugaugguuuuguc

SEQ ID NO: 132495 - RNA, 18 nt, Artificial Sequence
  Description of Artificial Sequence: Synthetic oligonucleotide
ccaacugccuugaugguu

SEQ ID NO: 132496 - RNA, 18 nt, Artificial Sequence
  Description of Artificial Sequence: Synthetic oligonucleotide
gggcuccaacugccuuga

SEQ ID NO: 132497 - RNA, 18 nt, Artificial Sequence
  Description of Artificial Sequence: Synthetic oligonucleotide
ugaacaagaggaucuggg

SEQ ID NO: 132498 - RNA, 18 nt, Artificial Sequence
  Description of Artificial Sequence: Synthetic oligonucleotide
uccugaacaagaggaucu

SEQ ID NO: 132499 - RNA, 18 nt, Artificial Sequence
  Description of Artificial Sequence: Synthetic oligonucleotide
gggauuccugaacaagag

SEQ ID NO: 132500 - RNA, 18 nt, Artificial Sequence
  Description of Artificial Sequence: Synthetic oligonucleotide
acaaggagauggccuggg

SEQ ID NO: 132501 - RNA, 18 nt, Artificial Sequence
  Description of Artificial Sequence: Synthetic oligonucleotide
gugacaaggagauggccu

SEQ ID NO: 132502 - RNA, 18 nt, Artificial Sequence
  Description of Artificial Sequence: Synthetic oligonucleotide
ucugggugacaaggagau

SEQ ID NO: 132503 - RNA, 18 nt, Artificial Sequence
  Description of Artificial Sequence: Synthetic oligonucleotide
auuacucugggugacaag

SEQ ID NO: 132504 - RNA, 18 nt, Artificial Sequence
  Description of Artificial Sequence: Synthetic oligonucleotide
aacaaauuacucugggug

SEQ ID NO: 132505 - RNA, 18 nt, Artificial Sequence
  Description of Artificial Sequence: Synthetic oligonucleotide
agcaaaacaaauuacucu

SEQ ID NO: 132506 - RNA, 18 nt, Artificial Sequence
  Description of Artificial Sequence: Synthetic oligonucleotide
aagcaagcaaaacaaauu

SEQ ID NO: 132507 - RNA, 18 nt, Artificial Sequence
  Description of Artificial Sequence: Synthetic oligonucleotide
gaguaaagcaagcaaaac

SEQ ID NO: 132508 - RNA, 18 nt, Artificial Sequence
  Description of Artificial Sequence: Synthetic oligonucleotide
aaagugaguaaagcaagc

SEQ ID NO: 132509 - RNA, 18 nt, Artificial Sequence
  Description of Artificial Sequence: Synthetic oligonucleotide
aaaugaaagugaguaaag

SEQ ID NO: 132510 - RNA, 18 nt, Artificial Sequence
  Description of Artificial Sequence: Synthetic oligonucleotide
uuuccaaaugaaagugag

SEQ ID NO: 132511 - RNA, 18 nt, Artificial Sequence
  Description of Artificial Sequence: Synthetic oligonucleotide
cuuucuuuccaaaugaaa

SEQ ID NO: 132512 - RNA, 18 nt, Artificial Sequence
  Description of Artificial Sequence: Synthetic oligonucleotide
ggucccuuucuuuccaaa

SEQ ID NO: 132513 - RNA, 18 nt, Artificial Sequence
  Description of Artificial Sequence: Synthetic oligonucleotide
aaaagggucccuuucuuu

SEQ ID NO: 132514 - RNA, 18 nt, Artificial Sequence
  Description of Artificial Sequence: Synthetic oligonucleotide
ucuacaaaagggucccuu

SEQ ID NO: 132515 - RNA, 18 nt, Artificial Sequence
  Description of Artificial Sequence: Synthetic oligonucleotide
ucuggucuacaaaagggu

SEQ ID NO: 132516 - RNA, 18 nt, Artificial Sequence
  Description of Artificial Sequence: Synthetic oligonucleotide
caagcucuggucuacaaa

SEQ ID NO: 132517 - RNA, 18 nt, Artificial Sequence
  Description of Artificial Sequence: Synthetic oligonucleotide
auguucaagcucuggucu

SEQ ID NO: 132518 - RNA, 18 nt, Artificial Sequence
  Description of Artificial Sequence: Synthetic oligonucleotide
uaaagauguucaagcucu

SEQ ID NO: 132519 - RNA, 18 nt, Artificial Sequence
  Description of Artificial Sequence: Synthetic oligonucleotide
uagcuuaaagauguucaa

SEQ ID NO: 132520 - RNA, 18 nt, Artificial Sequence
  Description of Artificial Sequence: Synthetic oligonucleotide
cugacuagcuuaaagaug

SEQ ID NO: 132521 - RNA, 18 nt, Artificial Sequence
  Description of Artificial Sequence: Synthetic oligonucleotide
gggaucugacuagcuuaa

SEQ ID NO: 132522 - RNA, 18 nt, Artificial Sequence
  Description of Artificial Sequence: Synthetic oligonucleotide
cuugagcauugaggaggg

SEQ ID NO: 132523 - RNA, 18 nt, Artificial Sequence
  Description of Artificial Sequence: Synthetic oligonucleotide
ucuugagcauugaggagg

SEQ ID NO: 132524 - RNA, 18 nt, Artificial Sequence
  Description of Artificial Sequence: Synthetic oligonucleotide
auuggucuugagcauuga

SEQ ID NO: 132525 - RNA, 18 nt, Artificial Sequence
  Description of Artificial Sequence: Synthetic oligonucleotide
uuaaaauuggucuugagc

SEQ ID NO: 132526 - RNA, 18 nt, Artificial Sequence
  Description of Artificial Sequence: Synthetic oligonucleotide
uggguuuaaaauuggucu

SEQ ID NO: 132527 - RNA, 18 nt, Artificial Sequence
  Description of Artificial Sequence: Synthetic oligonucleotide
ggcuauggguuuaaaauu

SEQ ID NO: 132528 - RNA, 18 nt, Artificial Sequence
  Description of Artificial Sequence: Synthetic oligonucleotide
gacucggcuauggguuua

SEQ ID NO: 132529 - RNA, 18 nt, Artificial Sequence
  Description of Artificial Sequence: Synthetic oligonucleotide
gugaagacucggcuaugg

SEQ ID NO: 132530 - RNA, 18 nt, Artificial Sequence
  Description of Artificial Sequence: Synthetic oligonucleotide
agacagugaagacucggc

SEQ ID NO: 132531 - RNA, 18 nt, Artificial Sequence
  Description of Artificial Sequence: Synthetic oligonucleotide
gcgcaagacagugaagac

SEQ ID NO: 132532 - RNA, 18 nt, Artificial Sequence
  Description of Artificial Sequence: Synthetic oligonucleotide
auccacccaucagcaggg

SEQ ID NO: 132533 - RNA, 18 nt, Artificial Sequence
  Description of Artificial Sequence: Synthetic oligonucleotide
gagugauccacccaucag

SEQ ID NO: 132534 - RNA, 18 nt, Artificial Sequence
  Description of Artificial Sequence: Synthetic oligonucleotide
uauaagagugauccaccc

SEQ ID NO: 132535 - RNA, 18 nt, Artificial Sequence
  Description of Artificial Sequence: Synthetic oligonucleotide
gaggcuauaagagugauc

SEQ ID NO: 132536 - RNA, 18 nt, Artificial Sequence
  Description of Artificial Sequence: Synthetic oligonucleotide
auggagaggcuauaagag

SEQ ID NO: 132537 - RNA, 18 nt, Artificial Sequence
  Description of Artificial Sequence: Synthetic oligonucleotide
acacaauggagaggcuau

SEQ ID NO: 132538 - RNA, 18 nt, Artificial Sequence
  Description of Artificial Sequence: Synthetic oligonucleotide
ccccaacacaauggagag

SEQ ID NO: 132539 - RNA, 18 nt, Artificial Sequence
  Description of Artificial Sequence: Synthetic oligonucleotide
acugcccccaacacaaug

SEQ ID NO: 132540 - RNA, 18 nt, Artificial Sequence
  Description of Artificial Sequence: Synthetic oligonucleotide
ucacaacugcccccaaca

SEQ ID NO: 132541 - RNA, 18 nt, Artificial Sequence
  Description of Artificial Sequence: Synthetic oligonucleotide
acauaucacaacugcccc

SEQ ID NO: 132542 - RNA, 18 nt, Artificial Sequence
  Description of Artificial Sequence: Synthetic oligonucleotide
uuuccacauaucacaacu

SEQ ID NO: 132543 - RNA, 18 nt, Artificial Sequence
  Description of Artificial Sequence: Synthetic oligonucleotide
agaacuuuccacauauca

SEQ ID NO: 132544 - RNA, 18 nt, Artificial Sequence
  Description of Artificial Sequence: Synthetic oligonucleotide
guggaagaacuuuccaca

SEQ ID NO: 132545 - RNA, 18 nt, Artificial Sequence
  Description of Artificial Sequence: Synthetic oligonucleotide
agcugguggaagaacuuu

SEQ ID NO: 132546 - RNA, 18 nt, Artificial Sequence
  Description of Artificial Sequence: Synthetic oligonucleotide
aacucagcugguggaaga

SEQ ID NO: 132547 - RNA, 18 nt, Artificial Sequence
  Description of Artificial Sequence: Synthetic oligonucleotide
ccucuaacucagcuggug

SEQ ID NO: 132548 - RNA, 18 nt, Artificial Sequence
  Description of Artificial Sequence: Synthetic oligonucleotide
gauggccucuaacucagc

SEQ ID NO: 132549 - RNA, 18 nt, Artificial Sequence
  Description of Artificial Sequence: Synthetic oligonucleotide
cagcauguggaaugaggg

SEQ ID NO: 132550 - RNA, 18 nt, Artificial Sequence
  Description of Artificial Sequence: Synthetic oligonucleotide
cacaucagcauguggaau

SEQ ID NO: 132551 - RNA, 18 nt, Artificial Sequence
  Description of Artificial Sequence: Synthetic oligonucleotide
aggcccacaucagcaugu

SEQ ID NO: 132552 - RNA, 18 nt, Artificial Sequence
  Description of Artificial Sequence: Synthetic oligonucleotide
agaacaggcccacaucag

SEQ ID NO: 132553 - RNA, 18 nt, Artificial Sequence
  Description of Artificial Sequence: Synthetic oligonucleotide
uccagagaacaggcccac

SEQ ID NO: 132554 - RNA, 18 nt, Artificial Sequence
  Description of Artificial Sequence: Synthetic oligonucleotide
ggguguccagagaacagg

SEQ ID NO: 132555 - RNA, 18 nt, Artificial Sequence
  Description of Artificial Sequence: Synthetic oligonucleotide
gugggagcaggagguggg

SEQ ID NO: 132556 - RNA, 18 nt, Artificial Sequence
  Description of Artificial Sequence: Synthetic oligonucleotide
gagugggagcaggaggug

SEQ ID NO: 132557 - RNA, 18 nt, Artificial Sequence
  Description of Artificial Sequence: Synthetic oligonucleotide
augaggagugggagcagg

SEQ ID NO: 132558 - RNA, 18 nt, Artificial Sequence
  Description of Artificial Sequence: Synthetic oligonucleotide
gacugaugaggaguggga

SEQ ID NO: 132559 - RNA, 18 nt, Artificial Sequence
  Description of Artificial Sequence: Synthetic oligonucleotide
ucugugacugaugaggag

SEQ ID NO: 132560 - RNA, 18 nt, Artificial Sequence
  Description of Artificial Sequence: Synthetic oligonucleotide
gggugucugugacugaug

SEQ ID NO: 132561 - RNA, 18 nt, Artificial Sequence
  Description of Artificial Sequence: Synthetic oligonucleotide
aacagggauggaguaggg

SEQ ID NO: 132562 - RNA, 18 nt, Artificial Sequence
  Description of Artificial Sequence: Synthetic oligonucleotide
agaacagggauggaguag

SEQ ID NO: 132563 - RNA, 18 nt, Artificial Sequence
  Description of Artificial Sequence: Synthetic oligonucleotide
gagggagaacagggaugg

SEQ ID NO: 132564 - RNA, 18 nt, Artificial Sequence
  Description of Artificial Sequence: Synthetic oligonucleotide
gugaggagggagaacagg

SEQ ID NO: 132565 - RNA, 18 nt, Artificial Sequence
  Description of Artificial Sequence: Synthetic oligonucleotide
gagaggugaggagggaga

SEQ ID NO: 132566 - RNA, 18 nt, Artificial Sequence
  Description of Artificial Sequence: Synthetic oligonucleotide
ucccgcucauucuggacg

SEQ ID NO: 132567 - RNA, 18 nt, Artificial Sequence
  Description of Artificial Sequence: Synthetic oligonucleotide
uccggucccgcucauucu

SEQ ID NO: 132568 - RNA, 18 nt, Artificial Sequence
  Description of Artificial Sequence: Synthetic oligonucleotide
gcugauccggucccgcuc

SEQ ID NO: 132569 - RNA, 18 nt, Artificial Sequence
  Description of Artificial Sequence: Synthetic oligonucleotide
cgagugcugauccggucc

SEQ ID NO: 132570 - RNA, 18 nt, Artificial Sequence
  Description of Artificial Sequence: Synthetic oligonucleotide
accuucgagugcugaucc

SEQ ID NO: 132571 - RNA, 18 nt, Artificial Sequence
  Description of Artificial Sequence: Synthetic oligonucleotide
gcuugaccuucgagugcu

SEQ ID NO: 132572 - RNA, 18 nt, Artificial Sequence
  Description of Artificial Sequence: Synthetic oligonucleotide
ucauagcuugaccuucga

SEQ ID NO: 132573 - RNA, 18 nt, Artificial Sequence
  Description of Artificial Sequence: Synthetic oligonucleotide
uguccucauagcuugacc

SEQ ID NO: 132574 - RNA, 18 nt, Artificial Sequence
  Description of Artificial Sequence: Synthetic oligonucleotide
gcugcuguccucauagcu

SEQ ID NO: 132575 - RNA, 18 nt, Artificial Sequence
  Description of Artificial Sequence: Synthetic oligonucleotide
ggcaggcugcuguccuca

SEQ ID NO: 132576 - RNA, 18 nt, Artificial Sequence
  Description of Artificial Sequence: Synthetic oligonucleotide
uggagggcaggcugcugu

SEQ ID NO: 132577 - RNA, 18 nt, Artificial Sequence
  Description of Artificial Sequence: Synthetic oligonucleotide
auugauggagggcaggcu

SEQ ID NO: 132578 - RNA, 18 nt, Artificial Sequence
  Description of Artificial Sequence: Synthetic oligonucleotide
agcgcauugauggagggc

SEQ ID NO: 132579 - RNA, 18 nt, Artificial Sequence
  Description of Artificial Sequence: Synthetic oligonucleotide
gcaggagcgcauugaugg

SEQ ID NO: 132580 - RNA, 18 nt, Artificial Sequence
  Description of Artificial Sequence: Synthetic oligonucleotide
cgccugcaggagcgcauu

SEQ ID NO: 132581 - RNA, 18 nt, Artificial Sequence
  Description of Artificial Sequence: Synthetic oligonucleotide
accuccgccugcaggagc

SEQ ID NO: 132582 - RNA, 18 nt, Artificial Sequence
  Description of Artificial Sequence: Synthetic oligonucleotide
acaggaccuccgccugca

SEQ ID NO: 132583 - RNA, 18 nt, Artificial Sequence
  Description of Artificial Sequence: Synthetic oligonucleotide
ucgggacaggaccuccgc

SEQ ID NO: 132584 - RNA, 18 nt, Artificial Sequence
  Description of Artificial Sequence: Synthetic oligonucleotide
ucccgcucauucuggacg

SEQ ID NO: 132585 - RNA, 18 nt, Artificial Sequence
  Description of Artificial Sequence: Synthetic oligonucleotide
uccggucccgcucauucu

SEQ ID NO: 132586 - RNA, 18 nt, Artificial Sequence
  Description of Artificial Sequence: Synthetic oligonucleotide
gcugauccggucccgcuc

SEQ ID NO: 132587 - RNA, 18 nt, Artificial Sequence
  Description of Artificial Sequence: Synthetic oligonucleotide
cgagugcugauccggucc

SEQ ID NO: 132588 - RNA, 18 nt, Artificial Sequence
  Description of Artificial Sequence: Synthetic oligonucleotide
accuucgagugcugaucc

SEQ ID NO: 132589 - RNA, 18 nt, Artificial Sequence
  Description of Artificial Sequence: Synthetic oligonucleotide
gcuugaccuucgagugcu

SEQ ID NO: 132590 - RNA, 18 nt, Artificial Sequence
  Description of Artificial Sequence: Synthetic oligonucleotide
ucauagcuugaccuucga

SEQ ID NO: 132591 - RNA, 18 nt, Artificial Sequence
  Description of Artificial Sequence: Synthetic oligonucleotide
uguccucauagcuugacc

SEQ ID NO: 132592 - RNA, 18 nt, Artificial Sequence
  Description of Artificial Sequence: Synthetic oligonucleotide
gcugcuguccucauagcu

SEQ ID NO: 132593 - RNA, 18 nt, Artificial Sequence
  Description of Artificial Sequence: Synthetic oligonucleotide
ggcaggcugcuguccuca

SEQ ID NO: 132594 - RNA, 18 nt, Artificial Sequence
  Description of Artificial Sequence: Synthetic oligonucleotide
uggagggcaggcugcugu

SEQ ID NO: 132595 - RNA, 18 nt, Artificial Sequence
  Description of Artificial Sequence: Synthetic oligonucleotide
auugauggagggcaggcu

SEQ ID NO: 132596 - RNA, 18 nt, Artificial Sequence
  Description of Artificial Sequence: Synthetic oligonucleotide
agcgcauugauggagggc

SEQ ID NO: 132597 - RNA, 18 nt, Artificial Sequence
  Description of Artificial Sequence: Synthetic oligonucleotide
gcaggagcgcauugaugg

SEQ ID NO: 132598 - RNA, 18 nt, Artificial Sequence
  Description of Artificial Sequence: Synthetic oligonucleotide
cgccugcaggagcgcauu

SEQ ID NO: 132599 - RNA, 18 nt, Artificial Sequence
  Description of Artificial Sequence: Synthetic oligonucleotide
accuccgccugcaggagc

SEQ ID NO: 132600 - RNA, 18 nt, Artificial Sequence
  Description of Artificial Sequence: Synthetic oligonucleotide
acaggaccuccgccugca

SEQ ID NO: 132601 - RNA, 18 nt, Artificial Sequence
  Description of Artificial Sequence: Synthetic oligonucleotide
ucgggacaggaccuccgc

SEQ ID NO: 132602 - RNA, 18 nt, Artificial Sequence
  Description of Artificial Sequence: Synthetic oligonucleotide
ggguggcaggaucacccc

SEQ ID NO: 132603 - RNA, 18 nt, Artificial Sequence
  Description of Artificial Sequence: Synthetic oligonucleotide
uggguggguggcaggauc

SEQ ID NO: 132604 - RNA, 18 nt, Artificial Sequence
  Description of Artificial Sequence: Synthetic oligonucleotide
aucccuggguggguggca

SEQ ID NO: 132605 - RNA, 18 nt, Artificial Sequence
  Description of Artificial Sequence: Synthetic oligonucleotide
gggaucccugggugggug

SEQ ID NO: 132606 - RNA, 18 nt, Artificial Sequence
  Description of Artificial Sequence: Synthetic oligonucleotide
gcuccucuguaguguggg

SEQ ID NO: 132607 - RNA, 18 nt, Artificial Sequence
  Description of Artificial Sequence: Synthetic oligonucleotide
ggugagcuccucuguagu

SEQ ID NO: 132608 - RNA, 18 nt, Artificial Sequence
  Description of Artificial Sequence: Synthetic oligonucleotide
gaggaggugagcuccucu

SEQ ID NO: 132609 - RNA, 18 nt, Artificial Sequence
  Description of Artificial Sequence: Synthetic oligonucleotide
agguggaggaggugagcu

SEQ ID NO: 132610 - RNA, 18 nt, Artificial Sequence
  Description of Artificial Sequence: Synthetic oligonucleotide
aauggagguggaggaggu

SEQ ID NO: 132611 - RNA, 18 nt, Artificial Sequence
  Description of Artificial Sequence: Synthetic oligonucleotide
gggagaauggagguggag

SEQ ID NO: 132612 - RNA, 18 nt, Artificial Sequence
  Description of Artificial Sequence: Synthetic oligonucleotide
gcugcuccagggccuggc

SEQ ID NO: 132613 - RNA, 18 nt, Artificial Sequence
  Description of Artificial Sequence: Synthetic oligonucleotide
cgucagcugcuccagggc

SEQ ID NO: 132614 - RNA, 18 nt, Artificial Sequence
  Description of Artificial Sequence: Synthetic oligonucleotide
ccucccgucagcugcucc

SEQ ID NO: 132615 - RNA, 18 nt, Artificial Sequence
  Description of Artificial Sequence: Synthetic oligonucleotide
aggccccucccgucagcu

SEQ ID NO: 132616 - RNA, 18 nt, Artificial Sequence
  Description of Artificial Sequence: Synthetic oligonucleotide
aucugaggccccucccgu

SEQ ID NO: 132617 - RNA, 18 nt, Artificial Sequence
  Description of Artificial Sequence: Synthetic oligonucleotide
guaauaucugaggccccu

SEQ ID NO: 132618 - RNA, 18 nt, Artificial Sequence
  Description of Artificial Sequence: Synthetic oligonucleotide
cuucuguaauaucugagg

SEQ ID NO: 132619 - RNA, 18 nt, Artificial Sequence
  Description of Artificial Sequence: Synthetic oligonucleotide
ugucccuucuguaauauc

SEQ ID NO: 132620 - RNA, 18 nt, Artificial Sequence
  Description of Artificial Sequence: Synthetic oligonucleotide
cucagugucccuucugua

SEQ ID NO: 132621 - RNA, 18 nt, Artificial Sequence
  Description of Artificial Sequence: Synthetic oligonucleotide
ccggacucagugucccuu

SEQ ID NO: 132622 - RNA, 18 nt, Artificial Sequence
  Description of Artificial Sequence: Synthetic oligonucleotide
ugaaaccggacucagugu

SEQ ID NO: 132623 - RNA, 18 nt, Artificial Sequence
  Description of Artificial Sequence: Synthetic oligonucleotide
ccaugugaaaccggacuc

SEQ ID NO: 132624 - RNA, 18 nt, Artificial Sequence
  Description of Artificial Sequence: Synthetic oligonucleotide
cugggccaugugaaaccg

SEQ ID NO: 132625 - RNA, 18 nt, Artificial Sequence
  Description of Artificial Sequence: Synthetic oligonucleotide
gcaaacugggccauguga

SEQ ID NO: 132626 - RNA, 18 nt, Artificial Sequence
  Description of Artificial Sequence: Synthetic oligonucleotide
uugcugcaaacugggcca

SEQ ID NO: 132627 - RNA, 18 nt, Artificial Sequence
  Description of Artificial Sequence: Synthetic oligonucleotide
ugcccuugcugcaaacug

SEQ ID NO: 132628 - RNA, 18 nt, Artificial Sequence
  Description of Artificial Sequence: Synthetic oligonucleotide
auuccugcccuugcugca

SEQ ID NO: 132629 - RNA, 18 nt, Artificial Sequence
  Description of Artificial Sequence: Synthetic oligonucleotide
guucgauuccugcccuug

SEQ ID NO: 132630 - RNA, 18 nt, Artificial Sequence
  Description of Artificial Sequence: Synthetic oligonucleotide
gccagguucgauuccugc

SEQ ID NO: 132631 - RNA, 18 nt, Artificial Sequence
  Description of Artificial Sequence: Synthetic oligonucleotide
agggcgccagguucgauu

SEQ ID NO: 132632 - RNA, 18 nt, Artificial Sequence
  Description of Artificial Sequence: Synthetic oligonucleotide
gccccagggcgccagguu

SEQ ID NO: 132633 - RNA, 18 nt, Artificial Sequence
  Description of Artificial Sequence: Synthetic oligonucleotide
aaagugccccagggcgcc

SEQ ID NO: 132634 - RNA, 18 nt, Artificial Sequence
  Description of Artificial Sequence: Synthetic oligonucleotide
auuagaaagugccccagg

SEQ ID NO: 132635 - RNA, 18 nt, Artificial Sequence
  Description of Artificial Sequence: Synthetic oligonucleotide
gaugaauuagaaagugcc

SEQ ID NO: 132636 - RNA, 18 nt, Artificial Sequence
  Description of Artificial Sequence: Synthetic oligonucleotide
aguaggaugaauuagaaa

SEQ ID NO: 132637 - RNA, 18 nt, Artificial Sequence
  Description of Artificial Sequence: Synthetic oligonucleotide
caggcaguaggaugaauu

SEQ ID NO: 132638 - RNA, 18 nt, Artificial Sequence
  Description of Artificial Sequence: Synthetic oligonucleotide
ggaugcaggcaguaggau

SEQ ID NO: 132639 - RNA, 18 nt, Artificial Sequence
  Description of Artificial Sequence: Synthetic oligonucleotide
cugugggaugcaggcagu

SEQ ID NO: 132640 - RNA, 18 nt, Artificial Sequence
  Description of Artificial Sequence: Synthetic oligonucleotide
uuggccugugggaugcag

SEQ ID NO: 132641 - RNA, 18 nt, Artificial Sequence
  Description of Artificial Sequence: Synthetic oligonucleotide
ucugcuuggccuguggga

SEQ ID NO: 132642 - RNA, 18 nt, Artificial Sequence
  Description of Artificial Sequence: Synthetic oligonucleotide
aagacucugcuuggccug

SEQ ID NO: 132643 - RNA, 18 nt, Artificial Sequence
  Description of Artificial Sequence: Synthetic oligonucleotide
aggugaagacucugcuug

SEQ ID NO: 132644 - RNA, 18 nt, Artificial Sequence
  Description of Artificial Sequence: Synthetic oligonucleotide
agugaaggugaagacucu

SEQ ID NO: 132645 - RNA, 18 nt, Artificial Sequence
  Description of Artificial Sequence: Synthetic oligonucleotide
cccucagugaaggugaag

SEQ ID NO: 132646 - RNA, 18 nt, Artificial Sequence
  Description of Artificial Sequence: Synthetic oligonucleotide
gcaggcccucagugaagg

SEQ ID NO: 132647 - RNA, 18 nt, Artificial Sequence
  Description of Artificial Sequence: Synthetic oligonucleotide
ugaucgcaggcccucagu

SEQ ID NO: 132648 - RNA, 18 nt, Artificial Sequence
  Description of Artificial Sequence: Synthetic oligonucleotide
ugagcugaucgcaggccc

SEQ ID NO: 132649 - RNA, 18 nt, Artificial Sequence
  Description of Artificial Sequence: Synthetic oligonucleotide
ggagcugagcugaucgca

SEQ ID NO: 132650 - RNA, 18 nt, Artificial Sequence
  Description of Artificial Sequence: Synthetic oligonucleotide
cucucggagcugagcuga

SEQ ID NO: 132651 - RNA, 18 nt, Artificial Sequence
  Description of Artificial Sequence: Synthetic oligonucleotide
cuguucucucggagcuga

SEQ ID NO: 132652 - RNA, 18 nt, Artificial Sequence
  Description of Artificial Sequence: Synthetic oligonucleotide
cugcucuguucucucgga

SEQ ID NO: 132653 - RNA, 18 nt, Artificial Sequence
  Description of Artificial Sequence: Synthetic oligonucleotide
agccacugcucuguucuc

SEQ ID NO: 132654 - RNA, 18 nt, Artificial Sequence
  Description of Artificial Sequence: Synthetic oligonucleotide
cacugagccacugcucug

SEQ ID NO: 132655 - RNA, 18 nt, Artificial Sequence
  Description of Artificial Sequence: Synthetic oligonucleotide
cucuccacugagccacug

SEQ ID NO: 132656 - RNA, 18 nt, Artificial Sequence
  Description of Artificial Sequence: Synthetic oligonucleotide
caccucucuccacugagc

SEQ ID NO: 132657 - RNA, 18 nt, Artificial Sequence
  Description of Artificial Sequence: Synthetic oligonucleotide
uuugccaccucucuccac

SEQ ID NO: 132658 - RNA, 18 nt, Artificial Sequence
  Description of Artificial Sequence: Synthetic oligonucleotide
cccacuuugccaccucuc

SEQ ID NO: 132659 - RNA, 18 nt, Artificial Sequence
  Description of Artificial Sequence: Synthetic oligonucleotide
ugggccccacuuugccac

SEQ ID NO: 132660 - RNA, 18 nt, Artificial Sequence
  Description of Artificial Sequence: Synthetic oligonucleotide
agggcugggccccacuuu

SEQ ID NO: 132661 - RNA, 18 nt, Artificial Sequence
  Description of Artificial Sequence: Synthetic oligonucleotide
agggaagggcugggcccc

SEQ ID NO: 132662 - RNA, 18 nt, Artificial Sequence
  Description of Artificial Sequence: Synthetic oligonucleotide
cagcaagggaagggcugg

SEQ ID NO: 132663 - RNA, 18 nt, Artificial Sequence
  Description of Artificial Sequence: Synthetic oligonucleotide
ucacucagcaagggaagg

SEQ ID NO: 132664 - RNA, 18 nt, Artificial Sequence
  Description of Artificial Sequence: Synthetic oligonucleotide
caaggucacucagcaagg

SEQ ID NO: 132665 - RNA, 18 nt, Artificial Sequence
  Description of Artificial Sequence: Synthetic oligonucleotide
uugcccaaggucacucag

SEQ ID NO: 132666 - RNA, 18 nt, Artificial Sequence
  Description of Artificial Sequence: Synthetic oligonucleotide
gugacuugcccaagguca

SEQ ID NO: 132667 - RNA, 18 nt, Artificial Sequence
  Description of Artificial Sequence: Synthetic oligonucleotide
gugcugugacuugcccaa

SEQ ID NO: 132668 - RNA, 18 nt, Artificial Sequence
  Description of Artificial Sequence: Synthetic oligonucleotide
gagaggugcugugacuug

SEQ ID NO: 132669 - RNA, 18 nt, Artificial Sequence
  Description of Artificial Sequence: Synthetic oligonucleotide
gcucagagaggugcugug

SEQ ID NO: 132670 - RNA, 18 nt, Artificial Sequence
  Description of Artificial Sequence: Synthetic oligonucleotide
gaagggcugggccccacu

SEQ ID NO: 132671 - RNA, 18 nt, Artificial Sequence
  Description of Artificial Sequence: Synthetic oligonucleotide
caagggaagggcugggcc

SEQ ID NO: 132672 - RNA, 18 nt, Artificial Sequence
  Description of Artificial Sequence: Synthetic oligonucleotide
cucagcaagggaagggcu

SEQ ID NO: 132673 - RNA, 18 nt, Artificial Sequence
  Description of Artificial Sequence: Synthetic oligonucleotide
ggucacucagcaagggaa

SEQ ID NO: 132674 - RNA, 18 nt, Artificial Sequence
  Description of Artificial Sequence: Synthetic oligonucleotide
cccaaggucacucagcaa

SEQ ID NO: 132675 - RNA, 18 nt, Artificial Sequence
  Description of Artificial Sequence: Synthetic oligonucleotide
acuugcccaaggucacuc

SEQ ID NO: 132676 - RNA, 18 nt, Artificial Sequence
  Description of Artificial Sequence: Synthetic oligonucleotide
cugugacuugcccaaggu

SEQ ID NO: 132677 - RNA, 18 nt, Artificial Sequence
  Description of Artificial Sequence: Synthetic oligonucleotide
aggugcugugacuugccc

SEQ ID NO: 132678 - RNA, 18 nt, Artificial Sequence
  Description of Artificial Sequence: Synthetic oligonucleotide
cagagaggugcugugacu

SEQ ID NO: 132679 - RNA, 18 nt, Artificial Sequence
  Description of Artificial Sequence: Synthetic oligonucleotide
uggcucagagaggugcug

SEQ ID NO: 132680 - RNA, 18 nt, Artificial Sequence
  Description of Artificial Sequence: Synthetic oligonucleotide
aaccauggcucagagagg

SEQ ID NO: 132681 - RNA, 18 nt, Artificial Sequence
  Description of Artificial Sequence: Synthetic oligonucleotide
gaggcaaccauggcucag

SEQ ID NO: 132682 - RNA, 18 nt, Artificial Sequence
  Description of Artificial Sequence: Synthetic oligonucleotide
acaaugaggcaaccaugg

SEQ ID NO: 132683 - RNA, 18 nt, Artificial Sequence
  Description of Artificial Sequence: Synthetic oligonucleotide
uucugacaaugaggcaac

SEQ ID NO: 132684 - RNA, 18 nt, Artificial Sequence
  Description of Artificial Sequence: Synthetic oligonucleotide
uccuuuucugacaaugag

SEQ ID NO: 132685 - RNA, 18 nt, Artificial Sequence
  Description of Artificial Sequence: Synthetic oligonucleotide
caucauccuuuucugaca

SEQ ID NO: 132686 - RNA, 18 nt, Artificial Sequence
  Description of Artificial Sequence: Synthetic oligonucleotide
aaaaucaucauccuuuuc

SEQ ID NO: 132687 - RNA, 18 nt, Artificial Sequence
  Description of Artificial Sequence: Synthetic oligonucleotide
ggcaaaaaaucaucaucc

SEQ ID NO: 132688 - RNA, 18 nt, Artificial Sequence
  Description of Artificial Sequence: Synthetic oligonucleotide
agcagggcaaaaaaucau

SEQ ID NO: 132689 - RNA, 18 nt, Artificial Sequence
  Description of Artificial Sequence: Synthetic oligonucleotide
ggagaagcagggcaaaaa

SEQ ID NO: 132690 - RNA, 18 nt, Artificial Sequence
  Description of Artificial Sequence: Synthetic oligonucleotide
uuagaggagaagcagggc

SEQ ID NO: 132691 - RNA, 18 nt, Artificial Sequence
  Description of Artificial Sequence: Synthetic oligonucleotide
cagccuuagaggagaagc

SEQ ID NO: 132692 - RNA, 18 nt, Artificial Sequence
  Description of Artificial Sequence: Synthetic oligonucleotide
ucugucagccuuagagga

SEQ ID NO: 132693 - RNA, 18 nt, Artificial Sequence
  Description of Artificial Sequence: Synthetic oligonucleotide
aggagucugucagccuua

SEQ ID NO: 132694 - RNA, 18 nt, Artificial Sequence
  Description of Artificial Sequence: Synthetic oligonucleotide
ccccaaggagucugucag

SEQ ID NO: 132695 - RNA, 18 nt, Artificial Sequence
  Description of Artificial Sequence: Synthetic oligonucleotide
uagagccccaaggagucu

SEQ ID NO: 132696 - RNA, 18 nt, Artificial Sequence
  Description of Artificial Sequence: Synthetic oligonucleotide
agcuuuagagccccaagg

SEQ ID NO: 132697 - RNA, 18 nt, Artificial Sequence
  Description of Artificial Sequence: Synthetic oligonucleotide
cugucagcuuuagagccc

SEQ ID NO: 132698 - RNA, 18 nt, Artificial Sequence
  Description of Artificial Sequence: Synthetic oligonucleotide
cuccucugucagcuuuag

SEQ ID NO: 132699 - RNA, 18 nt, Artificial Sequence
  Description of Artificial Sequence: Synthetic oligonucleotide
gcccccuccucugucagc

SEQ ID NO: 132700 - RNA, 18 nt, Artificial Sequence
  Description of Artificial Sequence: Synthetic oligonucleotide
ccccugcccccuccucug

SEQ ID NO: 132701 - RNA, 18 nt, Artificial Sequence
  Description of Artificial Sequence: Synthetic oligonucleotide
ccugcccccugcccccuc

SEQ ID NO: 132702 - RNA, 18 nt, Artificial Sequence
  Description of Artificial Sequence: Synthetic oligonucleotide
uguuaccugcccccugcc

SEQ ID NO: 132703 - RNA, 18 nt, Artificial Sequence
  Description of Artificial Sequence: Synthetic oligonucleotide
ucaccuguuaccugcccc

SEQ ID NO: 132704 - RNA, 18 nt, Artificial Sequence
  Description of Artificial Sequence: Synthetic oligonucleotide
ugccuucaccuguuaccu

SEQ ID NO: 132705 - RNA, 18 nt, Artificial Sequence
  Description of Artificial Sequence: Synthetic oligonucleotide
cucugugccuucaccugu

SEQ ID NO: 132706 - RNA, 18 nt, Artificial Sequence
  Description of Artificial Sequence: Synthetic oligonucleotide
gcucccucugugccuuca

SEQ ID NO: 132707 - RNA, 18 nt, Artificial Sequence
  Description of Artificial Sequence: Synthetic oligonucleotide
gaagggcucccucugugc

SEQ ID NO: 132708 - RNA, 18 nt, Artificial Sequence
  Description of Artificial Sequence: Synthetic oligonucleotide
agggagaagggcucccuc

SEQ ID NO: 132709 - RNA, 18 nt, Artificial Sequence
  Description of Artificial Sequence: Synthetic oligonucleotide
ggaugagggagaagggcu

SEQ ID NO: 132710 - RNA, 18 nt, Artificial Sequence
  Description of Artificial Sequence: Synthetic oligonucleotide
ggcagggaugagggagaa

SEQ ID NO: 132711 - RNA, 18 nt, Artificial Sequence
  Description of Artificial Sequence: Synthetic oligonucleotide
gaggaggcagggaugagg

SEQ ID NO: 132712 - RNA, 18 nt, Artificial Sequence
  Description of Artificial Sequence: Synthetic oligonucleotide
ggagggaggaggcaggga

SEQ ID NO: 132713 - RNA, 18 nt, Artificial Sequence
  Description of Artificial Sequence: Synthetic oligonucleotide
cggagggagggaggaggc

SEQ ID NO: 132714 - RNA, 18 nt, Artificial Sequence
  Description of Artificial Sequence: Synthetic oligonucleotide
aaaaacggagggagggag

SEQ ID NO: 132715 - RNA, 18 nt, Artificial Sequence
  Description of Artificial Sequence: Synthetic oligonucleotide
aggguaaaaacggaggga

SEQ ID NO: 132716 - RNA, 18 nt, Artificial Sequence
  Description of Artificial Sequence: Synthetic oligonucleotide
agcucaggguaaaaacgg

SEQ ID NO: 132717 - RNA, 18 nt, Artificial Sequence
  Description of Artificial Sequence: Synthetic oligonucleotide
aaggaagcucaggguaaa

SEQ ID NO: 132718 - RNA, 18 nt, Artificial Sequence
  Description of Artificial Sequence: Synthetic oligonucleotide
cucugaaggaagcucagg

SEQ ID NO: 132719 - RNA, 18 nt, Artificial Sequence
  Description of Artificial Sequence: Synthetic oligonucleotide
uccagcucugaaggaagc

SEQ ID NO: 132720 - RNA, 18 nt, Artificial Sequence
  Description of Artificial Sequence: Synthetic oligonucleotide
ugcccuccagcucugaag

SEQ ID NO: 132721 - RNA, 18 nt, Artificial Sequence
  Description of Artificial Sequence: Synthetic oligonucleotide
gugggugcccuccagcuc

SEQ ID NO: 132722 - RNA, 18 nt, Artificial Sequence
  Description of Artificial Sequence: Synthetic oligonucleotide
ggauagugggugcccucc

SEQ ID NO: 132723 - RNA, 18 nt, Artificial Sequence
  Description of Artificial Sequence: Synthetic oligonucleotide
gggcuggauagugggugc

SEQ ID NO: 132724 - RNA, 18 nt, Artificial Sequence
  Description of Artificial Sequence: Synthetic oligonucleotide
ccuggaaucagauguggg

SEQ ID NO: 132725 - RNA, 18 nt, Artificial Sequence
  Description of Artificial Sequence: Synthetic oligonucleotide
ccucccuggaaucagaug

SEQ ID NO: 132726 - RNA, 18 nt, Artificial Sequence
  Description of Artificial Sequence: Synthetic oligonucleotide
agcccccucccuggaauc

SEQ ID NO: 132727 - RNA, 18 nt, Artificial Sequence
  Description of Artificial Sequence: Synthetic oligonucleotide
cacagagcccccucccug

SEQ ID NO: 132728 - RNA, 18 nt, Artificial Sequence
  Description of Artificial Sequence: Synthetic oligonucleotide
cccugcacagagcccccu

SEQ ID NO: 132729 - RNA, 18 nt, Artificial Sequence
  Description of Artificial Sequence: Synthetic oligonucleotide
cuguccccugcacagagc

SEQ ID NO: 132730 - RNA, 18 nt, Artificial Sequence
  Description of Artificial Sequence: Synthetic oligonucleotide
acucucuguccccugcac

SEQ ID NO: 132731 - RNA, 18 nt, Artificial Sequence
  Description of Artificial Sequence: Synthetic oligonucleotide
cccgcacucucugucccc

SEQ ID NO: 132732 - RNA, 18 nt, Artificial Sequence
  Description of Artificial Sequence: Synthetic oligonucleotide
gcccucccgcacucucug

SEQ ID NO: 132733 - RNA, 18 nt, Artificial Sequence
  Description of Artificial Sequence: Synthetic oligonucleotide
uccgggcccucccgcacu

SEQ ID NO: 132734 - RNA, 18 nt, Artificial Sequence
  Description of Artificial Sequence: Synthetic oligonucleotide
agauguccgggcccuccc

SEQ ID NO: 132735 - RNA, 18 nt, Artificial Sequence
  Description of Artificial Sequence: Synthetic oligonucleotide
gcuggagauguccgggcc

SEQ ID NO: 132736 - RNA, 18 nt, Artificial Sequence
  Description of Artificial Sequence: Synthetic oligonucleotide
aaaaugcuggagaugucc

SEQ ID NO: 132737 - RNA, 18 nt, Artificial Sequence
  Description of Artificial Sequence: Synthetic oligonucleotide
ggaagaaaaugcuggaga

SEQ ID NO: 132738 - RNA, 18 nt, Artificial Sequence
  Description of Artificial Sequence: Synthetic oligonucleotide
ccguugaucccggagacg

SEQ ID NO: 132739 - RNA, 18 nt, Artificial Sequence
  Description of Artificial Sequence: Synthetic oligonucleotide
ugucgccguugaucccgg

SEQ ID NO: 132740 - RNA, 18 nt, Artificial Sequence
  Description of Artificial Sequence: Synthetic oligonucleotide
ccgaaugucgccguugau

SEQ ID NO: 132741 - RNA, 18 nt, Artificial Sequence
  Description of Artificial Sequence: Synthetic oligonucleotide
uucgcccgaaugucgccg

SEQ ID NO: 132742 - RNA, 18 nt, Artificial Sequence
  Description of Artificial Sequence: Synthetic oligonucleotide
ucuucuucgcccgaaugu

SEQ ID NO: 132743 - RNA, 18 nt, Artificial Sequence
  Description of Artificial Sequence: Synthetic oligonucleotide
ggcaaucuucuucgcccg

SEQ ID NO: 132744 - RNA, 18 nt, Artificial Sequence
  Description of Artificial Sequence: Synthetic oligonucleotide
augcuggcaaucuucuuc

SEQ ID NO: 132745 - RNA, 18 nt, Artificial Sequence
  Description of Artificial Sequence: Synthetic oligonucleotide
cugcgaugcuggcaaucu

SEQ ID NO: 132746 - RNA, 18 nt, Artificial Sequence
  Description of Artificial Sequence: Synthetic oligonucleotide
cacaucugcgaugcuggc

SEQ ID NO: 132747 - RNA, 18 nt, Artificial Sequence
  Description of Artificial Sequence: Synthetic oligonucleotide
ucacacacaucugcgaug

SEQ ID NO: 132748 - RNA, 18 nt, Artificial Sequence
  Description of Artificial Sequence: Synthetic oligonucleotide
uggacucacacacaucug

SEQ ID NO: 132749 - RNA, 18 nt, Artificial Sequence
  Description of Artificial Sequence: Synthetic oligonucleotide
cuucauggacucacacac

SEQ ID NO: 132750 - RNA, 18 nt, Artificial Sequence
  Description of Artificial Sequence: Synthetic oligonucleotide
ugcuccuucauggacuca

SEQ ID NO: 132751 - RNA, 18 nt, Artificial Sequence
  Description of Artificial Sequence: Synthetic oligonucleotide
gcagcugcuccuucaugg

SEQ ID NO: 132752 - RNA, 18 nt, Artificial Sequence
  Description of Artificial Sequence: Synthetic oligonucleotide
aaccagcagcugcuccuu

SEQ ID NO: 132753 - RNA, 18 nt, Artificial Sequence
  Description of Artificial Sequence: Synthetic oligonucleotide
acgagaaccagcagcugc

SEQ ID NO: 132754 - RNA, 18 nt, Artificial Sequence
  Description of Artificial Sequence: Synthetic oligonucleotide
acucaacgagaaccagca

SEQ ID NO: 132755 - RNA, 18 nt, Artificial Sequence
  Description of Artificial Sequence: Synthetic oligonucleotide
ggcccacucaacgagaac

SEQ ID NO: 132756 - RNA, 18 nt, Artificial Sequence
  Description of Artificial Sequence: Synthetic oligonucleotide
uacuuggcccacucaacg

SEQ ID NO: 132757 - RNA, 18 nt, Artificial Sequence
  Description of Artificial Sequence: Synthetic oligonucleotide
ggauguacuuggcccacu

SEQ ID NO: 132758 - RNA, 18 nt, Artificial Sequence
  Description of Artificial Sequence: Synthetic oligonucleotide
agcugggauguacuuggc

SEQ ID NO: 132759 - RNA, 18 nt, Artificial Sequence
  Description of Artificial Sequence: Synthetic oligonucleotide
cagaaagcugggauguac

SEQ ID NO: 132760 - RNA, 18 nt, Artificial Sequence
  Description of Artificial Sequence: Synthetic oligonucleotide
gcucgcagaaagcuggga

SEQ ID NO: 132761 - RNA, 18 nt, Artificial Sequence
  Description of Artificial Sequence: Synthetic oligonucleotide
gggagcucgcagaaagcu

SEQ ID NO: 132762 - RNA, 18 nt, Artificial Sequence
  Description of Artificial Sequence: Synthetic oligonucleotide
guugaucccggagacggg

SEQ ID NO: 132763 - RNA, 18 nt, Artificial Sequence
  Description of Artificial Sequence: Synthetic oligonucleotide
cguugaucccggagacgg

SEQ ID NO: 132764 - RNA, 18 nt, Artificial Sequence
  Description of Artificial Sequence: Synthetic oligonucleotide
gucgccguugaucccgga

SEQ ID NO: 132765 - RNA, 18 nt, Artificial Sequence
  Description of Artificial Sequence: Synthetic oligonucleotide
cgaaugucgccguugauc

SEQ ID NO: 132766 - RNA, 18 nt, Artificial Sequence
  Description of Artificial Sequence: Synthetic oligonucleotide
ucgcccgaaugucgccgu

SEQ ID NO: 132767 - RNA, 18 nt, Artificial Sequence
  Description of Artificial Sequence: Synthetic oligonucleotide
cuucuucgcccgaauguc

SEQ ID NO: 132768 - RNA, 18 nt, Artificial Sequence
  Description of Artificial Sequence: Synthetic oligonucleotide
gcaaucuucuucgcccga

SEQ ID NO: 132769 - RNA, 18 nt, Artificial Sequence
  Description of Artificial Sequence: Synthetic oligonucleotide
ugcuggcaaucuucuucg

SEQ ID NO: 132770 - RNA, 18 nt, Artificial Sequence
  Description of Artificial Sequence: Synthetic oligonucleotide
ugcgaugcuggcaaucuu

SEQ ID NO: 132771 - RNA, 18 nt, Artificial Sequence
  Description of Artificial Sequence: Synthetic oligonucleotide
acaucugcgaugcuggca

SEQ ID NO: 132772 - RNA, 18 nt, Artificial Sequence
  Description of Artificial Sequence: Synthetic oligonucleotide
cacacacaucugcgaugc

SEQ ID NO: 132773 - RNA, 18 nt, Artificial Sequence
  Description of Artificial Sequence: Synthetic oligonucleotide
ggacucacacacaucugc

SEQ ID NO: 132774 - RNA, 18 nt, Artificial Sequence
  Description of Artificial Sequence: Synthetic oligonucleotide
uucauggacucacacaca

SEQ ID NO: 132775 - RNA, 18 nt, Artificial Sequence
  Description of Artificial Sequence: Synthetic oligonucleotide
gcuccuucauggacucac

SEQ ID NO: 132776 - RNA, 18 nt, Artificial Sequence
  Description of Artificial Sequence: Synthetic oligonucleotide
cagcugcuccuucaugga

SEQ ID NO: 132777 - RNA, 18 nt, Artificial Sequence
  Description of Artificial Sequence: Synthetic oligonucleotide
accagcagcugcuccuuc

SEQ ID NO: 132778 - RNA, 18 nt, Artificial Sequence
  Description of Artificial Sequence: Synthetic oligonucleotide
cgagaaccagcagcugcu

SEQ ID NO: 132779 - RNA, 18 nt, Artificial Sequence
  Description of Artificial Sequence: Synthetic oligonucleotide
cucaacgagaaccagcag

SEQ ID NO: 132780 - RNA, 18 nt, Artificial Sequence
  Description of Artificial Sequence: Synthetic oligonucleotide
gcccacucaacgagaacc

SEQ ID NO: 132781 - RNA, 18 nt, Artificial Sequence
  Description of Artificial Sequence: Synthetic oligonucleotide
acuuggcccacucaacga

SEQ ID NO: 132782 - RNA, 18 nt, Artificial Sequence
  Description of Artificial Sequence: Synthetic oligonucleotide
gauguacuuggcccacuc

SEQ ID NO: 132783 - RNA, 18 nt, Artificial Sequence
  Description of Artificial Sequence: Synthetic oligonucleotide
gcugggauguacuuggcc

SEQ ID NO: 132784 - RNA, 18 nt, Artificial Sequence
  Description of Artificial Sequence: Synthetic oligonucleotide
agaaagcugggauguacu

SEQ ID NO: 132785 - RNA, 18 nt, Artificial Sequence
  Description of Artificial Sequence: Synthetic oligonucleotide
cucgcagaaagcugggau

SEQ ID NO: 132786 - RNA, 18 nt, Artificial Sequence
  Description of Artificial Sequence: Synthetic oligonucleotide
gggagcucgcagaaagcu

SEQ ID NO: 132787 - RNA, 18 nt, Artificial Sequence
  Description of Artificial Sequence: Synthetic oligonucleotide
ccaccauccacgcccauc

SEQ ID NO: 132788 - RNA, 18 nt, Artificial Sequence
  Description of Artificial Sequence: Synthetic oligonucleotide
acugcccaccauccacgc

SEQ ID NO: 132789 - RNA, 18 nt, Artificial Sequence
  Description of Artificial Sequence: Synthetic oligonucleotide
ccacuacugcccaccauc

SEQ ID NO: 132790 - RNA, 18 nt, Artificial Sequence
  Description of Artificial Sequence: Synthetic oligonucleotide
acugcccacuacugccca

SEQ ID NO: 132791 - RNA, 18 nt, Artificial Sequence
  Description of Artificial Sequence: Synthetic oligonucleotide
cgcccacugcccacuacu

SEQ ID NO: 132792 - RNA, 18 nt, Artificial Sequence
  Description of Artificial Sequence: Synthetic oligonucleotide
ugccccgcccacugccca

SEQ ID NO: 132793 - RNA, 18 nt, Artificial Sequence
  Description of Artificial Sequence: Synthetic oligonucleotide
cuggcugccccgcccacu

SEQ ID NO: 132794 - RNA, 18 nt, Artificial Sequence
  Description of Artificial Sequence: Synthetic oligonucleotide
gcccccuggcugccccgc

SEQ ID NO: 132795 - RNA, 18 nt, Artificial Sequence
  Description of Artificial Sequence: Synthetic oligonucleotide
cagcagcccccuggcugc

SEQ ID NO: 132796 - RNA, 18 nt, Artificial Sequence
  Description of Artificial Sequence: Synthetic oligonucleotide
ugggccagcagcccccug

SEQ ID NO: 132797 - RNA, 18 nt, Artificial Sequence
  Description of Artificial Sequence: Synthetic oligonucleotide
ccaggugggccagcagcc

SEQ ID NO: 132798 - RNA, 18 nt, Artificial Sequence
  Description of Artificial Sequence: Synthetic oligonucleotide
auaucccaggugggccag

SEQ ID NO: 132799 - RNA, 18 nt, Artificial Sequence
  Description of Artificial Sequence: Synthetic oligonucleotide
cggcuauaucccaggugg

SEQ ID NO: 132800 - RNA, 18 nt, Artificial Sequence
  Description of Artificial Sequence: Synthetic oligonucleotide
guccacggcuauauccca

SEQ ID NO: 132801 - RNA, 18 nt, Artificial Sequence
  Description of Artificial Sequence: Synthetic oligonucleotide
agccaguccacggcuaua

SEQ ID NO: 132802 - RNA, 18 nt, Artificial Sequence
  Description of Artificial Sequence: Synthetic oligonucleotide
aaucaagccaguccacgg

SEQ ID NO: 132803 - RNA, 18 nt, Artificial Sequence
  Description of Artificial Sequence: Synthetic oligonucleotide
aauaaaaucaagccaguc

SEQ ID NO: 132804 - RNA, 18 nt, Artificial Sequence
  Description of Artificial Sequence: Synthetic oligonucleotide
aauaaaauaaaaucaagc

SEQ ID NO: 132805 - RNA, 18 nt, Artificial Sequence
  Description of Artificial Sequence: Synthetic oligonucleotide
uguuaaauaaaauaaaau

SEQ ID NO: 132806 - RNA, 18 nt, Artificial Sequence
  Description of Artificial Sequence: Synthetic oligonucleotide
uauuuuguuaaauaaaau

SEQ ID NO: 132807 - RNA, 18 nt, Artificial Sequence
  Description of Artificial Sequence: Synthetic oligonucleotide
cuacauauuuuguuaaau

SEQ ID NO: 132808 - RNA, 18 nt, Artificial Sequence
  Description of Artificial Sequence: Synthetic oligonucleotide
gugcacuacauauuuugu

SEQ ID NO: 132809 - RNA, 18 nt, Artificial Sequence
  Description of Artificial Sequence: Synthetic oligonucleotide
cgugugugcacuacauau

SEQ ID NO: 132810 - RNA, 18 nt, Artificial Sequence
  Description of Artificial Sequence: Synthetic oligonucleotide
agacacgugugugcacua

SEQ ID NO: 132811 - RNA, 18 nt, Artificial Sequence
  Description of Artificial Sequence: Synthetic oligonucleotide
guuucagacacgugugug

SEQ ID NO: 132812 - RNA, 18 nt, Artificial Sequence
  Description of Artificial Sequence: Synthetic oligonucleotide
uuaaaguuucagacacgu

SEQ ID NO: 132813 - RNA, 18 nt, Artificial Sequence
  Description of Artificial Sequence: Synthetic oligonucleotide
gugauuuaaaguuucaga

SEQ ID NO: 132814 - RNA, 18 nt, Artificial Sequence
  Description of Artificial Sequence: Synthetic oligonucleotide
guaaggugauuuaaaguu

SEQ ID NO: 132815 - RNA, 18 nt, Artificial Sequence
  Description of Artificial Sequence: Synthetic oligonucleotide
uauuuguaaggugauuua

SEQ ID NO: 132816 - RNA, 18 nt, Artificial Sequence
  Description of Artificial Sequence: Synthetic oligonucleotide
guuaauauuuguaaggug

SEQ ID NO: 132817 - RNA, 18 nt, Artificial Sequence
  Description of Artificial Sequence: Synthetic oligonucleotide
acugaguuaauauuugua

SEQ ID NO: 132818 - RNA, 18 nt, Artificial Sequence
  Description of Artificial Sequence: Synthetic oligonucleotide
agcuaacugaguuaauau

SEQ ID NO: 132819 - RNA, 18 nt, Artificial Sequence
  Description of Artificial Sequence: Synthetic oligonucleotide
ggaggagcuaacugaguu

SEQ ID NO: 132820 - RNA, 18 nt, Artificial Sequence
  Description of Artificial Sequence: Synthetic oligonucleotide
uuguuggaggagcuaacu

SEQ ID NO: 132821 - RNA, 18 nt, Artificial Sequence
  Description of Artificial Sequence: Synthetic oligonucleotide
uagaguuguuggaggagc

SEQ ID NO: 132822 - RNA, 18 nt, Artificial Sequence
  Description of Artificial Sequence: Synthetic oligonucleotide
ccucauagaguuguugga

SEQ ID NO: 132823 - RNA, 18 nt, Artificial Sequence
  Description of Artificial Sequence: Synthetic oligonucleotide
accuaccucauagaguug

SEQ ID NO: 132824 - RNA, 18 nt, Artificial Sequence
  Description of Artificial Sequence: Synthetic oligonucleotide
uuaguaccuaccucauag

SEQ ID NO: 132825 - RNA, 18 nt, Artificial Sequence
  Description of Artificial Sequence: Synthetic oligonucleotide
guaccuuaguaccuaccu

SEQ ID NO: 132826 - RNA, 18 nt, Artificial Sequence
  Description of Artificial Sequence: Synthetic oligonucleotide
uaauaguaccuuaguacc

SEQ ID NO: 132827 - RNA, 18 nt, Artificial Sequence
  Description of Artificial Sequence: Synthetic oligonucleotide
aguaauaauaguaccuua

SEQ ID NO: 132828 - RNA, 18 nt, Artificial Sequence
  Description of Artificial Sequence: Synthetic oligonucleotide
auggcaguaauaauagua

SEQ ID NO: 132829 - RNA, 18 nt, Artificial Sequence
  Description of Artificial Sequence: Synthetic oligonucleotide
augagauggcaguaauaa

SEQ ID NO: 132830 - RNA, 18 nt, Artificial Sequence
  Description of Artificial Sequence: Synthetic oligonucleotide
caccuaugagauggcagu

SEQ ID NO: 132831 - RNA, 18 nt, Artificial Sequence
  Description of Artificial Sequence: Synthetic oligonucleotide
cuccucaccuaugagaug

SEQ ID NO: 132832 - RNA, 18 nt, Artificial Sequence
  Description of Artificial Sequence: Synthetic oligonucleotide
ccaaucuccucaccuaug

SEQ ID NO: 132833 - RNA, 18 nt, Artificial Sequence
  Description of Artificial Sequence: Synthetic oligonucleotide
gugccccaaucuccucac

SEQ ID NO: 132834 - RNA, 18 nt, Artificial Sequence
  Description of Artificial Sequence: Synthetic oligonucleotide
ucucugugccccaaucuc

SEQ ID NO: 132835 - RNA, 18 nt, Artificial Sequence
  Description of Artificial Sequence: Synthetic oligonucleotide
uaaccucucugugcccca

SEQ ID NO: 132836 - RNA, 18 nt, Artificial Sequence
  Description of Artificial Sequence: Synthetic oligonucleotide
uuacuuaaccucucugug

SEQ ID NO: 132837 - RNA, 18 nt, Artificial Sequence
  Description of Artificial Sequence: Synthetic oligonucleotide
gcagguuacuuaaccucu

SEQ ID NO: 132838 - RNA, 18 nt, Artificial Sequence
  Description of Artificial Sequence: Synthetic oligonucleotide
cuugagcagguuacuuaa

SEQ ID NO: 132839 - RNA, 18 nt, Artificial Sequence
  Description of Artificial Sequence: Synthetic oligonucleotide
gugaccuugagcagguua

SEQ ID NO: 132840 - RNA, 18 nt, Artificial Sequence
  Description of Artificial Sequence: Synthetic oligonucleotide
gcuaugugaccuugagca

SEQ ID NO: 132841 - RNA, 18 nt, Artificial Sequence
  Description of Artificial Sequence: Synthetic oligonucleotide
uaguagcuaugugaccuu

SEQ ID NO: 132842 - RNA, 18 nt, Artificial Sequence
  Description of Artificial Sequence: Synthetic oligonucleotide
cuggauaguagcuaugug

SEQ ID NO: 132843 - RNA, 18 nt, Artificial Sequence
  Description of Artificial Sequence: Synthetic oligonucleotide
cuaugcuggauaguagcu

SEQ ID NO: 132844 - RNA, 18 nt, Artificial Sequence
  Description of Artificial Sequence: Synthetic oligonucleotide
cccagcuaugcuggauag

SEQ ID NO: 132845 - RNA, 18 nt, Artificial Sequence
  Description of Artificial Sequence: Synthetic oligonucleotide
cuaaucccagcuaugcug

SEQ ID NO: 132846 - RNA, 18 nt, Artificial Sequence
  Description of Artificial Sequence: Synthetic oligonucleotide
agguucuaaucccagcua

SEQ ID NO: 132847 - RNA, 18 nt, Artificial Sequence
  Description of Artificial Sequence: Synthetic oligonucleotide
cugccagguucuaauccc

SEQ ID NO: 132848 - RNA, 18 nt, Artificial Sequence
  Description of Artificial Sequence: Synthetic oligonucleotide
gcuuccugccagguucua

SEQ ID NO: 132849 - RNA, 18 nt, Artificial Sequence
  Description of Artificial Sequence: Synthetic oligonucleotide
uuggagcuuccugccagg

SEQ ID NO: 132850 - RNA, 18 nt, Artificial Sequence
  Description of Artificial Sequence: Synthetic oligonucleotide
ggacuuuggagcuuccug

SEQ ID NO: 132851 - RNA, 18 nt, Artificial Sequence
  Description of Artificial Sequence: Synthetic oligonucleotide
agcuuggacuuuggagcu

SEQ ID NO: 132852 - RNA, 18 nt, Artificial Sequence
  Description of Artificial Sequence: Synthetic oligonucleotide
ucaggagcuuggacuuug

SEQ ID NO: 132853 - RNA, 18 nt, Artificial Sequence
  Description of Artificial Sequence: Synthetic oligonucleotide
aauggucaggagcuugga

SEQ ID NO: 132854 - RNA, 18 nt, Artificial Sequence
  Description of Artificial Sequence: Synthetic oligonucleotide
gguacaauggucaggagc

SEQ ID NO: 132855 - RNA, 18 nt, Artificial Sequence
  Description of Artificial Sequence: Synthetic oligonucleotide
ccucagguacaaugguca

SEQ ID NO: 132856 - RNA, 18 nt, Artificial Sequence
  Description of Artificial Sequence: Synthetic oligonucleotide
gagagccucagguacaau

SEQ ID NO: 132857 - RNA, 18 nt, Artificial Sequence
  Description of Artificial Sequence: Synthetic oligonucleotide
ccugggagagccucaggu

SEQ ID NO: 132858 - RNA, 18 nt, Artificial Sequence
  Description of Artificial Sequence: Synthetic oligonucleotide
aucccccugggagagccu

SEQ ID NO: 132859 - RNA, 18 nt, Artificial Sequence
  Description of Artificial Sequence: Synthetic oligonucleotide
ucaacaucccccugggag

SEQ ID NO: 132860 - RNA, 18 nt, Artificial Sequence
  Description of Artificial Sequence: Synthetic oligonucleotide
cccugucaacaucccccu

SEQ ID NO: 132861 - RNA, 18 nt, Artificial Sequence
  Description of Artificial Sequence: Synthetic oligonucleotide
agggucccugucaacauc

SEQ ID NO: 132862 - RNA, 18 nt, Artificial Sequence
  Description of Artificial Sequence: Synthetic oligonucleotide
guccuagggucccuguca

SEQ ID NO: 132863 - RNA, 18 nt, Artificial Sequence
  Description of Artificial Sequence: Synthetic oligonucleotide
ucccuguccuaggguccc

SEQ ID NO: 132864 - RNA, 18 nt, Artificial Sequence
  Description of Artificial Sequence: Synthetic oligonucleotide
ccugaucccuguccuagg

SEQ ID NO: 132865 - RNA, 18 nt, Artificial Sequence
  Description of Artificial Sequence: Synthetic oligonucleotide
aaucuccugaucccuguc

SEQ ID NO: 132866 - RNA, 18 nt, Artificial Sequence
  Description of Artificial Sequence: Synthetic oligonucleotide
gccaaaaucuccugaucc

SEQ ID NO: 132867 - RNA, 18 nt, Artificial Sequence
  Description of Artificial Sequence: Synthetic oligonucleotide
cuuaagccaaaaucuccu

SEQ ID NO: 132868 - RNA, 18 nt, Artificial Sequence
  Description of Artificial Sequence: Synthetic oligonucleotide
cauagcuuaagccaaaau

SEQ ID NO: 132869 - RNA, 18 nt, Artificial Sequence
  Description of Artificial Sequence: Synthetic oligonucleotide
agagccauagcuuaagcc

SEQ ID NO: 132870 - RNA, 18 nt, Artificial Sequence
  Description of Artificial Sequence: Synthetic oligonucleotide
gucuuagagccauagcuu

SEQ ID NO: 132871 - RNA, 18 nt, Artificial Sequence
  Description of Artificial Sequence: Synthetic oligonucleotide
aaccagucuuagagccau

SEQ ID NO: 132872 - RNA, 18 nt, Artificial Sequence
  Description of Artificial Sequence: Synthetic oligonucleotide
cagacaaccagucuuaga

SEQ ID NO: 132873 - RNA, 18 nt, Artificial Sequence
  Description of Artificial Sequence: Synthetic oligonucleotide
uuaggcagacaaccaguc

SEQ ID NO: 132874 - RNA, 18 nt, Artificial Sequence
  Description of Artificial Sequence: Synthetic oligonucleotide
caggauuaggcagacaac

SEQ ID NO: 132875 - RNA, 18 nt, Artificial Sequence
  Description of Artificial Sequence: Synthetic oligonucleotide
uugcccaggauuaggcag

SEQ ID NO: 132876 - RNA, 18 nt, Artificial Sequence
  Description of Artificial Sequence: Synthetic oligonucleotide
cucauuugcccaggauua

SEQ ID NO: 132877 - RNA, 18 nt, Artificial Sequence
  Description of Artificial Sequence: Synthetic oligonucleotide
aggaacucauuugcccag

SEQ ID NO: 132878 - RNA, 18 nt, Artificial Sequence
  Description of Artificial Sequence: Synthetic oligonucleotide
gagagaggaacucauuug

SEQ ID NO: 132879 - RNA, 18 nt, Artificial Sequence
  Description of Artificial Sequence: Synthetic oligonucleotide
gcucagagagaggaacuc

SEQ ID NO: 132880 - RNA, 18 nt, Artificial Sequence
  Description of Artificial Sequence: Synthetic oligonucleotide
cugaggcucagagagagg

SEQ ID NO: 132881 - RNA, 18 nt, Artificial Sequence
  Description of Artificial Sequence: Synthetic oligonucleotide
gaacacugaggcucagag

SEQ ID NO: 132882 - RNA, 18 nt, Artificial Sequence
  Description of Artificial Sequence: Synthetic oligonucleotide
uaagagaacacugaggcu

SEQ ID NO: 132883 - RNA, 18 nt, Artificial Sequence
  Description of Artificial Sequence: Synthetic oligonucleotide
acagauaagagaacacug

SEQ ID NO: 132884 - RNA, 18 nt, Artificial Sequence
  Description of Artificial Sequence: Synthetic oligonucleotide
acuuuacagauaagagaa

SEQ ID NO: 132885 - RNA, 18 nt, Artificial Sequence
  Description of Artificial Sequence: Synthetic oligonucleotide
uuuccacuuuacagauaa

SEQ ID NO: 132886 - RNA, 18 nt, Artificial Sequence
  Description of Artificial Sequence: Synthetic oligonucleotide
augaucucggcucacugc

SEQ ID NO: 132887 - RNA, 18 nt, Artificial Sequence
  Description of Artificial Sequence: Synthetic oligonucleotide
guggcaugaucucggcuc

SEQ ID NO: 132888 - RNA, 18 nt, Artificial Sequence
  Description of Artificial Sequence: Synthetic oligonucleotide
gugcaguggcaugaucuc

SEQ ID NO: 132889 - RNA, 18 nt, Artificial Sequence
  Description of Artificial Sequence: Synthetic oligonucleotide
cuggagugcaguggcaug

SEQ ID NO: 132890 - RNA, 18 nt, Artificial Sequence
  Description of Artificial Sequence: Synthetic oligonucleotide
ccaggcuggagugcagug

SEQ ID NO: 132891 - RNA, 18 nt, Artificial Sequence
  Description of Artificial Sequence: Synthetic oligonucleotide
gucacccaggcuggagug

SEQ ID NO: 132892 - RNA, 18 nt, Artificial Sequence
  Description of Artificial Sequence: Synthetic oligonucleotide
acucugucacccaggcug

SEQ ID NO: 132893 - RNA, 18 nt, Artificial Sequence
  Description of Artificial Sequence: Synthetic oligonucleotide
gucucacucugucaccca

SEQ ID NO: 132894 - RNA, 18 nt, Artificial Sequence
  Description of Artificial Sequence: Synthetic oligonucleotide
acagagucucacucuguc

SEQ ID NO: 132895 - RNA, 18 nt, Artificial Sequence
  Description of Artificial Sequence: Synthetic oligonucleotide
uugagacagagucucacu

SEQ ID NO: 132896 - RNA, 18 nt, Artificial Sequence
  Description of Artificial Sequence: Synthetic oligonucleotide
uuuuuuugagacagaguc

SEQ ID NO: 132897 - RNA, 18 nt, Artificial Sequence
  Description of Artificial Sequence: Synthetic oligonucleotide
uuuuuuuuuuuugagaca

SEQ ID NO: 132898 - RNA, 18 nt, Artificial Sequence
  Description of Artificial Sequence: Synthetic oligonucleotide
uuuuuuuuuuuuuuuuug

SEQ ID NO: 132899 - RNA, 18 nt, Artificial Sequence
  Description of Artificial Sequence: Synthetic oligonucleotide
uucuauuuuuuuuuuuuu

SEQ ID NO: 132900 - RNA, 18 nt, Artificial Sequence
  Description of Artificial Sequence: Synthetic oligonucleotide
acagauucuauuuuuuuu

SEQ ID NO: 132901 - RNA, 18 nt, Artificial Sequence
  Description of Artificial Sequence: Synthetic oligonucleotide
aaaauacagauucuauuu

SEQ ID NO: 132902 - RNA, 18 nt, Artificial Sequence
  Description of Artificial Sequence: Synthetic oligonucleotide
uuguaaaaauacagauuc

SEQ ID NO: 132903 - RNA, 18 nt, Artificial Sequence
  Description of Artificial Sequence: Synthetic oligonucleotide
gugcuuuguaaaaauaca

SEQ ID NO: 132904 - RNA, 18 nt, Artificial Sequence
  Description of Artificial Sequence: Synthetic oligonucleotide
gaagggugcuuuguaaaa

SEQ ID NO: 132905 - RNA, 18 nt, Artificial Sequence
  Description of Artificial Sequence: Synthetic oligonucleotide
auuaugaagggugcuuug

SEQ ID NO: 132906 - RNA, 18 nt, Artificial Sequence
  Description of Artificial Sequence: Synthetic oligonucleotide
ggagaauuaugaagggug

SEQ ID NO: 132907 - RNA, 18 nt, Artificial Sequence
  Description of Artificial Sequence: Synthetic oligonucleotide
gcuauggagaauuaugaa

SEQ ID NO: 132908 - RNA, 18 nt, Artificial Sequence
  Description of Artificial Sequence: Synthetic oligonucleotide
gaccagcuauggagaauu

SEQ ID NO: 132909 - RNA, 18 nt, Artificial Sequence
  Description of Artificial Sequence: Synthetic oligonucleotide
ccauggaccagcuaugga

SEQ ID NO: 132910 - RNA, 18 nt, Artificial Sequence
  Description of Artificial Sequence: Synthetic oligonucleotide
cccacccauggaccagcu

SEQ ID NO: 132911 - RNA, 18 nt, Artificial Sequence
  Description of Artificial Sequence: Synthetic oligonucleotide
aaauucccacccauggac

SEQ ID NO: 132912 - RNA, 18 nt, Artificial Sequence
  Description of Artificial Sequence: Synthetic oligonucleotide
gucccaaauucccaccca

SEQ ID NO: 132913 - RNA, 18 nt, Artificial Sequence
  Description of Artificial Sequence: Synthetic oligonucleotide
ugugggucccaaauuccc

SEQ ID NO: 132914 - RNA, 18 nt, Artificial Sequence
  Description of Artificial Sequence: Synthetic oligonucleotide
aaaacugugggucccaaa

SEQ ID NO: 132915 - RNA, 18 nt, Artificial Sequence
  Description of Artificial Sequence: Synthetic oligonucleotide
guuccaaaacuguggguc

SEQ ID NO: 132916 - RNA, 18 nt, Artificial Sequence
  Description of Artificial Sequence: Synthetic oligonucleotide
aaaaaguuccaaaacugu

SEQ ID NO: 132917 - RNA, 18 nt, Artificial Sequence
  Description of Artificial Sequence: Synthetic oligonucleotide
aucccaaaaaguuccaaa

SEQ ID NO: 132918 - RNA, 18 nt, Artificial Sequence
  Description of Artificial Sequence: Synthetic oligonucleotide
cuaugaucccaaaaaguu

SEQ ID NO: 132919 - RNA, 18 nt, Artificial Sequence
  Description of Artificial Sequence: Synthetic oligonucleotide
aaggucuaugaucccaaa

SEQ ID NO: 132920 - RNA, 18 nt, Artificial Sequence
  Description of Artificial Sequence: Synthetic oligonucleotide
ucaaaaaggucuaugauc

SEQ ID NO: 132921 - RNA, 18 nt, Artificial Sequence
  Description of Artificial Sequence: Synthetic oligonucleotide
gauucucaaaaaggucua

SEQ ID NO: 132922 - RNA, 18 nt, Artificial Sequence
  Description of Artificial Sequence: Synthetic oligonucleotide
uuugagauucucaaaaag

SEQ ID NO: 132923 - RNA, 18 nt, Artificial Sequence
  Description of Artificial Sequence: Synthetic oligonucleotide
ucuuuuuugagauucuca

SEQ ID NO: 132924 - RNA, 18 nt, Artificial Sequence
  Description of Artificial Sequence: Synthetic oligonucleotide
uuuuuucuuuuuugagau

SEQ ID NO: 132925 - RNA, 18 nt, Artificial Sequence
  Description of Artificial Sequence: Synthetic oligonucleotide
gcuuuuuuuuucuuuuuu

SEQ ID NO: 132926 - RNA, 18 nt, Artificial Sequence
  Description of Artificial Sequence: Synthetic oligonucleotide
ugugugcuuuuuuuuucu

SEQ ID NO: 132927 - RNA, 18 nt, Artificial Sequence
  Description of Artificial Sequence: Synthetic oligonucleotide
cauucugugugcuuuuuu

SEQ ID NO: 132928 - RNA, 18 nt, Artificial Sequence
  Description of Artificial Sequence: Synthetic oligonucleotide
agcaacauucugugugcu

SEQ ID NO: 132929 - RNA, 18 nt, Artificial Sequence
  Description of Artificial Sequence: Synthetic oligonucleotide
cuguaagcaacauucugu

SEQ ID NO: 132930 - RNA, 18 nt, Artificial Sequence
  Description of Artificial Sequence: Synthetic oligonucleotide
ugaaacuguaagcaacau

SEQ ID NO: 132931 - RNA, 18 nt, Artificial Sequence
  Description of Artificial Sequence: Synthetic oligonucleotide
ccugaugaaacuguaagc

SEQ ID NO: 132932 - RNA, 18 nt, Artificial Sequence
  Description of Artificial Sequence: Synthetic oligonucleotide
gugugccugaugaaacug

SEQ ID NO: 132933 - RNA, 18 nt, Artificial Sequence
  Description of Artificial Sequence: Synthetic oligonucleotide
cuucugugugccugauga

SEQ ID NO: 132934 - RNA, 18 nt, Artificial Sequence
  Description of Artificial Sequence: Synthetic oligonucleotide
ggccucuucugugugccu

SEQ ID NO: 132935 - RNA, 18 nt, Artificial Sequence
  Description of Artificial Sequence: Synthetic oligonucleotide
ugcugggccucuucugug

SEQ ID NO: 132936 - RNA, 18 nt, Artificial Sequence
  Description of Artificial Sequence: Synthetic oligonucleotide
cuucgugcugggccucuu

SEQ ID NO: 132937 - RNA, 18 nt, Artificial Sequence
  Description of Artificial Sequence: Synthetic oligonucleotide
aacugcuucgugcugggc

SEQ ID NO: 132938 - RNA, 18 nt, Artificial Sequence
  Description of Artificial Sequence: Synthetic oligonucleotide
caagaaacugcuucgugc

SEQ ID NO: 132939 - RNA, 18 nt, Artificial Sequence
  Description of Artificial Sequence: Synthetic oligonucleotide
uugggcaagaaacugcuu

SEQ ID NO: 132940 - RNA, 18 nt, Artificial Sequence
  Description of Artificial Sequence: Synthetic oligonucleotide
uguccuugggcaagaaac

SEQ ID NO: 132941 - RNA, 18 nt, Artificial Sequence
  Description of Artificial Sequence: Synthetic oligonucleotide
ugcuguguccuugggcaa

SEQ ID NO: 132942 - RNA, 18 nt, Artificial Sequence
  Description of Artificial Sequence: Synthetic oligonucleotide
ugaacugcuguguccuug

SEQ ID NO: 132943 - RNA, 18 nt, Artificial Sequence
  Description of Artificial Sequence: Synthetic oligonucleotide
guccuugaacugcugugu

SEQ ID NO: 132944 - RNA, 18 nt, Artificial Sequence
  Description of Artificial Sequence: Synthetic oligonucleotide
acucuguccuugaacugc

SEQ ID NO: 132945 - RNA, 18 nt, Artificial Sequence
  Description of Artificial Sequence: Synthetic oligonucleotide
cgcugacucuguccuuga

SEQ ID NO: 132946 - RNA, 18 nt, Artificial Sequence
  Description of Artificial Sequence: Synthetic oligonucleotide
ccucgcgcugacucuguc

SEQ ID NO: 132947 - RNA, 18 nt, Artificial Sequence
  Description of Artificial Sequence: Synthetic oligonucleotide
agagaccucgcgcugacu

SEQ ID NO: 132948 - RNA, 18 nt, Artificial Sequence
  Description of Artificial Sequence: Synthetic oligonucleotide
agcugagagaccucgcgc

SEQ ID NO: 132949 - RNA, 18 nt, Artificial Sequence
  Description of Artificial Sequence: Synthetic oligonucleotide
cucagagcugagagaccu

SEQ ID NO: 132950 - RNA, 18 nt, Artificial Sequence
  Description of Artificial Sequence: Synthetic oligonucleotide
augugcucagagcugaga

SEQ ID NO: 132951 - RNA, 18 nt, Artificial Sequence
  Description of Artificial Sequence: Synthetic oligonucleotide
agaacaugugcucagagc

SEQ ID NO: 132952 - RNA, 18 nt, Artificial Sequence
  Description of Artificial Sequence: Synthetic oligonucleotide
gggaaagaacaugugcuc

SEQ ID NO: 132953 - RNA, 18 nt, Artificial Sequence
  Description of Artificial Sequence: Synthetic oligonucleotide
acuagaaaccuggaaggg

SEQ ID NO: 132954 - RNA, 18 nt, Artificial Sequence
  Description of Artificial Sequence: Synthetic oligonucleotide
aaaacuagaaaccuggaa

SEQ ID NO: 132955 - RNA, 18 nt, Artificial Sequence
  Description of Artificial Sequence: Synthetic oligonucleotide
cccauaaaacuagaaacc

SEQ ID NO: 132956 - RNA, 18 nt, Artificial Sequence
  Description of Artificial Sequence: Synthetic oligonucleotide
uacuacccauaaaacuag

SEQ ID NO: 132957 - RNA, 18 nt, Artificial Sequence
  Description of Artificial Sequence: Synthetic oligonucleotide
aaaacuacuacccauaaa

SEQ ID NO: 132958 - RNA, 18 nt, Artificial Sequence
  Description of Artificial Sequence: Synthetic oligonucleotide
aucauaaaacuacuaccc

SEQ ID NO: 132959 - RNA, 18 nt, Artificial Sequence
  Description of Artificial Sequence: Synthetic oligonucleotide
ugggcaucauaaaacuac

SEQ ID NO: 132960 - RNA, 18 nt, Artificial Sequence
  Description of Artificial Sequence: Synthetic oligonucleotide
ugaaaugggcaucauaaa

SEQ ID NO: 132961 - RNA, 18 nt, Artificial Sequence
  Description of Artificial Sequence: Synthetic oligonucleotide
aacugugaaaugggcauc

SEQ ID NO: 132962 - RNA, 18 nt, Artificial Sequence
  Description of Artificial Sequence: Synthetic oligonucleotide
gccugaacugugaaaugg

SEQ ID NO: 132963 - RNA, 18 nt, Artificial Sequence
  Description of Artificial Sequence: Synthetic oligonucleotide
uaccugccugaacuguga

SEQ ID NO: 132964 - RNA, 18 nt, Artificial Sequence
  Description of Artificial Sequence: Synthetic oligonucleotide
gccucuaccugccugaac

SEQ ID NO: 132965 - RNA, 18 nt, Artificial Sequence
  Description of Artificial Sequence: Synthetic oligonucleotide
ccucugccucuaccugcc

SEQ ID NO: 132966 - RNA, 18 nt, Artificial Sequence
  Description of Artificial Sequence: Synthetic oligonucleotide
gcuccccucugccucuac

SEQ ID NO: 132967 - RNA, 18 nt, Artificial Sequence
  Description of Artificial Sequence: Synthetic oligonucleotide
uuaaugcuccccucugcc

SEQ ID NO: 132968 - RNA, 18 nt, Artificial Sequence
  Description of Artificial Sequence: Synthetic oligonucleotide
ucagcuuaaugcuccccu

SEQ ID NO: 132969 - RNA, 18 nt, Artificial Sequence
  Description of Artificial Sequence: Synthetic oligonucleotide
gcaagucagcuuaaugcu

SEQ ID NO: 132970 - RNA, 18 nt, Artificial Sequence
  Description of Artificial Sequence: Synthetic oligonucleotide
gcugggcaagucagcuua

SEQ ID NO: 132971 - RNA, 18 nt, Artificial Sequence
  Description of Artificial Sequence: Synthetic oligonucleotide
gugacgcugggcaaguca

SEQ ID NO: 132972 - RNA, 18 nt, Artificial Sequence
  Description of Artificial Sequence: Synthetic oligonucleotide
acucagugacgcugggca

SEQ ID NO: 132973 - RNA, 18 nt, Artificial Sequence
  Description of Artificial Sequence: Synthetic oligonucleotide
agccaacucagugacgcu

SEQ ID NO: 132974 - RNA, 18 nt, Artificial Sequence
  Description of Artificial Sequence: Synthetic oligonucleotide
cccguagccaacucagug

SEQ ID NO: 132975 - RNA, 18 nt, Artificial Sequence
  Description of Artificial Sequence: Synthetic oligonucleotide
ggcugcccguagccaacu

SEQ ID NO: 132976 - RNA, 18 nt, Artificial Sequence
  Description of Artificial Sequence: Synthetic oligonucleotide
gggaaggcugcccguagc

SEQ ID NO: 132977 - RNA, 18 nt, Artificial Sequence
  Description of Artificial Sequence: Synthetic oligonucleotide
cccuugggaaggcugccc

SEQ ID NO: 132978 - RNA, 18 nt, Artificial Sequence
  Description of Artificial Sequence: Synthetic oligonucleotide
cuguacccuugggaaggc

SEQ ID NO: 132979 - RNA, 18 nt, Artificial Sequence
  Description of Artificial Sequence: Synthetic oligonucleotide
gccaucuguacccuuggg

SEQ ID NO: 132980 - RNA, 18 nt, Artificial Sequence
  Description of Artificial Sequence: Synthetic oligonucleotide
uguuugccaucuguaccc

SEQ ID NO: 132981 - RNA, 18 nt, Artificial Sequence
  Description of Artificial Sequence: Synthetic oligonucleotide
aacaguguuugccaucug

SEQ ID NO: 132982 - RNA, 18 nt, Artificial Sequence
  Description of Artificial Sequence: Synthetic oligonucleotide
gggcucugagcagggcca

SEQ ID NO: 132983 - RNA, 18 nt, Artificial Sequence
  Description of Artificial Sequence: Synthetic oligonucleotide
agcaugggcucugagcag

SEQ ID NO: 132984 - RNA, 18 nt, Artificial Sequence
  Description of Artificial Sequence: Synthetic oligonucleotide
ucgccagcaugggcucug

SEQ ID NO: 132985 - RNA, 18 nt, Artificial Sequence
  Description of Artificial Sequence: Synthetic oligonucleotide
ggugcucgccagcauggg

SEQ ID NO: 132986 - RNA, 18 nt, Artificial Sequence
  Description of Artificial Sequence: Synthetic oligonucleotide
cagcaggugcucgccagc

SEQ ID NO: 132987 - RNA, 18 nt, Artificial Sequence
  Description of Artificial Sequence: Synthetic oligonucleotide
ccgagcagcaggugcucg

SEQ ID NO: 132988 - RNA, 18 nt, Artificial Sequence
  Description of Artificial Sequence: Synthetic oligonucleotide
uggcuccgagcagcaggu

SEQ ID NO: 132989 - RNA, 18 nt, Artificial Sequence
  Description of Artificial Sequence: Synthetic oligonucleotide
cuugguggcuccgagcag

SEQ ID NO: 132990 - RNA, 18 nt, Artificial Sequence
  Description of Artificial Sequence: Synthetic oligonucleotide
gaucucuugguggcuccg

SEQ ID NO: 132991 - RNA, 18 nt, Artificial Sequence
  Description of Artificial Sequence: Synthetic oligonucleotide
ccauggaucucuuggugg

SEQ ID NO: 132992 - RNA, 18 nt, Artificial Sequence
  Description of Artificial Sequence: Synthetic oligonucleotide
gaacaccauggaucucuu

SEQ ID NO: 132993 - RNA, 18 nt, Artificial Sequence
  Description of Artificial Sequence: Synthetic oligonucleotide
uccuugaacaccauggau

SEQ ID NO: 132994 - RNA, 18 nt, Artificial Sequence
  Description of Artificial Sequence: Synthetic oligonucleotide
gcacguccuugaacacca

SEQ ID NO: 132995 - RNA, 18 nt, Artificial Sequence
  Description of Artificial Sequence: Synthetic oligonucleotide
gagcagcacguccuugaa

SEQ ID NO: 132996 - RNA, 18 nt, Artificial Sequence
  Description of Artificial Sequence: Synthetic oligonucleotide
ugggcucugagcagggcc

SEQ ID NO: 132997 - RNA, 18 nt, Artificial Sequence
  Description of Artificial Sequence: Synthetic oligonucleotide
cagcaugggcucugagca

SEQ ID NO: 132998 - RNA, 18 nt, Artificial Sequence
  Description of Artificial Sequence: Synthetic oligonucleotide
cucgccagcaugggcucu

SEQ ID NO: 132999 - RNA, 18 nt, Artificial Sequence
  Description of Artificial Sequence: Synthetic oligonucleotide
aggugcucgccagcaugg

SEQ ID NO: 133000 - RNA, 18 nt, Artificial Sequence
  Description of Artificial Sequence: Synthetic oligonucleotide
gcagcaggugcucgccag

SEQ ID NO: 133001 - RNA, 18 nt, Artificial Sequence
  Description of Artificial Sequence: Synthetic oligonucleotide
uccgagcagcaggugcuc

SEQ ID NO: 133002 - RNA, 18 nt, Artificial Sequence
  Description of Artificial Sequence: Synthetic oligonucleotide
guggcuccgagcagcagg

SEQ ID NO: 133003 - RNA, 18 nt, Artificial Sequence
  Description of Artificial Sequence: Synthetic oligonucleotide
ucuugguggcuccgagca

SEQ ID NO: 133004 - RNA, 18 nt, Artificial Sequence
  Description of Artificial Sequence: Synthetic oligonucleotide
ggaucucuugguggcucc

SEQ ID NO: 133005 - RNA, 18 nt, Artificial Sequence
  Description of Artificial Sequence: Synthetic oligonucleotide
accauggaucucuuggug

SEQ ID NO: 133006 - RNA, 18 nt, Artificial Sequence
  Description of Artificial Sequence: Synthetic oligonucleotide
ugaacaccauggaucucu

SEQ ID NO: 133007 - RNA, 18 nt, Artificial Sequence
  Description of Artificial Sequence: Synthetic oligonucleotide
guccuugaacaccaugga

SEQ ID NO: 133008 - RNA, 18 nt, Artificial Sequence
  Description of Artificial Sequence: Synthetic oligonucleotide
agcacguccuugaacacc

SEQ ID NO: 133009 - RNA, 18 nt, Artificial Sequence
  Description of Artificial Sequence: Synthetic oligonucleotide
ggagcagcacguccuuga

SEQ ID NO: 133010 - RNA, 18 nt, Artificial Sequence
  Description of Artificial Sequence: Synthetic oligonucleotide
gccagggcaggcagccgc

SEQ ID NO: 133011 - RNA, 18 nt, Artificial Sequence
  Description of Artificial Sequence: Synthetic oligonucleotide
cccuggccagggcaggca

SEQ ID NO: 133012 - RNA, 18 nt, Artificial Sequence
  Description of Artificial Sequence: Synthetic oligonucleotide
uggagcccuggccagggc

SEQ ID NO: 133013 - RNA, 18 nt, Artificial Sequence
  Description of Artificial Sequence: Synthetic oligonucleotide
cucccuggagcccuggcc

SEQ ID NO: 133014 - RNA, 18 nt, Artificial Sequence
  Description of Artificial Sequence: Synthetic oligonucleotide
auacccucccuggagccc

SEQ ID NO: 133015 - RNA, 18 nt, Artificial Sequence
  Description of Artificial Sequence: Synthetic oligonucleotide
uaggcauacccucccugg

SEQ ID NO: 133016 - RNA, 18 nt, Artificial Sequence
  Description of Artificial Sequence: Synthetic oligonucleotide
caugcuaggcauacccuc

SEQ ID NO: 133017 - RNA, 18 nt, Artificial Sequence
  Description of Artificial Sequence: Synthetic oligonucleotide
agugccaugcuaggcaua

SEQ ID NO: 133018 - RNA, 18 nt, Artificial Sequence
  Description of Artificial Sequence: Synthetic oligonucleotide
gggugagugccaugcuag

SEQ ID NO: 133019 - RNA, 18 nt, Artificial Sequence
  Description of Artificial Sequence: Synthetic oligonucleotide
ugccugggugagugccau

SEQ ID NO: 133020 - RNA, 18 nt, Artificial Sequence
  Description of Artificial Sequence: Synthetic oligonucleotide
cuccuugccugggugagu

SEQ ID NO: 133021 - RNA, 18 nt, Artificial Sequence
  Description of Artificial Sequence: Synthetic oligonucleotide
ugaaucuccuugccuggg

SEQ ID NO: 133022 - RNA, 18 nt, Artificial Sequence
  Description of Artificial Sequence: Synthetic oligonucleotide
ccaugugaaucuccuugc

SEQ ID NO: 133023 - RNA, 18 nt, Artificial Sequence
  Description of Artificial Sequence: Synthetic oligonucleotide
ugccaccaugugaaucuc

SEQ ID NO: 133024 - RNA, 18 nt, Artificial Sequence
  Description of Artificial Sequence: Synthetic oligonucleotide
uugcaugccaccauguga

SEQ ID NO: 133025 - RNA, 18 nt, Artificial Sequence
  Description of Artificial Sequence: Synthetic oligonucleotide
cacccuugcaugccacca

SEQ ID NO: 133026 - RNA, 18 nt, Artificial Sequence
  Description of Artificial Sequence: Synthetic oligonucleotide
ucccucacccuugcaugc

SEQ ID NO: 133027 - RNA, 18 nt, Artificial Sequence
  Description of Artificial Sequence: Synthetic oligonucleotide
uagucucccucacccuug

SEQ ID NO: 133028 - RNA, 18 nt, Artificial Sequence
  Description of Artificial Sequence: Synthetic oligonucleotide
cugacuagucucccucac

SEQ ID NO: 133029 - RNA, 18 nt, Artificial Sequence
  Description of Artificial Sequence: Synthetic oligonucleotide
cacuccugacuagucucc

SEQ ID NO: 133030 - RNA, 18 nt, Artificial Sequence
  Description of Artificial Sequence: Synthetic oligonucleotide
agggccacuccugacuag

SEQ ID NO: 133031 - RNA, 18 nt, Artificial Sequence
  Description of Artificial Sequence: Synthetic oligonucleotide
aggacagggccacuccug

SEQ ID NO: 133032 - RNA, 18 nt, Artificial Sequence
  Description of Artificial Sequence: Synthetic oligonucleotide
gccugaggacagggccac

SEQ ID NO: 133033 - RNA, 18 nt, Artificial Sequence
  Description of Artificial Sequence: Synthetic oligonucleotide
ugcaagccugaggacagg

SEQ ID NO: 133034 - RNA, 18 nt, Artificial Sequence
  Description of Artificial Sequence: Synthetic oligonucleotide
ucuaaugcaagccugagg

SEQ ID NO: 133035 - RNA, 18 nt, Artificial Sequence
  Description of Artificial Sequence: Synthetic oligonucleotide
agcccucuaaugcaagcc

SEQ ID NO: 133036 - RNA, 18 nt, Artificial Sequence
  Description of Artificial Sequence: Synthetic oligonucleotide
ccuggagcccucuaaugc

SEQ ID NO: 133037 - RNA, 18 nt, Artificial Sequence
  Description of Artificial Sequence: Synthetic oligonucleotide
ugaguccuggagcccucu

SEQ ID NO: 133038 - RNA, 18 nt, Artificial Sequence
  Description of Artificial Sequence: Synthetic oligonucleotide
aaaacugaguccuggagc

SEQ ID NO: 133039 - RNA, 18 nt, Artificial Sequence
  Description of Artificial Sequence: Synthetic oligonucleotide
aguugaaaacugaguccu

SEQ ID NO: 133040 - RNA, 18 nt, Artificial Sequence
  Description of Artificial Sequence: Synthetic oligonucleotide
uacccaguugaaaacuga

SEQ ID NO: 133041 - RNA, 18 nt, Artificial Sequence
  Description of Artificial Sequence: Synthetic oligonucleotide
ggguacccaguugaaaac

SEQ ID NO: 133042 - RNA, 18 nt, Artificial Sequence
  Description of Artificial Sequence: Synthetic oligonucleotide
uccuugcaucugaguggg

SEQ ID NO: 133043 - RNA, 18 nt, Artificial Sequence
  Description of Artificial Sequence: Synthetic oligonucleotide
acauuuccuugcaucuga

SEQ ID NO: 133044 - RNA, 18 nt, Artificial Sequence
  Description of Artificial Sequence: Synthetic oligonucleotide
cauccacauuuccuugca

SEQ ID NO: 133045 - RNA, 18 nt, Artificial Sequence
  Description of Artificial Sequence: Synthetic oligonucleotide
acuugcauccacauuucc

SEQ ID NO: 133046 - RNA, 18 nt, Artificial Sequence
  Description of Artificial Sequence: Synthetic oligonucleotide
uggugacuugcauccaca

SEQ ID NO: 133047 - RNA, 18 nt, Artificial Sequence
  Description of Artificial Sequence: Synthetic oligonucleotide
gaauuuggugacuugcau

SEQ ID NO: 133048 - RNA, 18 nt, Artificial Sequence
  Description of Artificial Sequence: Synthetic oligonucleotide
gcugggaauuuggugacu

SEQ ID NO: 133049 - RNA, 18 nt, Artificial Sequence
  Description of Artificial Sequence: Synthetic oligonucleotide
ucaaugcugggaauuugg

SEQ ID NO: 133050 - RNA, 18 nt, Artificial Sequence
  Description of Artificial Sequence: Synthetic oligonucleotide
ugacuucaaugcugggaa

SEQ ID NO: 133051 - RNA, 18 nt, Artificial Sequence
  Description of Artificial Sequence: Synthetic oligonucleotide
ugcucugacuucaaugcu

SEQ ID NO: 133052 - RNA, 18 nt, Artificial Sequence
  Description of Artificial Sequence: Synthetic oligonucleotide
gaucgugcucugacuuca

SEQ ID NO: 133053 - RNA, 18 nt, Artificial Sequence
  Description of Artificial Sequence: Synthetic oligonucleotide
acccugaucgugcucuga

SEQ ID NO: 133054 - RNA, 18 nt, Artificial Sequence
  Description of Artificial Sequence: Synthetic oligonucleotide
ggauaacccugaucgugc

SEQ ID NO: 133055 - RNA, 18 nt, Artificial Sequence
  Description of Artificial Sequence: Synthetic oligonucleotide
uccagggauaacccugau

SEQ ID NO: 133056 - RNA, 18 nt, Artificial Sequence
  Description of Artificial Sequence: Synthetic oligonucleotide
guaauuccagggauaacc

SEQ ID NO: 133057 - RNA, 18 nt, Artificial Sequence
  Description of Artificial Sequence: Synthetic oligonucleotide
cacagguaauuccaggga

SEQ ID NO: 133058 - RNA, 18 nt, Artificial Sequence
  Description of Artificial Sequence: Synthetic oligonucleotide
ggaugcacagguaauucc

SEQ ID NO: 133059 - RNA, 18 nt, Artificial Sequence
  Description of Artificial Sequence: Synthetic oligonucleotide
aaaaaggaugcacaggua

SEQ ID NO: 133060 - RNA, 18 nt, Artificial Sequence
  Description of Artificial Sequence: Synthetic oligonucleotide
aaagaaaaaaggaugcac

SEQ ID NO: 133061 - RNA, 18 nt, Artificial Sequence
  Description of Artificial Sequence: Synthetic oligonucleotide
ugucaaaagaaaaaagga

SEQ ID NO: 133062 - RNA, 18 nt, Artificial Sequence
  Description of Artificial Sequence: Synthetic oligonucleotide
gacucugucaaaagaaaa

SEQ ID NO: 133063 - RNA, 18 nt, Artificial Sequence
  Description of Artificial Sequence: Synthetic oligonucleotide
agcaagacucugucaaaa

SEQ ID NO: 133064 - RNA, 18 nt, Artificial Sequence
  Description of Artificial Sequence: Synthetic oligonucleotide
gacagagcaagacucugu

SEQ ID NO: 133065 - RNA, 18 nt, Artificial Sequence
  Description of Artificial Sequence: Synthetic oligonucleotide
ugagugacagagcaagac

SEQ ID NO: 133066 - RNA, 18 nt, Artificial Sequence
  Description of Artificial Sequence: Synthetic oligonucleotide
cagccugagugacagagc

SEQ ID NO: 133067 - RNA, 18 nt, Artificial Sequence
  Description of Artificial Sequence: Synthetic oligonucleotide
cacuccagccugagugac

SEQ ID NO: 133068 - RNA, 18 nt, Artificial Sequence
  Description of Artificial Sequence: Synthetic oligonucleotide
cauugcacuccagccuga

SEQ ID NO: 133069 - RNA, 18 nt, Artificial Sequence
  Description of Artificial Sequence: Synthetic oligonucleotide
cacaucauugcacuccag

SEQ ID NO: 133070 - RNA, 18 nt, Artificial Sequence
  Description of Artificial Sequence: Synthetic oligonucleotide
gagaucacaucauugcac

SEQ ID NO: 133071 - RNA, 18 nt, Artificial Sequence
  Description of Artificial Sequence: Synthetic oligonucleotide
gagccgagaucacaucau

SEQ ID NO: 133072 - RNA, 18 nt, Artificial Sequence
  Description of Artificial Sequence: Synthetic oligonucleotide
gaagugagccgagaucac

SEQ ID NO: 133073 - RNA, 18 nt, Artificial Sequence
  Description of Artificial Sequence: Synthetic oligonucleotide
aggcugaagugagccgag

SEQ ID NO: 133074 - RNA, 18 nt, Artificial Sequence
  Description of Artificial Sequence: Synthetic oligonucleotide
gguggaggcugaagugag

SEQ ID NO: 133075 - RNA, 18 nt, Artificial Sequence
  Description of Artificial Sequence: Synthetic oligonucleotide
uggcggguggaggcugaa

SEQ ID NO: 133076 - RNA, 18 nt, Artificial Sequence
  Description of Artificial Sequence: Synthetic oligonucleotide
gaacguggcggguggagg

SEQ ID NO: 133077 - RNA, 18 nt, Artificial Sequence
  Description of Artificial Sequence: Synthetic oligonucleotide
ugcuugaacguggcgggu

SEQ ID NO: 133078 - RNA, 18 nt, Artificial Sequence
  Description of Artificial Sequence: Synthetic oligonucleotide
agaauugcuugaacgugg

SEQ ID NO: 133079 - RNA, 18 nt, Artificial Sequence
  Description of Artificial Sequence: Synthetic oligonucleotide
gcaggagaauugcuugaa

SEQ ID NO: 133080 - RNA, 18 nt, Artificial Sequence
  Description of Artificial Sequence: Synthetic oligonucleotide
gugaggcaggagaauugc

SEQ ID NO: 133081 - RNA, 18 nt, Artificial Sequence
  Description of Artificial Sequence: Synthetic oligonucleotide
ggagggugaggcaggaga

SEQ ID NO: 133082 - RNA, 18 nt, Artificial Sequence
  Description of Artificial Sequence: Synthetic oligonucleotide
acucuggagggugaggca

SEQ ID NO: 133083 - RNA, 18 nt, Artificial Sequence
  Description of Artificial Sequence: Synthetic oligonucleotide
cagcaacucuggagggug

SEQ ID NO: 133084 - RNA, 18 nt, Artificial Sequence
  Description of Artificial Sequence: Synthetic oligonucleotide
ggucccagcaacucugga

SEQ ID NO: 133085 - RNA, 18 nt, Artificial Sequence
  Description of Artificial Sequence: Synthetic oligonucleotide
ccuguggucccagcaacu

SEQ ID NO: 133086 - RNA, 18 nt, Artificial Sequence
  Description of Artificial Sequence: Synthetic oligonucleotide
gcacgccuguggucccag

SEQ ID NO: 133087 - RNA, 18 nt, Artificial Sequence
  Description of Artificial Sequence: Synthetic oligonucleotide
guggugcacgccuguggu

SEQ ID NO: 133088 - RNA, 18 nt, Artificial Sequence
  Description of Artificial Sequence: Synthetic oligonucleotide
gugugguggugcacgccu

SEQ ID NO: 133089 - RNA, 18 nt, Artificial Sequence
  Description of Artificial Sequence: Synthetic oligonucleotide
gcugggugugguggugca

SEQ ID NO: 133090 - RNA, 18 nt, Artificial Sequence
  Description of Artificial Sequence: Synthetic oligonucleotide
aauuagcuggguguggug

SEQ ID NO: 133091 - RNA, 18 nt, Artificial Sequence
  Description of Artificial Sequence: Synthetic oligonucleotide
acaaaaauuagcugggug

SEQ ID NO: 133092 - RNA, 18 nt, Artificial Sequence
  Description of Artificial Sequence: Synthetic oligonucleotide
aaaauacaaaaauuagcu

SEQ ID NO: 133093 - RNA, 18 nt, Artificial Sequence
  Description of Artificial Sequence: Synthetic oligonucleotide
uacuaaaaauacaaaaau

SEQ ID NO: 133094 - RNA, 18 nt, Artificial Sequence
  Description of Artificial Sequence: Synthetic oligonucleotide
gucucuacuaaaaauaca

SEQ ID NO: 133095 - RNA, 18 nt, Artificial Sequence
  Description of Artificial Sequence: Synthetic oligonucleotide
acccugucucuacuaaaa

SEQ ID NO: 133096 - RNA, 18 nt, Artificial Sequence
  Description of Artificial Sequence: Synthetic oligonucleotide
gugaaacccugucucuac

SEQ ID NO: 133097 - RNA, 18 nt, Artificial Sequence
  Description of Artificial Sequence: Synthetic oligonucleotide
acauggugaaacccuguc

SEQ ID NO: 133098 - RNA, 18 nt, Artificial Sequence
  Description of Artificial Sequence: Synthetic oligonucleotide
ggucaacauggugaaacc

SEQ ID NO: 133099 - RNA, 18 nt, Artificial Sequence
  Description of Artificial Sequence: Synthetic oligonucleotide
agccuggucaacauggug

SEQ ID NO: 133100 - RNA, 18 nt, Artificial Sequence
  Description of Artificial Sequence: Synthetic oligonucleotide
agaccagccuggucaaca

SEQ ID NO: 133101 - RNA, 18 nt, Artificial Sequence
  Description of Artificial Sequence: Synthetic oligonucleotide
guuugagaccagccuggu

SEQ ID NO: 133102 - RNA, 18 nt, Artificial Sequence
  Description of Artificial Sequence: Synthetic oligonucleotide
caggaguuugagaccagc

SEQ ID NO: 133103 - RNA, 18 nt, Artificial Sequence
  Description of Artificial Sequence: Synthetic oligonucleotide
gaggccaggaguuugaga

SEQ ID NO: 133104 - RNA, 18 nt, Artificial Sequence
  Description of Artificial Sequence: Synthetic oligonucleotide
uauuugaggccaggaguu

SEQ ID NO: 133105 - RNA, 18 nt, Artificial Sequence
  Description of Artificial Sequence: Synthetic oligonucleotide
uggauuauuugaggccag

SEQ ID NO: 133106 - RNA, 18 nt, Artificial Sequence
  Description of Artificial Sequence: Synthetic oligonucleotide
gcggguggauuauuugag

SEQ ID NO: 133107 - RNA, 18 nt, Artificial Sequence
  Description of Artificial Sequence: Synthetic oligonucleotide
cugaggcggguggauuau

SEQ ID NO: 133108 - RNA, 18 nt, Artificial Sequence
  Description of Artificial Sequence: Synthetic oligonucleotide
gagcacagucccuggcac

SEQ ID NO: 133109 - RNA, 18 nt, Artificial Sequence
  Description of Artificial Sequence: Synthetic oligonucleotide
gcagugagcacagucccu

SEQ ID NO: 133110 - RNA, 18 nt, Artificial Sequence
  Description of Artificial Sequence: Synthetic oligonucleotide
gcaaagcagugagcacag

SEQ ID NO: 133111 - RNA, 18 nt, Artificial Sequence
  Description of Artificial Sequence: Synthetic oligonucleotide
uguuugcaaagcagugag

SEQ ID NO: 133112 - RNA, 18 nt, Artificial Sequence
  Description of Artificial Sequence: Synthetic oligonucleotide
gguaguguuugcaaagca

SEQ ID NO: 133113 - RNA, 18 nt, Artificial Sequence
  Description of Artificial Sequence: Synthetic oligonucleotide
aaauagguaguguuugca

SEQ ID NO: 133114 - RNA, 18 nt, Artificial Sequence
  Description of Artificial Sequence: Synthetic oligonucleotide
uauuaaaauagguagugu

SEQ ID NO: 133115 - RNA, 18 nt, Artificial Sequence
  Description of Artificial Sequence: Synthetic oligonucleotide
uguuauauuaaaauaggu

SEQ ID NO: 133116 - RNA, 18 nt, Artificial Sequence
  Description of Artificial Sequence: Synthetic oligonucleotide
agcauuguuauauuaaaa

SEQ ID NO: 133117 - RNA, 18 nt, Artificial Sequence
  Description of Artificial Sequence: Synthetic oligonucleotide
cucauagcauuguuauau

SEQ ID NO: 133118 - RNA, 18 nt, Artificial Sequence
  Description of Artificial Sequence: Synthetic oligonucleotide
cuucccucauagcauugu

SEQ ID NO: 133119 - RNA, 18 nt, Artificial Sequence
  Description of Artificial Sequence: Synthetic oligonucleotide
ucgagcuucccucauagc

SEQ ID NO: 133120 - RNA, 18 nt, Artificial Sequence
  Description of Artificial Sequence: Synthetic oligonucleotide
aauaaucgagcuucccuc

SEQ ID NO: 133121 - RNA, 18 nt, Artificial Sequence
  Description of Artificial Sequence: Synthetic oligonucleotide
ggauaaauaaucgagcuu

SEQ ID NO: 133122 - RNA, 18 nt, Artificial Sequence
  Description of Artificial Sequence: Synthetic oligonucleotide
gaugaggauaaauaaucg

SEQ ID NO: 133123 - RNA, 18 nt, Artificial Sequence
  Description of Artificial Sequence: Synthetic oligonucleotide
uauaagaugaggauaaau

SEQ ID NO: 133124 - RNA, 18 nt, Artificial Sequence
  Description of Artificial Sequence: Synthetic oligonucleotide
uuaucuauaagaugagga

SEQ ID NO: 133125 - RNA, 18 nt, Artificial Sequence
  Description of Artificial Sequence: Synthetic oligonucleotide
uuuucuuaucuauaagau

SEQ ID NO: 133126 - RNA, 18 nt, Artificial Sequence
  Description of Artificial Sequence: Synthetic oligonucleotide
cucaguuuucuuaucuau

SEQ ID NO: 133127 - RNA, 18 nt, Artificial Sequence
  Description of Artificial Sequence: Synthetic oligonucleotide
ugugccucaguuuucuua

SEQ ID NO: 133128 - RNA, 18 nt, Artificial Sequence
  Description of Artificial Sequence: Synthetic oligonucleotide
cucucugugccucaguuu

SEQ ID NO: 133129 - RNA, 18 nt, Artificial Sequence
  Description of Artificial Sequence: Synthetic oligonucleotide
uuaaccucucugugccuc

SEQ ID NO: 133130 - RNA, 18 nt, Artificial Sequence
  Description of Artificial Sequence: Synthetic oligonucleotide
guuacuuaaccucucugu

SEQ ID NO: 133131 - RNA, 18 nt, Artificial Sequence
  Description of Artificial Sequence: Synthetic oligonucleotide
gauaaguuacuuaaccuc

SEQ ID NO: 133132 - RNA, 18 nt, Artificial Sequence
  Description of Artificial Sequence: Synthetic oligonucleotide
aguuggauaaguuacuua

SEQ ID NO: 133133 - RNA, 18 nt, Artificial Sequence
  Description of Artificial Sequence: Synthetic oligonucleotide
guuauaguuggauaaguu

SEQ ID NO: 133134 - RNA, 18 nt, Artificial Sequence
  Description of Artificial Sequence: Synthetic oligonucleotide
agcugguuauaguuggau

SEQ ID NO: 133135 - RNA, 18 nt, Artificial Sequence
  Description of Artificial Sequence: Synthetic oligonucleotide
cugauagcugguuauagu

SEQ ID NO: 133136 - RNA, 18 nt, Artificial Sequence
  Description of Artificial Sequence: Synthetic oligonucleotide
ugccccugauagcugguu

SEQ ID NO: 133137 - RNA, 18 nt, Artificial Sequence
  Description of Artificial Sequence: Synthetic oligonucleotide
ggcucugccccugauagc

SEQ ID NO: 133138 - RNA, 18 nt, Artificial Sequence
  Description of Artificial Sequence: Synthetic oligonucleotide
uaaauggcucugccccug

SEQ ID NO: 133139 - RNA, 18 nt, Artificial Sequence
  Description of Artificial Sequence: Synthetic oligonucleotide
cugcuuaaauggcucugc

SEQ ID NO: 133140 - RNA, 18 nt, Artificial Sequence
  Description of Artificial Sequence: Synthetic oligonucleotide
cugcccugcuuaaauggc

SEQ ID NO: 133141 - RNA, 18 nt, Artificial Sequence
  Description of Artificial Sequence: Synthetic oligonucleotide
cugcacugcccugcuuaa

SEQ ID NO: 133142 - RNA, 18 nt, Artificial Sequence
  Description of Artificial Sequence: Synthetic oligonucleotide
uggaacugcacugcccug

SEQ ID NO: 133143 - RNA, 18 nt, Artificial Sequence
  Description of Artificial Sequence: Synthetic oligonucleotide
gauucuggaacugcacug

SEQ ID NO: 133144 - RNA, 18 nt, Artificial Sequence
  Description of Artificial Sequence: Synthetic oligonucleotide
gaccagauucuggaacug

SEQ ID NO: 133145 - RNA, 18 nt, Artificial Sequence
  Description of Artificial Sequence: Synthetic oligonucleotide
uaaaggaccagauucugg

SEQ ID NO: 133146 - RNA, 18 nt, Artificial Sequence
  Description of Artificial Sequence: Synthetic oligonucleotide
aagguuaaaggaccagau

SEQ ID NO: 133147 - RNA, 18 nt, Artificial Sequence
  Description of Artificial Sequence: Synthetic oligonucleotide
gcaucaagguuaaaggac

SEQ ID NO: 133148 - RNA, 18 nt, Artificial Sequence
  Description of Artificial Sequence: Synthetic oligonucleotide
ccaaagcaucaagguuaa

SEQ ID NO: 133149 - RNA, 18 nt, Artificial Sequence
  Description of Artificial Sequence: Synthetic oligonucleotide
aggcaccaaagcaucaag

SEQ ID NO: 133150 - RNA, 18 nt, Artificial Sequence
  Description of Artificial Sequence: Synthetic oligonucleotide
cugauaggcaccaaagca

SEQ ID NO: 133151 - RNA, 18 nt, Artificial Sequence
  Description of Artificial Sequence: Synthetic oligonucleotide
gucaccugauaggcacca

SEQ ID NO: 133152 - RNA, 18 nt, Artificial Sequence
  Description of Artificial Sequence: Synthetic oligonucleotide
caaaggucaccugauagg

SEQ ID NO: 133153 - RNA, 18 nt, Artificial Sequence
  Description of Artificial Sequence: Synthetic oligonucleotide
acauucaaaggucaccug

SEQ ID NO: 133154 - RNA, 18 nt, Artificial Sequence
  Description of Artificial Sequence: Synthetic oligonucleotide
cgaugacauucaaagguc

SEQ ID NO: 133155 - RNA, 18 nt, Artificial Sequence
  Description of Artificial Sequence: Synthetic oligonucleotide
aagaucgaugacauucaa

SEQ ID NO: 133156 - RNA, 18 nt, Artificial Sequence
  Description of Artificial Sequence: Synthetic oligonucleotide
cucacaagaucgaugaca

SEQ ID NO: 133157 - RNA, 18 nt, Artificial Sequence
  Description of Artificial Sequence: Synthetic oligonucleotide
caugacucacaagaucga

SEQ ID NO: 133158 - RNA, 18 nt, Artificial Sequence
  Description of Artificial Sequence: Synthetic oligonucleotide
accaacaugacucacaag

SEQ ID NO: 133159 - RNA, 18 nt, Artificial Sequence
  Description of Artificial Sequence: Synthetic oligonucleotide
cauuuaccaacaugacuc

SEQ ID NO: 133160 - RNA, 18 nt, Artificial Sequence
  Description of Artificial Sequence: Synthetic oligonucleotide
agcuccauuuaccaacau

SEQ ID NO: 133161 - RNA, 18 nt, Artificial Sequence
  Description of Artificial Sequence: Synthetic oligonucleotide
acccaagcuccauuuacc

SEQ ID NO: 133162 - RNA, 18 nt, Artificial Sequence
  Description of Artificial Sequence: Synthetic oligonucleotide
acaugacccaagcuccau

SEQ ID NO: 133163 - RNA, 18 nt, Artificial Sequence
  Description of Artificial Sequence: Synthetic oligonucleotide
cuuucacaugacccaagc

SEQ ID NO: 133164 - RNA, 18 nt, Artificial Sequence
  Description of Artificial Sequence: Synthetic oligonucleotide
gaccucuuucacaugacc

SEQ ID NO: 133165 - RNA, 18 nt, Artificial Sequence
  Description of Artificial Sequence: Synthetic oligonucleotide
ucuaggaccucuuucaca

SEQ ID NO: 133166 - RNA, 18 nt, Artificial Sequence
  Description of Artificial Sequence: Synthetic oligonucleotide
ggcuuucuaggaccucuu

SEQ ID NO: 133167 - RNA, 18 nt, Artificial Sequence
  Description of Artificial Sequence: Synthetic oligonucleotide
aacuuggcuuucuaggac

SEQ ID NO: 133168 - RNA, 18 nt, Artificial Sequence
  Description of Artificial Sequence: Synthetic oligonucleotide
cuuggaacuuggcuuucu

SEQ ID NO: 133169 - RNA, 18 nt, Artificial Sequence
  Description of Artificial Sequence: Synthetic oligonucleotide
cugagcuuggaacuuggc

SEQ ID NO: 133170 - RNA, 18 nt, Artificial Sequence
  Description of Artificial Sequence: Synthetic oligonucleotide
uccggcugagcuuggaac

SEQ ID NO: 133171 - RNA, 18 nt, Artificial Sequence
  Description of Artificial Sequence: Synthetic oligonucleotide
agucauccggcugagcuu

SEQ ID NO: 133172 - RNA, 18 nt, Artificial Sequence
  Description of Artificial Sequence: Synthetic oligonucleotide
ccuugagucauccggcug

SEQ ID NO: 133173 - RNA, 18 nt, Artificial Sequence
  Description of Artificial Sequence: Synthetic oligonucleotide
agcugccuugagucaucc

SEQ ID NO: 133174 - RNA, 18 nt, Artificial Sequence
  Description of Artificial Sequence: Synthetic oligonucleotide
agauaagcugccuugagu

SEQ ID NO: 133175 - RNA, 18 nt, Artificial Sequence
  Description of Artificial Sequence: Synthetic oligonucleotide
ucagaagauaagcugccu

SEQ ID NO: 133176 - RNA, 18 nt, Artificial Sequence
  Description of Artificial Sequence: Synthetic oligonucleotide
cagauucagaagauaagc

SEQ ID NO: 133177 - RNA, 18 nt, Artificial Sequence
  Description of Artificial Sequence: Synthetic oligonucleotide
aggcccagauucagaaga

SEQ ID NO: 133178 - RNA, 18 nt, Artificial Sequence
  Description of Artificial Sequence: Synthetic oligonucleotide
agcugaggcccagauuca

SEQ ID NO: 133179 - RNA, 18 nt, Artificial Sequence
  Description of Artificial Sequence: Synthetic oligonucleotide
aaggaagcugaggcccag

SEQ ID NO: 133180 - RNA, 18 nt, Artificial Sequence
  Description of Artificial Sequence: Synthetic oligonucleotide
cagguaaggaagcugagg

SEQ ID NO: 133181 - RNA, 18 nt, Artificial Sequence
  Description of Artificial Sequence: Synthetic oligonucleotide
uuucacagguaaggaagc

SEQ ID NO: 133182 - RNA, 18 nt, Artificial Sequence
  Description of Artificial Sequence: Synthetic oligonucleotide
ucccauuucacagguaag

SEQ ID NO: 133183 - RNA, 18 nt, Artificial Sequence
  Description of Artificial Sequence: Synthetic oligonucleotide
gugacucccauuucacag

SEQ ID NO: 133184 - RNA, 18 nt, Artificial Sequence
  Description of Artificial Sequence: Synthetic oligonucleotide
ggauggugacucccauuu

SEQ ID NO: 133185 - RNA, 18 nt, Artificial Sequence
  Description of Artificial Sequence: Synthetic oligonucleotide
ugcagggauggugacucc

SEQ ID NO: 133186 - RNA, 18 nt, Artificial Sequence
  Description of Artificial Sequence: Synthetic oligonucleotide
ggaccugcagggauggug

SEQ ID NO: 133187 - RNA, 18 nt, Artificial Sequence
  Description of Artificial Sequence: Synthetic oligonucleotide
gaggaggaccugcaggga

SEQ ID NO: 133188 - RNA, 18 nt, Artificial Sequence
  Description of Artificial Sequence: Synthetic oligonucleotide
ugugggaggaggaccugc

SEQ ID NO: 133189 - RNA, 18 nt, Artificial Sequence
  Description of Artificial Sequence: Synthetic oligonucleotide
gugccugugggaggagga

SEQ ID NO: 133190 - RNA, 18 nt, Artificial Sequence
  Description of Artificial Sequence: Synthetic oligonucleotide
agcuggugccugugggag

SEQ ID NO: 133191 - RNA, 18 nt, Artificial Sequence
  Description of Artificial Sequence: Synthetic oligonucleotide
aagauagcuggugccugu

SEQ ID NO: 133192 - RNA, 18 nt, Artificial Sequence
  Description of Artificial Sequence: Synthetic oligonucleotide
uuggcaagauagcuggug

SEQ ID NO: 133193 - RNA, 18 nt, Artificial Sequence
  Description of Artificial Sequence: Synthetic oligonucleotide
uuaaguuggcaagauagc

SEQ ID NO: 133194 - RNA, 18 nt, Artificial Sequence
  Description of Artificial Sequence: Synthetic oligonucleotide
ggcuuuuaaguuggcaag

SEQ ID NO: 133195 - RNA, 18 nt, Artificial Sequence
  Description of Artificial Sequence: Synthetic oligonucleotide
guuuuggcuuuuaaguug

SEQ ID NO: 133196 - RNA, 18 nt, Artificial Sequence
  Description of Artificial Sequence: Synthetic oligonucleotide
cucuaguuuuggcuuuua

SEQ ID NO: 133197 - RNA, 18 nt, Artificial Sequence
  Description of Artificial Sequence: Synthetic oligonucleotide
cucuccucuaguuuuggc

SEQ ID NO: 133198 - RNA, 18 nt, Artificial Sequence
  Description of Artificial Sequence: Synthetic oligonucleotide
gaccccucuccucuaguu

SEQ ID NO: 133199 - RNA, 18 nt, Artificial Sequence
  Description of Artificial Sequence: Synthetic oligonucleotide
ggguugaccccucuccuc

SEQ ID NO: 133200 - RNA, 18 nt, Artificial Sequence
  Description of Artificial Sequence: Synthetic oligonucleotide
accuuggguugaccccuc

SEQ ID NO: 133201 - RNA, 18 nt, Artificial Sequence
  Description of Artificial Sequence: Synthetic oligonucleotide
aagucaccuuggguugac

SEQ ID NO: 133202 - RNA, 18 nt, Artificial Sequence
  Description of Artificial Sequence: Synthetic oligonucleotide
augggaagucaccuuggg

SEQ ID NO: 133203 - RNA, 18 nt, Artificial Sequence
  Description of Artificial Sequence: Synthetic oligonucleotide
ggaggaugggaagucacc

SEQ ID NO: 133204 - RNA, 18 nt, Artificial Sequence
  Description of Artificial Sequence: Synthetic oligonucleotide
gggagggaggaugggaag

SEQ ID NO: 133205 - RNA, 18 nt, Artificial Sequence
  Description of Artificial Sequence: Synthetic oligonucleotide
gggacaauguagucauug

SEQ ID NO: 133206 - RNA, 18 nt, Artificial Sequence
  Description of Artificial Sequence: Synthetic oligonucleotide
gccgagggacaauguagu

SEQ ID NO: 133207 - RNA, 18 nt, Artificial Sequence
  Description of Artificial Sequence: Synthetic oligonucleotide
gcagugccgagggacaau

SEQ ID NO: 133208 - RNA, 18 nt, Artificial Sequence
  Description of Artificial Sequence: Synthetic oligonucleotide
uccgggcagugccgaggg

SEQ ID NO: 133209 - RNA, 18 nt, Artificial Sequence
  Description of Artificial Sequence: Synthetic oligonucleotide
ccagcuccgggcagugcc

SEQ ID NO: 133210 - RNA, 18 nt, Artificial Sequence
  Description of Artificial Sequence: Synthetic oligonucleotide
cuccgccagcuccgggca

SEQ ID NO: 133211 - RNA, 18 nt, Artificial Sequence
  Description of Artificial Sequence: Synthetic oligonucleotide
cucaucuccgccagcucc

SEQ ID NO: 133212 - RNA, 18 nt, Artificial Sequence
  Description of Artificial Sequence: Synthetic oligonucleotide
cccggcucaucuccgcca

SEQ ID NO: 133213 - RNA, 18 nt, Artificial Sequence
  Description of Artificial Sequence: Synthetic oligonucleotide
ggacacccggcucaucuc

SEQ ID NO: 133214 - RNA, 18 nt, Artificial Sequence
  Description of Artificial Sequence: Synthetic oligonucleotide
cguauggacacccggcuc

SEQ ID NO: 133215 - RNA, 18 nt, Artificial Sequence
  Description of Artificial Sequence: Synthetic oligonucleotide
ggaugcguauggacaccc

SEQ ID NO: 133216 - RNA, 18 nt, Artificial Sequence
  Description of Artificial Sequence: Synthetic oligonucleotide
gucaaggaugcguaugga

SEQ ID NO: 133217 - RNA, 18 nt, Artificial Sequence
  Description of Artificial Sequence: Synthetic oligonucleotide
agcucgucaaggaugcgu

SEQ ID NO: 133218 - RNA, 18 nt, Artificial Sequence
  Description of Artificial Sequence: Synthetic oligonucleotide
gcaccagcucgucaagga

SEQ ID NO: 133219 - RNA, 18 nt, Artificial Sequence
  Description of Artificial Sequence: Synthetic oligonucleotide
gggcagcaccagcucguc

SEQ ID NO: 133220 - RNA, 18 nt, Artificial Sequence
  Description of Artificial Sequence: Synthetic oligonucleotide
uggaagggcagcaccagc

SEQ ID NO: 133221 - RNA, 18 nt, Artificial Sequence
  Description of Artificial Sequence: Synthetic oligonucleotide
gcuccuggaagggcagca

SEQ ID NO: 133222 - RNA, 18 nt, Artificial Sequence
  Description of Artificial Sequence: Synthetic oligonucleotide
cugcagcuccuggaaggg

SEQ ID NO: 133223 - RNA, 18 nt, Artificial Sequence
  Description of Artificial Sequence: Synthetic oligonucleotide
ucgaucugcagcuccugg

SEQ ID NO: 133224 - RNA, 18 nt, Artificial Sequence
  Description of Artificial Sequence: Synthetic oligonucleotide
ugucaucgaucugcagcu

SEQ ID NO: 133225 - RNA, 18 nt, Artificial Sequence
  Description of Artificial Sequence: Synthetic oligonucleotide
cucauugucaucgaucug

SEQ ID NO: 133226 - RNA, 18 nt, Artificial Sequence
  Description of Artificial Sequence: Synthetic oligonucleotide
gcauacucauugucaucg

SEQ ID NO: 133227 - RNA, 18 nt, Artificial Sequence
  Description of Artificial Sequence: Synthetic oligonucleotide
gguaggcauacucauugu

SEQ ID NO: 133228 - RNA, 18 nt, Artificial Sequence
  Description of Artificial Sequence: Synthetic oligonucleotide
uuugagguaggcauacuc

SEQ ID NO: 133229 - RNA, 18 nt, Artificial Sequence
  Description of Artificial Sequence: Synthetic oligonucleotide
auggcuuugagguaggca

SEQ ID NO: 133230 - RNA, 18 nt, Artificial Sequence
  Description of Artificial Sequence: Synthetic oligonucleotide
agaugauggcuuugaggu

SEQ ID NO: 133231 - RNA, 18 nt, Artificial Sequence
  Description of Artificial Sequence: Synthetic oligonucleotide
aaagaagaugauggcuuu

SEQ ID NO: 133232 - RNA, 18 nt, Artificial Sequence
  Description of Artificial Sequence: Synthetic oligonucleotide
gggucaaagaagaugaug

SEQ ID NO: 133233 - RNA, 18 nt, Artificial Sequence
  Description of Artificial Sequence: Synthetic oligonucleotide
ggacaauguagucauugc

SEQ ID NO: 133234 - RNA, 18 nt, Artificial Sequence
  Description of Artificial Sequence: Synthetic oligonucleotide
ccgagggacaauguaguc

SEQ ID NO: 133235 - RNA, 18 nt, Artificial Sequence
  Description of Artificial Sequence: Synthetic oligonucleotide
cagugccgagggacaaug

SEQ ID NO: 133236 - RNA, 18 nt, Artificial Sequence
  Description of Artificial Sequence: Synthetic oligonucleotide
ccgggcagugccgaggga

SEQ ID NO: 133237 - RNA, 18 nt, Artificial Sequence
  Description of Artificial Sequence: Synthetic oligonucleotide
cagcuccgggcagugccg

SEQ ID NO: 133238 - RNA, 18 nt, Artificial Sequence
  Description of Artificial Sequence: Synthetic oligonucleotide
uccgccagcuccgggcag

SEQ ID NO: 133239 - RNA, 18 nt, Artificial Sequence
  Description of Artificial Sequence: Synthetic oligonucleotide
ucaucuccgccagcuccg

SEQ ID NO: 133240 - RNA, 18 nt, Artificial Sequence
  Description of Artificial Sequence: Synthetic oligonucleotide
ccggcucaucuccgccag

SEQ ID NO: 133241 - RNA, 18 nt, Artificial Sequence
  Description of Artificial Sequence: Synthetic oligonucleotide
gacacccggcucaucucc

SEQ ID NO: 133242 - RNA, 18 nt, Artificial Sequence
  Description of Artificial Sequence: Synthetic oligonucleotide
guauggacacccggcuca

SEQ ID NO: 133243 - RNA, 18 nt, Artificial Sequence
  Description of Artificial Sequence: Synthetic oligonucleotide
gaugcguauggacacccg

SEQ ID NO: 133244 - RNA, 18 nt, Artificial Sequence
  Description of Artificial Sequence: Synthetic oligonucleotide
ucaaggaugcguauggac

SEQ ID NO: 133245 - RNA, 18 nt, Artificial Sequence
  Description of Artificial Sequence: Synthetic oligonucleotide
gcucgucaaggaugcgua

SEQ ID NO: 133246 - RNA, 18 nt, Artificial Sequence
  Description of Artificial Sequence: Synthetic oligonucleotide
caccagcucgucaaggau

SEQ ID NO: 133247 - RNA, 18 nt, Artificial Sequence
  Description of Artificial Sequence: Synthetic oligonucleotide
ggcagcaccagcucguca

SEQ ID NO: 133248 - RNA, 18 nt, Artificial Sequence
  Description of Artificial Sequence: Synthetic oligonucleotide
ggaagggcagcaccagcu

SEQ ID NO: 133249 - RNA, 18 nt, Artificial Sequence
  Description of Artificial Sequence: Synthetic oligonucleotide
cuccuggaagggcagcac

SEQ ID NO: 133250 - RNA, 18 nt, Artificial Sequence
  Description of Artificial Sequence: Synthetic oligonucleotide
ugcagcuccuggaagggc

SEQ ID NO: 133251 - RNA, 18 nt, Artificial Sequence
  Description of Artificial Sequence: Synthetic oligonucleotide
cgaucugcagcuccugga

SEQ ID NO: 133252 - RNA, 18 nt, Artificial Sequence
  Description of Artificial Sequence: Synthetic oligonucleotide
gucaucgaucugcagcuc

SEQ ID NO: 133253 - RNA, 18 nt, Artificial Sequence
  Description of Artificial Sequence: Synthetic oligonucleotide
ucauugucaucgaucugc

SEQ ID NO: 133254 - RNA, 18 nt, Artificial Sequence
  Description of Artificial Sequence: Synthetic oligonucleotide
cauacucauugucaucga

SEQ ID NO: 133255 - RNA, 18 nt, Artificial Sequence
  Description of Artificial Sequence: Synthetic oligonucleotide
guaggcauacucauuguc

SEQ ID NO: 133256 - RNA, 18 nt, Artificial Sequence
  Description of Artificial Sequence: Synthetic oligonucleotide
uugagguaggcauacuca

SEQ ID NO: 133257 - RNA, 18 nt, Artificial Sequence
  Description of Artificial Sequence: Synthetic oligonucleotide
uggcuuugagguaggcau

SEQ ID NO: 133258 - RNA, 18 nt, Artificial Sequence
  Description of Artificial Sequence: Synthetic oligonucleotide
gaugauggcuuugaggua

SEQ ID NO: 133259 - RNA, 18 nt, Artificial Sequence
  Description of Artificial Sequence: Synthetic oligonucleotide
aagaagaugauggcuuug

SEQ ID NO: 133260 - RNA, 18 nt, Artificial Sequence
  Description of Artificial Sequence: Synthetic oligonucleotide
ggucaaagaagaugaugg

SEQ ID NO: 133261 - RNA, 18 nt, Artificial Sequence
  Description of Artificial Sequence: Synthetic oligonucleotide
ggcuuaggaggugugcac

SEQ ID NO: 133262 - RNA, 18 nt, Artificial Sequence
  Description of Artificial Sequence: Synthetic oligonucleotide
gggauggcuuaggaggug

SEQ ID NO: 133263 - RNA, 18 nt, Artificial Sequence
  Description of Artificial Sequence: Synthetic oligonucleotide
agucagggauggcuuagg

SEQ ID NO: 133264 - RNA, 18 nt, Artificial Sequence
  Description of Artificial Sequence: Synthetic oligonucleotide
gagagagucagggauggc

SEQ ID NO: 133265 - RNA, 18 nt, Artificial Sequence
  Description of Artificial Sequence: Synthetic oligonucleotide
cuggagagagagucaggg

SEQ ID NO: 133266 - RNA, 18 nt, Artificial Sequence
  Description of Artificial Sequence: Synthetic oligonucleotide
gcguucuggagagagagu

SEQ ID NO: 133267 - RNA, 18 nt, Artificial Sequence
  Description of Artificial Sequence: Synthetic oligonucleotide
gcagagcguucuggagag

SEQ ID NO: 133268 - RNA, 18 nt, Artificial Sequence
  Description of Artificial Sequence: Synthetic oligonucleotide
gucuggcagagcguucug

SEQ ID NO: 133269 - RNA, 18 nt, Artificial Sequence
  Description of Artificial Sequence: Synthetic oligonucleotide
gagaagucuggcagagcg

SEQ ID NO: 133270 - RNA, 18 nt, Artificial Sequence
  Description of Artificial Sequence: Synthetic oligonucleotide
aauaggagaagucuggca

SEQ ID NO: 133271 - RNA, 18 nt, Artificial Sequence
  Description of Artificial Sequence: Synthetic oligonucleotide
aacccaauaggagaaguc

SEQ ID NO: 133272 - RNA, 18 nt, Artificial Sequence
  Description of Artificial Sequence: Synthetic oligonucleotide
uacagaacccaauaggag

SEQ ID NO: 133273 - RNA, 18 nt, Artificial Sequence
  Description of Artificial Sequence: Synthetic oligonucleotide
caguguacagaacccaau

SEQ ID NO: 133274 - RNA, 18 nt, Artificial Sequence
  Description of Artificial Sequence: Synthetic oligonucleotide
gaacucaguguacagaac

SEQ ID NO: 133275 - RNA, 18 nt, Artificial Sequence
  Description of Artificial Sequence: Synthetic oligonucleotide
gcugugaacucaguguac

SEQ ID NO: 133276 - RNA, 18 nt, Artificial Sequence
  Description of Artificial Sequence: Synthetic oligonucleotide
augaggcugugaacucag

SEQ ID NO: 133277 - RNA, 18 nt, Artificial Sequence
  Description of Artificial Sequence: Synthetic oligonucleotide
augagaugaggcugugaa

SEQ ID NO: 133278 - RNA, 18 nt, Artificial Sequence
  Description of Artificial Sequence: Synthetic oligonucleotide
uuaacaugagaugaggcu

SEQ ID NO: 133279 - RNA, 18 nt, Artificial Sequence
  Description of Artificial Sequence: Synthetic oligonucleotide
ugucguuaacaugagaug

SEQ ID NO: 133280 - RNA, 18 nt, Artificial Sequence
  Description of Artificial Sequence: Synthetic oligonucleotide
cuggcugucguuaacaug

SEQ ID NO: 133281 - RNA, 18 nt, Artificial Sequence
  Description of Artificial Sequence: Synthetic oligonucleotide
cucuccuggcugucguua

SEQ ID NO: 133282 - RNA, 18 nt, Artificial Sequence
  Description of Artificial Sequence: Synthetic oligonucleotide
acggccucuccuggcugu

SEQ ID NO: 133283 - RNA, 18 nt, Artificial Sequence
  Description of Artificial Sequence: Synthetic oligonucleotide
ugaaaacggccucuccug

SEQ ID NO: 133284 - RNA, 18 nt, Artificial Sequence
  Description of Artificial Sequence: Synthetic oligonucleotide
uuaaaugaaaacggccuc

SEQ ID NO: 133285 - RNA, 18 nt, Artificial Sequence
  Description of Artificial Sequence: Synthetic oligonucleotide
aucuguuaaaugaaaacg

SEQ ID NO: 133286 - RNA, 18 nt, Artificial Sequence
  Description of Artificial Sequence: Synthetic oligonucleotide
gccucaucuguuaaauga

SEQ ID NO: 133287 - RNA, 18 nt, Artificial Sequence
  Description of Artificial Sequence: Synthetic oligonucleotide
gacuugccucaucuguua

SEQ ID NO: 133288 - RNA, 18 nt, Artificial Sequence
  Description of Artificial Sequence: Synthetic oligonucleotide
aucuugacuugccucauc

SEQ ID NO: 133289 - RNA, 18 nt, Artificial Sequence
  Description of Artificial Sequence: Synthetic oligonucleotide
uucaaaucuugacuugcc

SEQ ID NO: 133290 - RNA, 18 nt, Artificial Sequence
  Description of Artificial Sequence: Synthetic oligonucleotide
gucucuucaaaucuugac

SEQ ID NO: 133291 - RNA, 18 nt, Artificial Sequence
  Description of Artificial Sequence: Synthetic oligonucleotide
auauugucucuucaaauc

SEQ ID NO: 133292 - RNA, 18 nt, Artificial Sequence
  Description of Artificial Sequence: Synthetic oligonucleotide
cggccauauugucucuuc

SEQ ID NO: 133293 - RNA, 18 nt, Artificial Sequence
  Description of Artificial Sequence: Synthetic oligonucleotide
gcgcccggccauauuguc

SEQ ID NO: 133294 - RNA, 18 nt, Artificial Sequence
  Description of Artificial Sequence: Synthetic oligonucleotide
ccacugcgcccggccaua

SEQ ID NO: 133295 - RNA, 18 nt, Artificial Sequence
  Description of Artificial Sequence: Synthetic oligonucleotide
gugagccacugcgcccgg

SEQ ID NO: 133296 - RNA, 18 nt, Artificial Sequence
  Description of Artificial Sequence: Synthetic oligonucleotide
caggugugagccacugcg

SEQ ID NO: 133297 - RNA, 18 nt, Artificial Sequence
  Description of Artificial Sequence: Synthetic oligonucleotide
gauuacaggugugagcca

SEQ ID NO: 133298 - RNA, 18 nt, Artificial Sequence
  Description of Artificial Sequence: Synthetic oligonucleotide
gcugggauuacaggugug

SEQ ID NO: 133299 - RNA, 18 nt, Artificial Sequence
  Description of Artificial Sequence: Synthetic oligonucleotide
aaagugcugggauuacag

SEQ ID NO: 133300 - RNA, 18 nt, Artificial Sequence
  Description of Artificial Sequence: Synthetic oligonucleotide
cucccaaagugcugggau

SEQ ID NO: 133301 - RNA, 18 nt, Artificial Sequence
  Description of Artificial Sequence: Synthetic oligonucleotide
ucagccucccaaagugcu

SEQ ID NO: 133302 - RNA, 18 nt, Artificial Sequence
  Description of Artificial Sequence: Synthetic oligonucleotide
ccgccucagccucccaaa

SEQ ID NO: 133303 - RNA, 18 nt, Artificial Sequence
  Description of Artificial Sequence: Synthetic oligonucleotide
uccgcccgccucagccuc

SEQ ID NO: 133304 - RNA, 18 nt, Artificial Sequence
  Description of Artificial Sequence: Synthetic oligonucleotide
ggugauccgcccgccuca

SEQ ID NO: 133305 - RNA, 18 nt, Artificial Sequence
  Description of Artificial Sequence: Synthetic oligonucleotide
ccucaggugauccgcccg

SEQ ID NO: 133306 - RNA, 18 nt, Artificial Sequence
  Description of Artificial Sequence: Synthetic oligonucleotide
ccugaccucaggugaucc

SEQ ID NO: 133307 - RNA, 18 nt, Artificial Sequence
  Description of Artificial Sequence: Synthetic oligonucleotide
gaaccccugaccucaggu

SEQ ID NO: 133308 - RNA, 18 nt, Artificial Sequence
  Description of Artificial Sequence: Synthetic oligonucleotide
aucuugaaccccugaccu

SEQ ID NO: 133309 - RNA, 18 nt, Artificial Sequence
  Description of Artificial Sequence: Synthetic oligonucleotide
ggcucaucuugaaccccu

SEQ ID NO: 133310 - RNA, 18 nt, Artificial Sequence
  Description of Artificial Sequence: Synthetic oligonucleotide
agccaggcucaucuugaa

SEQ ID NO: 133311 - RNA, 18 nt, Artificial Sequence
  Description of Artificial Sequence: Synthetic oligonucleotide
auguuagccaggcucauc

SEQ ID NO: 133312 - RNA, 18 nt, Artificial Sequence
  Description of Artificial Sequence: Synthetic oligonucleotide
ucuccauguuagccaggc

SEQ ID NO: 133313 - RNA, 18 nt, Artificial Sequence
  Description of Artificial Sequence: Synthetic oligonucleotide
ggguuucuccauguuagc

SEQ ID NO: 133314 - RNA, 18 nt, Artificial Sequence
  Description of Artificial Sequence: Synthetic oligonucleotide
uuguauuuuuaguagaga

SEQ ID NO: 133315 - RNA, 18 nt, Artificial Sequence
  Description of Artificial Sequence: Synthetic oligonucleotide
aauuuuuguauuuuuagu

SEQ ID NO: 133316 - RNA, 18 nt, Artificial Sequence
  Description of Artificial Sequence: Synthetic oligonucleotide
uggcuaauuuuuguauuu

SEQ ID NO: 133317 - RNA, 18 nt, Artificial Sequence
  Description of Artificial Sequence: Synthetic oligonucleotide
augccuggcuaauuuuug

SEQ ID NO: 133318 - RNA, 18 nt, Artificial Sequence
  Description of Artificial Sequence: Synthetic oligonucleotide
ccaccaugccuggcuaau

SEQ ID NO: 133319 - RNA, 18 nt, Artificial Sequence
  Description of Artificial Sequence: Synthetic oligonucleotide
gugcaccaccaugccugg

SEQ ID NO: 133320 - RNA, 18 nt, Artificial Sequence
  Description of Artificial Sequence: Synthetic oligonucleotide
caggcgugcaccaccaug

SEQ ID NO: 133321 - RNA, 18 nt, Artificial Sequence
  Description of Artificial Sequence: Synthetic oligonucleotide
gauuacaggcgugcacca

SEQ ID NO: 133322 - RNA, 18 nt, Artificial Sequence
  Description of Artificial Sequence: Synthetic oligonucleotide
gcugggauuacaggcgug

SEQ ID NO: 133323 - RNA, 18 nt, Artificial Sequence
  Description of Artificial Sequence: Synthetic oligonucleotide
gaauagcugggauuacag

SEQ ID NO: 133324 - RNA, 18 nt, Artificial Sequence
  Description of Artificial Sequence: Synthetic oligonucleotide
cucccgaauagcugggau

SEQ ID NO: 133325 - RNA, 18 nt, Artificial Sequence
  Description of Artificial Sequence: Synthetic oligonucleotide
ucagccucccgaauagcu

SEQ ID NO: 133326 - RNA, 18 nt, Artificial Sequence
  Description of Artificial Sequence: Synthetic oligonucleotide
cugccucagccucccgaa

SEQ ID NO: 133327 - RNA, 18 nt, Artificial Sequence
  Description of Artificial Sequence: Synthetic oligonucleotide
uucuccugccucagccuc

SEQ ID NO: 133328 - RNA, 18 nt, Artificial Sequence
  Description of Artificial Sequence: Synthetic oligonucleotide
agcaauucuccugccuca

SEQ ID NO: 133329 - RNA, 18 nt, Artificial Sequence
  Description of Artificial Sequence: Synthetic oligonucleotide
guucaagcaauucuccug

SEQ ID NO: 133330 - RNA, 18 nt, Artificial Sequence
  Description of Artificial Sequence: Synthetic oligonucleotide
cccagguucaagcaauuc

SEQ ID NO: 133331 - RNA, 18 nt, Artificial Sequence
  Description of Artificial Sequence: Synthetic oligonucleotide
cgccucccagguucaagc

SEQ ID NO: 133332 - RNA, 18 nt, Artificial Sequence
  Description of Artificial Sequence: Synthetic oligonucleotide
accuccgccucccagguu

SEQ ID NO: 133333 - RNA, 18 nt, Artificial Sequence
  Description of Artificial Sequence: Synthetic oligonucleotide
cugcaaccuccgccuccc

SEQ ID NO: 133334 - RNA, 18 nt, Artificial Sequence
  Description of Artificial Sequence: Synthetic oligonucleotide
gcucacugcaaccuccgc

SEQ ID NO: 133335 - RNA, 18 nt, Artificial Sequence
  Description of Artificial Sequence: Synthetic oligonucleotide
ucuuggcucacugcaacc

SEQ ID NO: 133336 - RNA, 18 nt, Artificial Sequence
  Description of Artificial Sequence: Synthetic oligonucleotide
cgggaucuuggcucacug

SEQ ID NO: 133337 - RNA, 18 nt, Artificial Sequence
  Description of Artificial Sequence: Synthetic oligonucleotide
aguggcgggaucuuggcu

SEQ ID NO: 133338 - RNA, 18 nt, Artificial Sequence
  Description of Artificial Sequence: Synthetic oligonucleotide
aaugcaguggcgggaucu

SEQ ID NO: 133339 - RNA, 18 nt, Artificial Sequence
  Description of Artificial Sequence: Synthetic oligonucleotide
gcuggaaugcaguggcgg

SEQ ID NO: 133340 - RNA, 18 nt, Artificial Sequence
  Description of Artificial Sequence: Synthetic oligonucleotide
cccaggcuggaaugcagu

SEQ ID NO: 133341 - RNA, 18 nt, Artificial Sequence
  Description of Artificial Sequence: Synthetic oligonucleotide
agucacccaggcuggaau

SEQ ID NO: 133342 - RNA, 18 nt, Artificial Sequence
  Description of Artificial Sequence: Synthetic oligonucleotide
gauggagucacccaggcu

SEQ ID NO: 133343 - RNA, 18 nt, Artificial Sequence
  Description of Artificial Sequence: Synthetic oligonucleotide
uuugagauggagucaccc

SEQ ID NO: 133344 - RNA, 18 nt, Artificial Sequence
  Description of Artificial Sequence: Synthetic oligonucleotide
guuuuuuugagauggagu

SEQ ID NO: 133345 - RNA, 18 nt, Artificial Sequence
  Description of Artificial Sequence: Synthetic oligonucleotide
uuuuuguuuuuuugagau

SEQ ID NO: 133346 - RNA, 18 nt, Artificial Sequence
  Description of Artificial Sequence: Synthetic oligonucleotide
cuuuguuuuuguuuuuuu

SEQ ID NO: 133347 - RNA, 18 nt, Artificial Sequence
  Description of Artificial Sequence: Synthetic oligonucleotide
ccucccuuuguuuuuguu

SEQ ID NO: 133348 - RNA, 18 nt, Artificial Sequence
  Description of Artificial Sequence: Synthetic oligonucleotide
cauauccucccuuuguuu

SEQ ID NO: 133349 - RNA, 18 nt, Artificial Sequence
  Description of Artificial Sequence: Synthetic oligonucleotide
caagucauauccucccuu

SEQ ID NO: 133350 - RNA, 18 nt, Artificial Sequence
  Description of Artificial Sequence: Synthetic oligonucleotide
ccugucaagucauauccu

SEQ ID NO: 133351 - RNA, 18 nt, Artificial Sequence
  Description of Artificial Sequence: Synthetic oligonucleotide
ggugcccugucaagucau

SEQ ID NO: 133352 - RNA, 18 nt, Artificial Sequence
  Description of Artificial Sequence: Synthetic oligonucleotide
gucagggugcccugucaa

SEQ ID NO: 133353 - RNA, 18 nt, Artificial Sequence
  Description of Artificial Sequence: Synthetic oligonucleotide
uuggagucagggugcccu

SEQ ID NO: 133354 - RNA, 18 nt, Artificial Sequence
  Description of Artificial Sequence: Synthetic oligonucleotide
ggccuuuggagucagggu

SEQ ID NO: 133355 - RNA, 18 nt, Artificial Sequence
  Description of Artificial Sequence: Synthetic oligonucleotide
gcccaggccuuuggaguc

SEQ ID NO: 133356 - RNA, 18 nt, Artificial Sequence
  Description of Artificial Sequence: Synthetic oligonucleotide
ggaaagcccaggccuuug

SEQ ID NO: 133357 - RNA, 18 nt, Artificial Sequence
  Description of Artificial Sequence: Synthetic oligonucleotide
acucagguuagguuucac

SEQ ID NO: 133358 - RNA, 18 nt, Artificial Sequence
  Description of Artificial Sequence: Synthetic oligonucleotide
uagggacucagguuaggu

SEQ ID NO: 133359 - RNA, 18 nt, Artificial Sequence
  Description of Artificial Sequence: Synthetic oligonucleotide
caccuuagggacucaggu

SEQ ID NO: 133360 - RNA, 18 nt, Artificial Sequence
  Description of Artificial Sequence: Synthetic oligonucleotide
ccuaucaccuuagggacu

SEQ ID NO: 133361 - RNA, 18 nt, Artificial Sequence
  Description of Artificial Sequence: Synthetic oligonucleotide
ugcuuccuaucaccuuag

SEQ ID NO: 133362 - RNA, 18 nt, Artificial Sequence
  Description of Artificial Sequence: Synthetic oligonucleotide
guuccugcuuccuaucac

SEQ ID NO: 133363 - RNA, 18 nt, Artificial Sequence
  Description of Artificial Sequence: Synthetic oligonucleotide
cccugguuccugcuuccu

SEQ ID NO: 133364 - RNA, 18 nt, Artificial Sequence
  Description of Artificial Sequence: Synthetic oligonucleotide
cccuucccugguuccugc

SEQ ID NO: 133365 - RNA, 18 nt, Artificial Sequence
  Description of Artificial Sequence: Synthetic oligonucleotide
ggcuccccuucccugguu

SEQ ID NO: 133366 - RNA, 18 nt, Artificial Sequence
  Description of Artificial Sequence: Synthetic oligonucleotide
gaauaggcuccccuuccc

SEQ ID NO: 133367 - RNA, 18 nt, Artificial Sequence
  Description of Artificial Sequence: Synthetic oligonucleotide
uguuagaauaggcucccc

SEQ ID NO: 133368 - RNA, 18 nt, Artificial Sequence
  Description of Artificial Sequence: Synthetic oligonucleotide
uacuguguuagaauaggc

SEQ ID NO: 133369 - RNA, 18 nt, Artificial Sequence
  Description of Artificial Sequence: Synthetic oligonucleotide
gcuucuacuguguuagaa

SEQ ID NO: 133370 - RNA, 18 nt, Artificial Sequence
  Description of Artificial Sequence: Synthetic oligonucleotide
uugcugcuucuacugugu

SEQ ID NO: 133371 - RNA, 18 nt, Artificial Sequence
  Description of Artificial Sequence: Synthetic oligonucleotide
agcaguugcugcuucuac

SEQ ID NO: 133372 - RNA, 18 nt, Artificial Sequence
  Description of Artificial Sequence: Synthetic oligonucleotide
accucagcaguugcugcu

SEQ ID NO: 133373 - RNA, 18 nt, Artificial Sequence
  Description of Artificial Sequence: Synthetic oligonucleotide
uccagaccucagcaguug

SEQ ID NO: 133374 - RNA, 18 nt, Artificial Sequence
  Description of Artificial Sequence: Synthetic oligonucleotide
ccucauccagaccucagc

SEQ ID NO: 133375 - RNA, 18 nt, Artificial Sequence
  Description of Artificial Sequence: Synthetic oligonucleotide
gguccccucauccagacc

SEQ ID NO: 133376 - RNA, 18 nt, Artificial Sequence
  Description of Artificial Sequence: Synthetic oligonucleotide
guugagguccccucaucc

SEQ ID NO: 133377 - RNA, 18 nt, Artificial Sequence
  Description of Artificial Sequence: Synthetic oligonucleotide
ccacaguugagguccccu

SEQ ID NO: 133378 - RNA, 18 nt, Artificial Sequence
  Description of Artificial Sequence: Synthetic oligonucleotide
uugggccacaguugaggu

SEQ ID NO: 133379 - RNA, 18 nt, Artificial Sequence
  Description of Artificial Sequence: Synthetic oligonucleotide
ggguuuugggccacaguu

SEQ ID NO: 133380 - RNA, 18 nt, Artificial Sequence
  Description of Artificial Sequence: Synthetic oligonucleotide
ccacaaugggaacuuggg

SEQ ID NO: 133381 - RNA, 18 nt, Artificial Sequence
  Description of Artificial Sequence: Synthetic oligonucleotide
gccacaaugggaacuugg

SEQ ID NO: 133382 - RNA, 18 nt, Artificial Sequence
  Description of Artificial Sequence: Synthetic oligonucleotide
gcagagccacaaugggaa

SEQ ID NO: 133383 - RNA, 18 nt, Artificial Sequence
  Description of Artificial Sequence: Synthetic oligonucleotide
uguuggcagagccacaau

SEQ ID NO: 133384 - RNA, 18 nt, Artificial Sequence
  Description of Artificial Sequence: Synthetic oligonucleotide
ccaguuguuggcagagcc

SEQ ID NO: 133385 - RNA, 18 nt, Artificial Sequence
  Description of Artificial Sequence: Synthetic oligonucleotide
cacagccaguuguuggca

SEQ ID NO: 133386 - RNA, 18 nt, Artificial Sequence
  Description of Artificial Sequence: Synthetic oligonucleotide
ggucgcacagccaguugu

SEQ ID NO: 133387 - RNA, 18 nt, Artificial Sequence
  Description of Artificial Sequence: Synthetic oligonucleotide
uccugggucgcacagcca

SEQ ID NO: 133388 - RNA, 18 nt, Artificial Sequence
  Description of Artificial Sequence: Synthetic oligonucleotide
acuuguccugggucgcac

SEQ ID NO: 133389 - RNA, 18 nt, Artificial Sequence
  Description of Artificial Sequence: Synthetic oligonucleotide
auaggacuuguccugggu

SEQ ID NO: 133390 - RNA, 18 nt, Artificial Sequence
  Description of Artificial Sequence: Synthetic oligonucleotide
caaagauaggacuugucc

SEQ ID NO: 133391 - RNA, 18 nt, Artificial Sequence
  Description of Artificial Sequence: Synthetic oligonucleotide
cagugcaaagauaggacu

SEQ ID NO: 133392 - RNA, 18 nt, Artificial Sequence
  Description of Artificial Sequence: Synthetic oligonucleotide
agacacagugcaaagaua

SEQ ID NO: 133393 - RNA, 18 nt, Artificial Sequence
  Description of Artificial Sequence: Synthetic oligonucleotide
aacccagacacagugcaa

SEQ ID NO: 133394 - RNA, 18 nt, Artificial Sequence
  Description of Artificial Sequence: Synthetic oligonucleotide
ccucaucuuacacacggg

SEQ ID NO: 133395 - RNA, 18 nt, Artificial Sequence
  Description of Artificial Sequence: Synthetic oligonucleotide
aaccgccucaucuuacac

SEQ ID NO: 133396 - RNA, 18 nt, Artificial Sequence
  Description of Artificial Sequence: Synthetic oligonucleotide
cuagcaaccgccucaucu

SEQ ID NO: 133397 - RNA, 18 nt, Artificial Sequence
  Description of Artificial Sequence: Synthetic oligonucleotide
agcaccuagcaaccgccu

SEQ ID NO: 133398 - RNA, 18 nt, Artificial Sequence
  Description of Artificial Sequence: Synthetic oligonucleotide
caauaagcaccuagcaac

SEQ ID NO: 133399 - RNA, 18 nt, Artificial Sequence
  Description of Artificial Sequence: Synthetic oligonucleotide
gcauccaauaagcaccua

SEQ ID NO: 133400 - RNA, 18 nt, Artificial Sequence
  Description of Artificial Sequence: Synthetic oligonucleotide
ggaaugcauccaauaagc

SEQ ID NO: 133401 - RNA, 18 nt, Artificial Sequence
  Description of Artificial Sequence: Synthetic oligonucleotide
cuugaggaaugcauccaa

SEQ ID NO: 133402 - RNA, 18 nt, Artificial Sequence
  Description of Artificial Sequence: Synthetic oligonucleotide
cgggacuugaggaaugca

SEQ ID NO: 133403 - RNA, 18 nt, Artificial Sequence
  Description of Artificial Sequence: Synthetic oligonucleotide
gagggcgggacuugagga

SEQ ID NO: 133404 - RNA, 18 nt, Artificial Sequence
  Description of Artificial Sequence: Synthetic oligonucleotide
agauggagggcgggacuu

SEQ ID NO: 133405 - RNA, 18 nt, Artificial Sequence
  Description of Artificial Sequence: Synthetic oligonucleotide
auaggagauggagggcgg

SEQ ID NO: 133406 - RNA, 18 nt, Artificial Sequence
  Description of Artificial Sequence: Synthetic oligonucleotide
cuaaaccagaagagaggg

SEQ ID NO: 133407 - RNA, 18 nt, Artificial Sequence
  Description of Artificial Sequence: Synthetic oligonucleotide
aagcacuaaaccagaaga

SEQ ID NO: 133408 - RNA, 18 nt, Artificial Sequence
  Description of Artificial Sequence: Synthetic oligonucleotide
uccuaaagcacuaaacca

SEQ ID NO: 133409 - RNA, 18 nt, Artificial Sequence
  Description of Artificial Sequence: Synthetic oligonucleotide
acauuuccuaaagcacua

SEQ ID NO: 133410 - RNA, 18 nt, Artificial Sequence
  Description of Artificial Sequence: Synthetic oligonucleotide
cugccacauuuccuaaag

SEQ ID NO: 133411 - RNA, 18 nt, Artificial Sequence
  Description of Artificial Sequence: Synthetic oligonucleotide
gauuucugccacauuucc

SEQ ID NO: 133412 - RNA, 18 nt, Artificial Sequence
  Description of Artificial Sequence: Synthetic oligonucleotide
aaaaagauuucugccaca

SEQ ID NO: 133413 - RNA, 18 nt, Artificial Sequence
  Description of Artificial Sequence: Synthetic oligonucleotide
ggcagaaaaagauuucug

SEQ ID NO: 133414 - RNA, 18 nt, Artificial Sequence
  Description of Artificial Sequence: Synthetic oligonucleotide
acacaggcagaaaaagau

SEQ ID NO: 133415 - RNA, 18 nt, Artificial Sequence
  Description of Artificial Sequence: Synthetic oligonucleotide
ccuagacacaggcagaaa

SEQ ID NO: 133416 - RNA, 18 nt, Artificial Sequence
  Description of Artificial Sequence: Synthetic oligonucleotide
gauuuccuagacacaggc

SEQ ID NO: 133417 - RNA, 18 nt, Artificial Sequence
  Description of Artificial Sequence: Synthetic oligonucleotide
auuaugauuuccuagaca

SEQ ID NO: 133418 - RNA, 18 nt, Artificial Sequence
  Description of Artificial Sequence: Synthetic oligonucleotide
caugaauuaugauuuccu

SEQ ID NO: 133419 - RNA, 18 nt, Artificial Sequence
  Description of Artificial Sequence: Synthetic oligonucleotide
gccagcaugaauuaugau

SEQ ID NO: 133420 - RNA, 18 nt, Artificial Sequence
  Description of Artificial Sequence: Synthetic oligonucleotide
gguacgccagcaugaauu

SEQ ID NO: 133421 - RNA, 18 nt, Artificial Sequence
  Description of Artificial Sequence: Synthetic oligonucleotide
accaggguacgccagcau

SEQ ID NO: 133422 - RNA, 18 nt, Artificial Sequence
  Description of Artificial Sequence: Synthetic oligonucleotide
caacaaccaggguacgcc

SEQ ID NO: 133423 - RNA, 18 nt, Artificial Sequence
  Description of Artificial Sequence: Synthetic oligonucleotide
gaccucaacaaccagggu

SEQ ID NO: 133424 - RNA, 18 nt, Artificial Sequence
  Description of Artificial Sequence: Synthetic oligonucleotide
ucagggaccucaacaacc

SEQ ID NO: 133425 - RNA, 18 nt, Artificial Sequence
  Description of Artificial Sequence: Synthetic oligonucleotide
aggauucagggaccucaa

SEQ ID NO: 133426 - RNA, 18 nt, Artificial Sequence
  Description of Artificial Sequence: Synthetic oligonucleotide
gcacaaggauucagggac

SEQ ID NO: 133427 - RNA, 18 nt, Artificial Sequence
  Description of Artificial Sequence: Synthetic oligonucleotide
ugugggcacaaggauuca

SEQ ID NO: 133428 - RNA, 18 nt, Artificial Sequence
  Description of Artificial Sequence: Synthetic oligonucleotide
agcagugugggcacaagg

SEQ ID NO: 133429 - RNA, 18 nt, Artificial Sequence
  Description of Artificial Sequence: Synthetic oligonucleotide
ucuucagcagugugggca

SEQ ID NO: 133430 - RNA, 18 nt, Artificial Sequence
  Description of Artificial Sequence: Synthetic oligonucleotide
aggagucuucagcagugu

SEQ ID NO: 133431 - RNA, 18 nt, Artificial Sequence
  Description of Artificial Sequence: Synthetic oligonucleotide
acacaaggagucuucagc

SEQ ID NO: 133432 - RNA, 18 nt, Artificial Sequence
  Description of Artificial Sequence: Synthetic oligonucleotide
guaucacacaaggagucu

SEQ ID NO: 133433 - RNA, 18 nt, Artificial Sequence
  Description of Artificial Sequence: Synthetic oligonucleotide
gacuuguaucacacaagg

SEQ ID NO: 133434 - RNA, 18 nt, Artificial Sequence
  Description of Artificial Sequence: Synthetic oligonucleotide
ccccugacuuguaucaca

SEQ ID NO: 133435 - RNA, 18 nt, Artificial Sequence
  Description of Artificial Sequence: Synthetic oligonucleotide
gauguccccugacuugua

SEQ ID NO: 133436 - RNA, 18 nt, Artificial Sequence
  Description of Artificial Sequence: Synthetic oligonucleotide
acccagauguccccugac

SEQ ID NO: 133437 - RNA, 18 nt, Artificial Sequence
  Description of Artificial Sequence: Synthetic oligonucleotide
ucaagacccagauguccc

SEQ ID NO: 133438 - RNA, 18 nt, Artificial Sequence
  Description of Artificial Sequence: Synthetic oligonucleotide
gggagucaagacccagau

SEQ ID NO: 133439 - RNA, 18 nt, Artificial Sequence
  Description of Artificial Sequence: Synthetic oligonucleotide
ccagcuggagcaucuggg

SEQ ID NO: 133440 - RNA, 18 nt, Artificial Sequence
  Description of Artificial Sequence: Synthetic oligonucleotide
ggguccagcuggagcauc

SEQ ID NO: 133441 - RNA, 18 nt, Artificial Sequence
  Description of Artificial Sequence: Synthetic oligonucleotide
cagcaggguccagcugga

SEQ ID NO: 133442 - RNA, 18 nt, Artificial Sequence
  Description of Artificial Sequence: Synthetic oligonucleotide
gagggcagcaggguccag

SEQ ID NO: 133443 - RNA, 18 nt, Artificial Sequence
  Description of Artificial Sequence: Synthetic oligonucleotide
caagggagggcagcaggg

SEQ ID NO: 133444 - RNA, 18 nt, Artificial Sequence
  Description of Artificial Sequence: Synthetic oligonucleotide
gugggcaagggagggcag

SEQ ID NO: 133445 - RNA, 18 nt, Artificial Sequence
  Description of Artificial Sequence: Synthetic oligonucleotide
ucgcucagccccuuggca

SEQ ID NO: 133446 - RNA, 18 nt, Artificial Sequence
  Description of Artificial Sequence: Synthetic oligonucleotide
cuggaucgcucagccccu

SEQ ID NO: 133447 - RNA, 18 nt, Artificial Sequence
  Description of Artificial Sequence: Synthetic oligonucleotide
cuucccuggaucgcucag

SEQ ID NO: 133448 - RNA, 18 nt, Artificial Sequence
  Description of Artificial Sequence: Synthetic oligonucleotide
uugaucuucccuggaucg

SEQ ID NO: 133449 - RNA, 18 nt, Artificial Sequence
  Description of Artificial Sequence: Synthetic oligonucleotide
gccgcuugaucuucccug

SEQ ID NO: 133450 - RNA, 18 nt, Artificial Sequence
  Description of Artificial Sequence: Synthetic oligonucleotide
acgcagccgcuugaucuu

SEQ ID NO: 133451 - RNA, 18 nt, Artificial Sequence
  Description of Artificial Sequence: Synthetic oligonucleotide
ugggaacgcagccgcuug

SEQ ID NO: 133452 - RNA, 18 nt, Artificial Sequence
  Description of Artificial Sequence: Synthetic oligonucleotide
gcaccugggaacgcagcc

SEQ ID NO: 133453 - RNA, 18 nt, Artificial Sequence
  Description of Artificial Sequence: Synthetic oligonucleotide
caccugcaccugggaacg

SEQ ID NO: 133454 - RNA, 18 nt, Artificial Sequence
  Description of Artificial Sequence: Synthetic oligonucleotide
aagcucaccugcaccugg

SEQ ID NO: 133455 - RNA, 18 nt, Artificial Sequence
  Description of Artificial Sequence: Synthetic oligonucleotide
ccuccaagcucaccugca

SEQ ID NO: 133456 - RNA, 18 nt, Artificial Sequence
  Description of Artificial Sequence: Synthetic oligonucleotide
guaguccuccaagcucac

SEQ ID NO: 133457 - RNA, 18 nt, Artificial Sequence
  Description of Artificial Sequence: Synthetic oligonucleotide
uugauguaguccuccaag

SEQ ID NO: 133458 - RNA, 18 nt, Artificial Sequence
  Description of Artificial Sequence: Synthetic oligonucleotide
ggucguugauguaguccu

SEQ ID NO: 133459 - RNA, 18 nt, Artificial Sequence
  Description of Artificial Sequence: Synthetic oligonucleotide
cuggcggucguugaugua

SEQ ID NO: 133460 - RNA, 18 nt, Artificial Sequence
  Description of Artificial Sequence: Synthetic oligonucleotide
ucauacuggcggucguug

SEQ ID NO: 133461 - RNA, 18 nt, Artificial Sequence
  Description of Artificial Sequence: Synthetic oligonucleotide
gcgagucauacuggcggu

SEQ ID NO: 133462 - RNA, 18 nt, Artificial Sequence
  Description of Artificial Sequence: Synthetic oligonucleotide
gccacgcgagucauacug

SEQ ID NO: 133463 - RNA, 18 nt, Artificial Sequence
  Description of Artificial Sequence: Synthetic oligonucleotide
aagcggccacgcgaguca

SEQ ID NO: 133464 - RNA, 18 nt, Artificial Sequence
  Description of Artificial Sequence: Synthetic oligonucleotide
cuccaaagcggccacgcg

SEQ ID NO: 133465 - RNA, 18 nt, Artificial Sequence
  Description of Artificial Sequence: Synthetic oligonucleotide
cagcucuccaaagcggcc

SEQ ID NO: 133466 - RNA, 18 nt, Artificial Sequence
  Description of Artificial Sequence: Synthetic oligonucleotide
agcagcagcucuccaaag

SEQ ID NO: 133467 - RNA, 18 nt, Artificial Sequence
  Description of Artificial Sequence: Synthetic oligonucleotide
gcagcagcagcagcucuc

SEQ ID NO: 133468 - RNA, 18 nt, Artificial Sequence
  Description of Artificial Sequence: Synthetic oligonucleotide
gggcagcagcagcagcag

SEQ ID NO: 133469 - RNA, 18 nt, Artificial Sequence
  Description of Artificial Sequence: Synthetic oligonucleotide
aaggugggcagcagcagc

SEQ ID NO: 133470 - RNA, 18 nt, Artificial Sequence
  Description of Artificial Sequence: Synthetic oligonucleotide
ucugcaaggugggcagca

SEQ ID NO: 133471 - RNA, 18 nt, Artificial Sequence
  Description of Artificial Sequence: Synthetic oligonucleotide
gaugcucugcaagguggg

SEQ ID NO: 133472 - RNA, 18 nt, Artificial Sequence
  Description of Artificial Sequence: Synthetic oligonucleotide
caggugaugcucugcaag

SEQ ID NO: 133473 - RNA, 18 nt, Artificial Sequence
  Description of Artificial Sequence: Synthetic oligonucleotide
ucugccaggugaugcucu

SEQ ID NO: 133474 - RNA, 18 nt, Artificial Sequence
  Description of Artificial Sequence: Synthetic oligonucleotide
gaucaucugccaggugau

SEQ ID NO: 133475 - RNA, 18 nt, Artificial Sequence
  Description of Artificial Sequence: Synthetic oligonucleotide
ugcucgaucaucugccag

SEQ ID NO: 133476 - RNA, 18 nt, Artificial Sequence
  Description of Artificial Sequence: Synthetic oligonucleotide
ggaucugcucgaucaucu

SEQ ID NO: 133477 - RNA, 18 nt, Artificial Sequence
  Description of Artificial Sequence: Synthetic oligonucleotide
gaacuggaucugcucgau

SEQ ID NO: 133478 - RNA, 18 nt, Artificial Sequence
  Description of Artificial Sequence: Synthetic oligonucleotide
uugaugaacuggaucugc

SEQ ID NO: 133479 - RNA, 18 nt, Artificial Sequence
  Description of Artificial Sequence: Synthetic oligonucleotide
agagcuugaugaacugga

SEQ ID NO: 133480 - RNA, 18 nt, Artificial Sequence
  Description of Artificial Sequence: Synthetic oligonucleotide
gccgaagagcuugaugaa

SEQ ID NO: 133481 - RNA, 18 nt, Artificial Sequence
  Description of Artificial Sequence: Synthetic oligonucleotide
gccaugccgaagagcuug

SEQ ID NO: 133482 - RNA, 18 nt, Artificial Sequence
  Description of Artificial Sequence: Synthetic oligonucleotide
ucuuggccaugccgaaga

SEQ ID NO: 133483 - RNA, 18 nt, Artificial Sequence
  Description of Artificial Sequence: Synthetic oligonucleotide
gucaaucuuggccaugcc

SEQ ID NO: 133484 - RNA, 18 nt, Artificial Sequence
  Description of Artificial Sequence: Synthetic oligonucleotide
agguugucaaucuuggcc

SEQ ID NO: 133485 - RNA, 18 nt, Artificial Sequence
  Description of Artificial Sequence: Synthetic oligonucleotide
gcaacagguugucaaucu

SEQ ID NO: 133486 - RNA, 18 nt, Artificial Sequence
  Description of Artificial Sequence: Synthetic oligonucleotide
cuccugcaacagguuguc

SEQ ID NO: 133487 - RNA, 18 nt, Artificial Sequence
  Description of Artificial Sequence: Synthetic oligonucleotide
agcaucuccugcaacagg

SEQ ID NO: 133488 - RNA, 18 nt, Artificial Sequence
  Description of Artificial Sequence: Synthetic oligonucleotide
ccagcagcaucuccugca

SEQ ID NO: 133489 - RNA, 18 nt, Artificial Sequence
  Description of Artificial Sequence: Synthetic oligonucleotide
ucgcucagccccuuggca

SEQ ID NO: 133490 - RNA, 18 nt, Artificial Sequence
  Description of Artificial Sequence: Synthetic oligonucleotide
cuggaucgcucagccccu

SEQ ID NO: 133491 - RNA, 18 nt, Artificial Sequence
  Description of Artificial Sequence: Synthetic oligonucleotide
cuucccuggaucgcucag

SEQ ID NO: 133492 - RNA, 18 nt, Artificial Sequence
  Description of Artificial Sequence: Synthetic oligonucleotide
uugaucuucccuggaucg

SEQ ID NO: 133493 - RNA, 18 nt, Artificial Sequence
  Description of Artificial Sequence: Synthetic oligonucleotide
gccgcuugaucuucccug

SEQ ID NO: 133494 - RNA, 18 nt, Artificial Sequence
  Description of Artificial Sequence: Synthetic oligonucleotide
acgcagccgcuugaucuu

SEQ ID NO: 133495 - RNA, 18 nt, Artificial Sequence
  Description of Artificial Sequence: Synthetic oligonucleotide
ugggaacgcagccgcuug

SEQ ID NO: 133496 - RNA, 18 nt, Artificial Sequence
  Description of Artificial Sequence: Synthetic oligonucleotide
gcaccugggaacgcagcc

SEQ ID NO: 133497 - RNA, 18 nt, Artificial Sequence
  Description of Artificial Sequence: Synthetic oligonucleotide
caccugcaccugggaacg

SEQ ID NO: 133498 - RNA, 18 nt, Artificial Sequence
  Description of Artificial Sequence: Synthetic oligonucleotide
aagcucaccugcaccugg

SEQ ID NO: 133499 - RNA, 18 nt, Artificial Sequence
  Description of Artificial Sequence: Synthetic oligonucleotide
ccuccaagcucaccugca

SEQ ID NO: 133500 - RNA, 18 nt, Artificial Sequence
  Description of Artificial Sequence: Synthetic oligonucleotide
guaguccuccaagcucac

SEQ ID NO: 133501 - RNA, 18 nt, Artificial Sequence
  Description of Artificial Sequence: Synthetic oligonucleotide
uugauguaguccuccaag

SEQ ID NO: 133502 - RNA, 18 nt, Artificial Sequence
  Description of Artificial Sequence: Synthetic oligonucleotide
ggucguugauguaguccu

SEQ ID NO: 133503 - RNA, 18 nt, Artificial Sequence
  Description of Artificial Sequence: Synthetic oligonucleotide
cuggcggucguugaugua

SEQ ID NO: 133504 - RNA, 18 nt, Artificial Sequence
  Description of Artificial Sequence: Synthetic oligonucleotide
ucauacuggcggucguug

SEQ ID NO: 133505 - RNA, 18 nt, Artificial Sequence
  Description of Artificial Sequence: Synthetic oligonucleotide
gcgagucauacuggcggu

SEQ ID NO: 133506 - RNA, 18 nt, Artificial Sequence
  Description of Artificial Sequence: Synthetic oligonucleotide
gccacgcgagucauacug

SEQ ID NO: 133507 - RNA, 18 nt, Artificial Sequence
  Description of Artificial Sequence: Synthetic oligonucleotide
aagcggccacgcgaguca

SEQ ID NO: 133508 - RNA, 18 nt, Artificial Sequence
  Description of Artificial Sequence: Synthetic oligonucleotide
cuccaaagcggccacgcg

SEQ ID NO: 133509 - RNA, 18 nt, Artificial Sequence
  Description of Artificial Sequence: Synthetic oligonucleotide
cagcucuccaaagcggcc

SEQ ID NO: 133510 - RNA, 18 nt, Artificial Sequence
  Description of Artificial Sequence: Synthetic oligonucleotide
agcagcagcucuccaaag

SEQ ID NO: 133511 - RNA, 18 nt, Artificial Sequence
  Description of Artificial Sequence: Synthetic oligonucleotide
gcagcagcagcagcucuc

SEQ ID NO: 133512 - RNA, 18 nt, Artificial Sequence
  Description of Artificial Sequence: Synthetic oligonucleotide
gggcagcagcagcagcag

SEQ ID NO: 133513 - RNA, 18 nt, Artificial Sequence
  Description of Artificial Sequence: Synthetic oligonucleotide
aaggugggcagcagcagc

SEQ ID NO: 133514 - RNA, 18 nt, Artificial Sequence
  Description of Artificial Sequence: Synthetic oligonucleotide
ucugcaaggugggcagca

SEQ ID NO: 133515 - RNA, 18 nt, Artificial Sequence
  Description of Artificial Sequence: Synthetic oligonucleotide
gaugcucugcaagguggg

SEQ ID NO: 133516 - RNA, 18 nt, Artificial Sequence
  Description of Artificial Sequence: Synthetic oligonucleotide
caggugaugcucugcaag

SEQ ID NO: 133517 - RNA, 18 nt, Artificial Sequence
  Description of Artificial Sequence: Synthetic oligonucleotide
ucugccaggugaugcucu

SEQ ID NO: 133518 - RNA, 18 nt, Artificial Sequence
  Description of Artificial Sequence: Synthetic oligonucleotide
gaucaucugccaggugau

SEQ ID NO: 133519 - RNA, 18 nt, Artificial Sequence
  Description of Artificial Sequence: Synthetic oligonucleotide
ugcucgaucaucugccag

SEQ ID NO: 133520 - RNA, 18 nt, Artificial Sequence
  Description of Artificial Sequence: Synthetic oligonucleotide
ggaucugcucgaucaucu

SEQ ID NO: 133521 - RNA, 18 nt, Artificial Sequence
  Description of Artificial Sequence: Synthetic oligonucleotide
gaacuggaucugcucgau

SEQ ID NO: 133522 - RNA, 18 nt, Artificial Sequence
  Description of Artificial Sequence: Synthetic oligonucleotide
uugaugaacuggaucugc

SEQ ID NO: 133523 - RNA, 18 nt, Artificial Sequence
  Description of Artificial Sequence: Synthetic oligonucleotide
agagcuugaugaacugga

SEQ ID NO: 133524 - RNA, 18 nt, Artificial Sequence
  Description of Artificial Sequence: Synthetic oligonucleotide
gccgaagagcuugaugaa

SEQ ID NO: 133525 - RNA, 18 nt, Artificial Sequence
  Description of Artificial Sequence: Synthetic oligonucleotide
gccaugccgaagagcuug

SEQ ID NO: 133526 - RNA, 18 nt, Artificial Sequence
  Description of Artificial Sequence: Synthetic oligonucleotide
ucuuggccaugccgaaga

SEQ ID NO: 133527 - RNA, 18 nt, Artificial Sequence
  Description of Artificial Sequence: Synthetic oligonucleotide
gucaaucuuggccaugcc

SEQ ID NO: 133528 - RNA, 18 nt, Artificial Sequence
  Description of Artificial Sequence: Synthetic oligonucleotide
agguugucaaucuuggcc

SEQ ID NO: 133529 - RNA, 18 nt, Artificial Sequence
  Description of Artificial Sequence: Synthetic oligonucleotide
gcaacagguugucaaucu

SEQ ID NO: 133530 - RNA, 18 nt, Artificial Sequence
  Description of Artificial Sequence: Synthetic oligonucleotide
cuccugcaacagguuguc

SEQ ID NO: 133531 - RNA, 18 nt, Artificial Sequence
  Description of Artificial Sequence: Synthetic oligonucleotide
agcaucuccugcaacagg

SEQ ID NO: 133532 - RNA, 18 nt, Artificial Sequence
  Description of Artificial Sequence: Synthetic oligonucleotide
ccagcagcaucuccugca

SEQ ID NO: 133533 - RNA, 18 nt, Artificial Sequence
  Description of Artificial Sequence: Synthetic oligonucleotide
ccccuccugggcuuggca

SEQ ID NO: 133534 - RNA, 18 nt, Artificial Sequence
  Description of Artificial Sequence: Synthetic oligonucleotide
ccccgccccuccugggcu

SEQ ID NO: 133535 - RNA, 18 nt, Artificial Sequence
  Description of Artificial Sequence: Synthetic oligonucleotide
uccaaccccgccccuccu

SEQ ID NO: 133536 - RNA, 18 nt, Artificial Sequence
  Description of Artificial Sequence: Synthetic oligonucleotide
cccacuccaaccccgccc

SEQ ID NO: 133537 - RNA, 18 nt, Artificial Sequence
  Description of Artificial Sequence: Synthetic oligonucleotide
gaguccccacuccaaccc

SEQ ID NO: 133538 - RNA, 18 nt, Artificial Sequence
  Description of Artificial Sequence: Synthetic oligonucleotide
gggaguccccacuccaac

SEQ ID NO: 133539 - RNA, 18 nt, Artificial Sequence
  Description of Artificial Sequence: Synthetic oligonucleotide
ugaggccugucuccuggg

SEQ ID NO: 133540 - RNA, 18 nt, Artificial Sequence
  Description of Artificial Sequence: Synthetic oligonucleotide
cugugugaggccugucuc

SEQ ID NO: 133541 - RNA, 18 nt, Artificial Sequence
  Description of Artificial Sequence: Synthetic oligonucleotide
gcucacugugugaggccu

SEQ ID NO: 133542 - RNA, 18 nt, Artificial Sequence
  Description of Artificial Sequence: Synthetic oligonucleotide
ggugagcucacuguguga

SEQ ID NO: 133543 - RNA, 18 nt, Artificial Sequence
  Description of Artificial Sequence: Synthetic oligonucleotide
gggugagcucacugugug

SEQ ID NO: 133544 - RNA, 18 nt, Artificial Sequence
  Description of Artificial Sequence: Synthetic oligonucleotide
aagccaaggagcugaggg

SEQ ID NO: 133545 - RNA, 18 nt, Artificial Sequence
  Description of Artificial Sequence: Synthetic oligonucleotide
gggaagccaaggagcuga

SEQ ID NO: 133546 - RNA, 18 nt, Artificial Sequence
  Description of Artificial Sequence: Synthetic oligonucleotide
ccaaagcggcacaguggg

SEQ ID NO: 133547 - RNA, 18 nt, Artificial Sequence
  Description of Artificial Sequence: Synthetic oligonucleotide
cuugcccaaagcggcaca

SEQ ID NO: 133548 - RNA, 18 nt, Artificial Sequence
  Description of Artificial Sequence: Synthetic oligonucleotide
agcaacuugcccaaagcg

SEQ ID NO: 133549 - RNA, 18 nt, Artificial Sequence
  Description of Artificial Sequence: Synthetic oligonucleotide
gguuaagcaacuugccca

SEQ ID NO: 133550 - RNA, 18 nt, Artificial Sequence
  Description of Artificial Sequence: Synthetic oligonucleotide
agacagguuaagcaacuu

SEQ ID NO: 133551 - RNA, 18 nt, Artificial Sequence
  Description of Artificial Sequence: Synthetic oligonucleotide
ggcacagacagguuaagc

SEQ ID NO: 133552 - RNA, 18 nt, Artificial Sequence
  Description of Artificial Sequence: Synthetic oligonucleotide
acugaggcacagacaggu

SEQ ID NO: 133553 - RNA, 18 nt, Artificial Sequence
  Description of Artificial Sequence: Synthetic oligonucleotide
aggaaacugaggcacaga

SEQ ID NO: 133554 - RNA, 18 nt, Artificial Sequence
  Description of Artificial Sequence: Synthetic oligonucleotide
uggugaggaaacugaggc

SEQ ID NO: 133555 - RNA, 18 nt, Artificial Sequence
  Description of Artificial Sequence: Synthetic oligonucleotide
uuuucuggugaggaaacu

SEQ ID NO: 133556 - RNA, 18 nt, Artificial Sequence
  Description of Artificial Sequence: Synthetic oligonucleotide
cccauuuuucuggugagg

SEQ ID NO: 133557 - RNA, 18 nt, Artificial Sequence
  Description of Artificial Sequence: Synthetic oligonucleotide
uuguucccauuuuucugg

SEQ ID NO: 133558 - RNA, 18 nt, Artificial Sequence
  Description of Artificial Sequence: Synthetic oligonucleotide
uugccuuguucccauuuu

SEQ ID NO: 133559 - RNA, 18 nt, Artificial Sequence
  Description of Artificial Sequence: Synthetic oligonucleotide
gaccauugccuuguuccc

SEQ ID NO: 133560 - RNA, 18 nt, Artificial Sequence
  Description of Artificial Sequence: Synthetic oligonucleotide
aaauagaccauugccuug

SEQ ID NO: 133561 - RNA, 18 nt, Artificial Sequence
  Description of Artificial Sequence: Synthetic oligonucleotide
ugaacaaauagaccauug

SEQ ID NO: 133562 - RNA, 18 nt, Artificial Sequence
  Description of Artificial Sequence: Synthetic oligonucleotide
gugccugaacaaauagac

SEQ ID NO: 133563 - RNA, 18 nt, Artificial Sequence
  Description of Artificial Sequence: Synthetic oligonucleotide
ucucggugccugaacaaa

SEQ ID NO: 133564 - RNA, 18 nt, Artificial Sequence
  Description of Artificial Sequence: Synthetic oligonucleotide
uagguucucggugccuga

SEQ ID NO: 133565 - RNA, 18 nt, Artificial Sequence
  Description of Artificial Sequence: Synthetic oligonucleotide
cgugcuagguucucggug

SEQ ID NO: 133566 - RNA, 18 nt, Artificial Sequence
  Description of Artificial Sequence: Synthetic oligonucleotide
uggcacgugcuagguucu

SEQ ID NO: 133567 - RNA, 18 nt, Artificial Sequence
  Description of Artificial Sequence: Synthetic oligonucleotide
gugacuggcacgugcuag

SEQ ID NO: 133568 - RNA, 18 nt, Artificial Sequence
  Description of Artificial Sequence: Synthetic oligonucleotide
gaacagugacuggcacgu

SEQ ID NO: 133569 - RNA, 18 nt, Artificial Sequence
  Description of Artificial Sequence: Synthetic oligonucleotide
acuuagaacagugacugg

SEQ ID NO: 133570 - RNA, 18 nt, Artificial Sequence
  Description of Artificial Sequence: Synthetic oligonucleotide
ccagcacuuagaacagug

SEQ ID NO: 133571 - RNA, 18 nt, Artificial Sequence
  Description of Artificial Sequence: Synthetic oligonucleotide
aauugccagcacuuagaa

SEQ ID NO: 133572 - RNA, 18 nt, Artificial Sequence
  Description of Artificial Sequence: Synthetic oligonucleotide
ugcugaauugccagcacu

SEQ ID NO: 133573 - RNA, 18 nt, Artificial Sequence
  Description of Artificial Sequence: Synthetic oligonucleotide
uucuuugcugaauugcca

SEQ ID NO: 133574 - RNA, 18 nt, Artificial Sequence
  Description of Artificial Sequence: Synthetic oligonucleotide
ucuuguucuuugcugaau

SEQ ID NO: 133575 - RNA, 18 nt, Artificial Sequence
  Description of Artificial Sequence: Synthetic oligonucleotide
aaagaucuuguucuuugc

SEQ ID NO: 133576 - RNA, 18 nt, Artificial Sequence
  Description of Artificial Sequence: Synthetic oligonucleotide
agggcaaagaucuuguuc

SEQ ID NO: 133577 - RNA, 18 nt, Artificial Sequence
  Description of Artificial Sequence: Synthetic oligonucleotide
ccccgagggcaaagaucu

SEQ ID NO: 133578 - RNA, 18 nt, Artificial Sequence
  Description of Artificial Sequence: Synthetic oligonucleotide
agccuccccgagggcaaa

SEQ ID NO: 133579 - RNA, 18 nt, Artificial Sequence
  Description of Artificial Sequence: Synthetic oligonucleotide
cacacagccuccccgagg

SEQ ID NO: 133580 - RNA, 18 nt, Artificial Sequence
  Description of Artificial Sequence: Synthetic oligonucleotide
acacacacacagccuccc

SEQ ID NO: 133581 - RNA, 18 nt, Artificial Sequence
  Description of Artificial Sequence: Synthetic oligonucleotide
uacucacacacacacagc

SEQ ID NO: 133582 - RNA, 18 nt, Artificial Sequence
  Description of Artificial Sequence: Synthetic oligonucleotide
auacauacucacacacac

SEQ ID NO: 133583 - RNA, 18 nt, Artificial Sequence
  Description of Artificial Sequence: Synthetic oligonucleotide
cauccauacauacucaca

SEQ ID NO: 133584 - RNA, 18 nt, Artificial Sequence
  Description of Artificial Sequence: Synthetic oligonucleotide
ccacgcauccauacauac

SEQ ID NO: 133585 - RNA, 18 nt, Artificial Sequence
  Description of Artificial Sequence: Synthetic oligonucleotide
gauauccacgcauccaua

SEQ ID NO: 133586 - RNA, 18 nt, Artificial Sequence
  Description of Artificial Sequence: Synthetic oligonucleotide
acacagauauccacgcau

SEQ ID NO: 133587 - RNA, 18 nt, Artificial Sequence
  Description of Artificial Sequence: Synthetic oligonucleotide
cauauacacagauaucca

SEQ ID NO: 133588 - RNA, 18 nt, Artificial Sequence
  Description of Artificial Sequence: Synthetic oligonucleotide
acgggcauauacacagau

SEQ ID NO: 133589 - RNA, 18 nt, Artificial Sequence
  Description of Artificial Sequence: Synthetic oligonucleotide
cacauacgggcauauaca

SEQ ID NO: 133590 - RNA, 18 nt, Artificial Sequence
  Description of Artificial Sequence: Synthetic oligonucleotide
gcacgcacauacgggcau

SEQ ID NO: 133591 - RNA, 18 nt, Artificial Sequence
  Description of Artificial Sequence: Synthetic oligonucleotide
cacaugcacgcacauacg

SEQ ID NO: 133592 - RNA, 18 nt, Artificial Sequence
  Description of Artificial Sequence: Synthetic oligonucleotide
auauacacaugcacgcac

SEQ ID NO: 133593 - RNA, 18 nt, Artificial Sequence
  Description of Artificial Sequence: Synthetic oligonucleotide
gcuuuauauacacaugca

SEQ ID NO: 133594 - RNA, 18 nt, Artificial Sequence
  Description of Artificial Sequence: Synthetic oligonucleotide
gugaggcuuuauauacac

SEQ ID NO: 133595 - RNA, 18 nt, Artificial Sequence
  Description of Artificial Sequence: Synthetic oligonucleotide
aaaaugugaggcuuuaua

SEQ ID NO: 133596 - RNA, 18 nt, Artificial Sequence
  Description of Artificial Sequence: Synthetic oligonucleotide
aucauaaaaugugaggcu

SEQ ID NO: 133597 - RNA, 18 nt, Artificial Sequence
  Description of Artificial Sequence: Synthetic oligonucleotide
ucaaaaucauaaaaugug

SEQ ID NO: 133598 - RNA, 18 nt, Artificial Sequence
  Description of Artificial Sequence: Synthetic oligonucleotide
uuauuucaaaaucauaaa

SEQ ID NO: 133599 - RNA, 18 nt, Artificial Sequence
  Description of Artificial Sequence: Synthetic oligonucleotide
ccuguuuauuucaaaauc

SEQ ID NO: 133600 - RNA, 18 nt, Artificial Sequence
  Description of Artificial Sequence: Synthetic oligonucleotide
uauuaccuguuuauuuca

SEQ ID NO: 133601 - RNA, 18 nt, Artificial Sequence
  Description of Artificial Sequence: Synthetic oligonucleotide
uaucauauuaccuguuua

SEQ ID NO: 133602 - RNA, 18 nt, Artificial Sequence
  Description of Artificial Sequence: Synthetic oligonucleotide
aacucuaucauauuaccu

SEQ ID NO: 133603 - RNA, 18 nt, Artificial Sequence
  Description of Artificial Sequence: Synthetic oligonucleotide
aguuaaacucuaucauau

SEQ ID NO: 133604 - RNA, 18 nt, Artificial Sequence
  Description of Artificial Sequence: Synthetic oligonucleotide
uuuucaguuaaacucuau

SEQ ID NO: 133605 - RNA, 18 nt, Artificial Sequence
  Description of Artificial Sequence: Synthetic oligonucleotide
auuccuuuucaguuaaac

SEQ ID NO: 133606 - RNA, 18 nt, Artificial Sequence
  Description of Artificial Sequence: Synthetic oligonucleotide
agaggauuccuuuucagu

SEQ ID NO: 133607 - RNA, 18 nt, Artificial Sequence
  Description of Artificial Sequence: Synthetic oligonucleotide
ucuaaagaggauuccuuu

SEQ ID NO: 133608 - RNA, 18 nt, Artificial Sequence
  Description of Artificial Sequence: Synthetic oligonucleotide
cccuaucuaaagaggauu

SEQ ID NO: 133609 - RNA, 18 nt, Artificial Sequence
  Description of Artificial Sequence: Synthetic oligonucleotide
gccuccccuaucuaaaga

SEQ ID NO: 133610 - RNA, 18 nt, Artificial Sequence
  Description of Artificial Sequence: Synthetic oligonucleotide
cuguggccuccccuaucu

SEQ ID NO: 133611 - RNA, 18 nt, Artificial Sequence
  Description of Artificial Sequence: Synthetic oligonucleotide
gucuccuguggccucccc

SEQ ID NO: 133612 - RNA, 18 nt, Artificial Sequence
  Description of Artificial Sequence: Synthetic oligonucleotide
gagaggucuccuguggcc

SEQ ID NO: 133613 - RNA, 18 nt, Artificial Sequence
  Description of Artificial Sequence: Synthetic oligonucleotide
cuucagagaggucuccug

SEQ ID NO: 133614 - RNA, 18 nt, Artificial Sequence
  Description of Artificial Sequence: Synthetic oligonucleotide
caccacuucagagagguc

SEQ ID NO: 133615 - RNA, 18 nt, Artificial Sequence
  Description of Artificial Sequence: Synthetic oligonucleotide
agagucaccacuucagag

SEQ ID NO: 133616 - RNA, 18 nt, Artificial Sequence
  Description of Artificial Sequence: Synthetic oligonucleotide
gcacaagagucaccacuu

SEQ ID NO: 133617 - RNA, 18 nt, Artificial Sequence
  Description of Artificial Sequence: Synthetic oligonucleotide
ucuuagcacaagagucac

SEQ ID NO: 133618 - RNA, 18 nt, Artificial Sequence
  Description of Artificial Sequence: Synthetic oligonucleotide
uagggucuuagcacaaga

SEQ ID NO: 133619 - RNA, 18 nt, Artificial Sequence
  Description of Artificial Sequence: Synthetic oligonucleotide
gccguuagggucuuagca

SEQ ID NO: 133620 - RNA, 18 nt, Artificial Sequence
  Description of Artificial Sequence: Synthetic oligonucleotide
uuucagccguuagggucu

SEQ ID NO: 133621 - RNA, 18 nt, Artificial Sequence
  Description of Artificial Sequence: Synthetic oligonucleotide
uuuccuuucagccguuag

SEQ ID NO: 133622 - RNA, 18 nt, Artificial Sequence
  Description of Artificial Sequence: Synthetic oligonucleotide
uuccauuuccuuucagcc

SEQ ID NO: 133623 - RNA, 18 nt, Artificial Sequence
  Description of Artificial Sequence: Synthetic oligonucleotide
aagccuuccauuuccuuu

SEQ ID NO: 133624 - RNA, 18 nt, Artificial Sequence
  Description of Artificial Sequence: Synthetic oligonucleotide
cuuuuaagccuuccauuu

SEQ ID NO: 133625 - RNA, 18 nt, Artificial Sequence
  Description of Artificial Sequence: Synthetic oligonucleotide
cuugucuuuuaagccuuc

SEQ ID NO: 133626 - RNA, 18 nt, Artificial Sequence
  Description of Artificial Sequence: Synthetic oligonucleotide
ccucucuugucuuuuaag

SEQ ID NO: 133627 - RNA, 18 nt, Artificial Sequence
  Description of Artificial Sequence: Synthetic oligonucleotide
auauuccucucuugucuu

SEQ ID NO: 133628 - RNA, 18 nt, Artificial Sequence
  Description of Artificial Sequence: Synthetic oligonucleotide
guuuuuccaccccaaacc

SEQ ID NO: 133629 - RNA, 18 nt, Artificial Sequence
  Description of Artificial Sequence: Synthetic oligonucleotide
gagauguuuuuccacccc

SEQ ID NO: 133630 - RNA, 18 nt, Artificial Sequence
  Description of Artificial Sequence: Synthetic oligonucleotide
ugucagagauguuuuucc

SEQ ID NO: 133631 - RNA, 18 nt, Artificial Sequence
  Description of Artificial Sequence: Synthetic oligonucleotide
gcuucugucagagauguu

SEQ ID NO: 133632 - RNA, 18 nt, Artificial Sequence
  Description of Artificial Sequence: Synthetic oligonucleotide
uuguugcuucugucagag

SEQ ID NO: 133633 - RNA, 18 nt, Artificial Sequence
  Description of Artificial Sequence: Synthetic oligonucleotide
ucacguuguugcuucugu

SEQ ID NO: 133634 - RNA, 18 nt, Artificial Sequence
  Description of Artificial Sequence: Synthetic oligonucleotide
ucugcucacguuguugcu

SEQ ID NO: 133635 - RNA, 18 nt, Artificial Sequence
  Description of Artificial Sequence: Synthetic oligonucleotide
augcuucugcucacguug

SEQ ID NO: 133636 - RNA, 18 nt, Artificial Sequence
  Description of Artificial Sequence: Synthetic oligonucleotide
ucucuaugcuucugcuca

SEQ ID NO: 133637 - RNA, 18 nt, Artificial Sequence
  Description of Artificial Sequence: Synthetic oligonucleotide
uucuaucucuaugcuucu

SEQ ID NO: 133638 - RNA, 18 nt, Artificial Sequence
  Description of Artificial Sequence: Synthetic oligonucleotide
uguuuuucuaucucuaug

SEQ ID NO: 133639 - RNA, 18 nt, Artificial Sequence
  Description of Artificial Sequence: Synthetic oligonucleotide
cccuguguuuuucuaucu

SEQ ID NO: 133640 - RNA, 18 nt, Artificial Sequence
  Description of Artificial Sequence: Synthetic oligonucleotide
guguccccuguguuuuuc

SEQ ID NO: 133641 - RNA, 18 nt, Artificial Sequence
  Description of Artificial Sequence: Synthetic oligonucleotide
ucuauguguccccugugu

SEQ ID NO: 133642 - RNA, 18 nt, Artificial Sequence
  Description of Artificial Sequence: Synthetic oligonucleotide
uagcaucuaugugucccc

SEQ ID NO: 133643 - RNA, 18 nt, Artificial Sequence
  Description of Artificial Sequence: Synthetic oligonucleotide
acuuauagcaucuaugug

SEQ ID NO: 133644 - RNA, 18 nt, Artificial Sequence
  Description of Artificial Sequence: Synthetic oligonucleotide
gaccuacuuauagcaucu

SEQ ID NO: 133645 - RNA, 18 nt, Artificial Sequence
  Description of Artificial Sequence: Synthetic oligonucleotide
caacugaccuacuuauag

SEQ ID NO: 133646 - RNA, 18 nt, Artificial Sequence
  Description of Artificial Sequence: Synthetic oligonucleotide
gcagccaacugaccuacu

SEQ ID NO: 133647 - RNA, 18 nt, Artificial Sequence
  Description of Artificial Sequence: Synthetic oligonucleotide
cugcugcagccaacugac

SEQ ID NO: 133648 - RNA, 18 nt, Artificial Sequence
  Description of Artificial Sequence: Synthetic oligonucleotide
caucucugcugcagccaa

SEQ ID NO: 133649 - RNA, 18 nt, Artificial Sequence
  Description of Artificial Sequence: Synthetic oligonucleotide
ccccacaucucugcugca

SEQ ID NO: 133650 - RNA, 18 nt, Artificial Sequence
  Description of Artificial Sequence: Synthetic oligonucleotide
ucaucccccacaucucug

SEQ ID NO: 133651 - RNA, 18 nt, Artificial Sequence
  Description of Artificial Sequence: Synthetic oligonucleotide
cagccucaucccccacau

SEQ ID NO: 133652 - RNA, 18 nt, Artificial Sequence
  Description of Artificial Sequence: Synthetic oligonucleotide
ccuuucagccucaucccc

SEQ ID NO: 133653 - RNA, 18 nt, Artificial Sequence
  Description of Artificial Sequence: Synthetic oligonucleotide
ccucaccuuucagccuca

SEQ ID NO: 133654 - RNA, 18 nt, Artificial Sequence
  Description of Artificial Sequence: Synthetic oligonucleotide
ucccgccucaccuuucag

SEQ ID NO: 133655 - RNA, 18 nt, Artificial Sequence
  Description of Artificial Sequence: Synthetic oligonucleotide
uuuggucccgccucaccu

SEQ ID NO: 133656 - RNA, 18 nt, Artificial Sequence
  Description of Artificial Sequence: Synthetic oligonucleotide
aaccauuuggucccgccu

SEQ ID NO: 133657 - RNA, 18 nt, Artificial Sequence
  Description of Artificial Sequence: Synthetic oligonucleotide
ccuucaaccauuuggucc

SEQ ID NO: 133658 - RNA, 18 nt, Artificial Sequence
  Description of Artificial Sequence: Synthetic oligonucleotide
caaguccuucaaccauuu

SEQ ID NO: 133659 - RNA, 18 nt, Artificial Sequence
  Description of Artificial Sequence: Synthetic oligonucleotide
gagugcaaguccuucaac

SEQ ID NO: 133660 - RNA, 18 nt, Artificial Sequence
  Description of Artificial Sequence: Synthetic oligonucleotide
ccuuggagugcaaguccu

SEQ ID NO: 133661 - RNA, 18 nt, Artificial Sequence
  Description of Artificial Sequence: Synthetic oligonucleotide
aagcuccuuggagugcaa

SEQ ID NO: 133662 - RNA, 18 nt, Artificial Sequence
  Description of Artificial Sequence: Synthetic oligonucleotide
ucucaaagcuccuuggag

SEQ ID NO: 133663 - RNA, 18 nt, Artificial Sequence
  Description of Artificial Sequence: Synthetic oligonucleotide
auggcucucaaagcuccu

SEQ ID NO: 133664 - RNA, 18 nt, Artificial Sequence
  Description of Artificial Sequence: Synthetic oligonucleotide
aaucaauggcucucaaag

SEQ ID NO: 133665 - RNA, 18 nt, Artificial Sequence
  Description of Artificial Sequence: Synthetic oligonucleotide
gauguaaucaauggcucu

SEQ ID NO: 133666 - RNA, 18 nt, Artificial Sequence
  Description of Artificial Sequence: Synthetic oligonucleotide
uaauggauguaaucaaug

SEQ ID NO: 133667 - RNA, 18 nt, Artificial Sequence
  Description of Artificial Sequence: Synthetic oligonucleotide
uaacauaauggauguaau

SEQ ID NO: 133668 - RNA, 18 nt, Artificial Sequence
  Description of Artificial Sequence: Synthetic oligonucleotide
cauaguaacauaauggau

SEQ ID NO: 133669 - RNA, 18 nt, Artificial Sequence
  Description of Artificial Sequence: Synthetic oligonucleotide
ggucacauaguaacauaa

SEQ ID NO: 133670 - RNA, 18 nt, Artificial Sequence
  Description of Artificial Sequence: Synthetic oligonucleotide
guauuggucacauaguaa

SEQ ID NO: 133671 - RNA, 18 nt, Artificial Sequence
  Description of Artificial Sequence: Synthetic oligonucleotide
guaguguauuggucacau

SEQ ID NO: 133672 - RNA, 18 nt, Artificial Sequence
  Description of Artificial Sequence: Synthetic oligonucleotide
aaugaguaguguauuggu

SEQ ID NO: 133673 - RNA, 18 nt, Artificial Sequence
  Description of Artificial Sequence: Synthetic oligonucleotide
guucuaaugaguagugua

SEQ ID NO: 133674 - RNA, 18 nt, Artificial Sequence
  Description of Artificial Sequence: Synthetic oligonucleotide
uaaauguucuaaugagua

SEQ ID NO: 133675 - RNA, 18 nt, Artificial Sequence
  Description of Artificial Sequence: Synthetic oligonucleotide
ucacguaaauguucuaau

SEQ ID NO: 133676 - RNA, 18 nt, Artificial Sequence
  Description of Artificial Sequence: Synthetic oligonucleotide
ugagaucacguaaauguu

SEQ ID NO: 133677 - RNA, 18 nt, Artificial Sequence
  Description of Artificial Sequence: Synthetic oligonucleotide
agcucugagaucacguaa

SEQ ID NO: 133678 - RNA, 18 nt, Artificial Sequence
  Description of Artificial Sequence: Synthetic oligonucleotide
aaggaagcucugagauca

SEQ ID NO: 133679 - RNA, 18 nt, Artificial Sequence
  Description of Artificial Sequence: Synthetic oligonucleotide
cauauaaggaagcucuga

SEQ ID NO: 133680 - RNA, 18 nt, Artificial Sequence
  Description of Artificial Sequence: Synthetic oligonucleotide
aggugcauauaaggaagc

SEQ ID NO: 133681 - RNA, 18 nt, Artificial Sequence
  Description of Artificial Sequence: Synthetic oligonucleotide
gaacaaggugcauauaag

SEQ ID NO: 133682 - RNA, 18 nt, Artificial Sequence
  Description of Artificial Sequence: Synthetic oligonucleotide
gaaaggaacaaggugcau

SEQ ID NO: 133683 - RNA, 18 nt, Artificial Sequence
  Description of Artificial Sequence: Synthetic oligonucleotide
gaguugaaaggaacaagg

SEQ ID NO: 133684 - RNA, 18 nt, Artificial Sequence
  Description of Artificial Sequence: Synthetic oligonucleotide
aaagugaguugaaaggaa

SEQ ID NO: 133685 - RNA, 18 nt, Artificial Sequence
  Description of Artificial Sequence: Synthetic oligonucleotide
gaacaaaagugaguugaa

SEQ ID NO: 133686 - RNA, 18 nt, Artificial Sequence
  Description of Artificial Sequence: Synthetic oligonucleotide
caagagaacaaaagugag

SEQ ID NO: 133687 - RNA, 18 nt, Artificial Sequence
  Description of Artificial Sequence: Synthetic oligonucleotide
aaaaccaagagaacaaaa

SEQ ID NO: 133688 - RNA, 18 nt, Artificial Sequence
  Description of Artificial Sequence: Synthetic oligonucleotide
cccaaaaaaccaagagaa

SEQ ID NO: 133689 - RNA, 18 nt, Artificial Sequence
  Description of Artificial Sequence: Synthetic oligonucleotide
aggaccccaaaaaaccaa

SEQ ID NO: 133690 - RNA, 18 nt, Artificial Sequence
  Description of Artificial Sequence: Synthetic oligonucleotide
uuaagaggaccccaaaaa

SEQ ID NO: 133691 - RNA, 18 nt, Artificial Sequence
  Description of Artificial Sequence: Synthetic oligonucleotide
ggguguuaagaggacccc

SEQ ID NO: 133692 - RNA, 18 nt, Artificial Sequence
  Description of Artificial Sequence: Synthetic oligonucleotide
caugaggguguuaagagg

SEQ ID NO: 133693 - RNA, 18 nt, Artificial Sequence
  Description of Artificial Sequence: Synthetic oligonucleotide
gacuucaugaggguguua

SEQ ID NO: 133694 - RNA, 18 nt, Artificial Sequence
  Description of Artificial Sequence: Synthetic oligonucleotide
cuauagacuucaugaggg

SEQ ID NO: 133695 - RNA, 18 nt, Artificial Sequence
  Description of Artificial Sequence: Synthetic oligonucleotide
cccaucuauagacuucau

SEQ ID NO: 133696 - RNA, 18 nt, Artificial Sequence
  Description of Artificial Sequence: Synthetic oligonucleotide
ccauucccaucuauagac

SEQ ID NO: 133697 - RNA, 18 nt, Artificial Sequence
  Description of Artificial Sequence: Synthetic oligonucleotide
guguaccauucccaucua

SEQ ID NO: 133698 - RNA, 18 nt, Artificial Sequence
  Description of Artificial Sequence: Synthetic oligonucleotide
cuaggguguaccauuccc

SEQ ID NO: 133699 - RNA, 18 nt, Artificial Sequence
  Description of Artificial Sequence: Synthetic oligonucleotide
guaaacuaggguguacca

SEQ ID NO: 133700 - RNA, 18 nt, Artificial Sequence
  Description of Artificial Sequence: Synthetic oligonucleotide
gguuaguaaacuagggug

SEQ ID NO: 133701 - RNA, 18 nt, Artificial Sequence
  Description of Artificial Sequence: Synthetic oligonucleotide
uccuggguuaguaaacua

SEQ ID NO: 133702 - RNA, 18 nt, Artificial Sequence
  Description of Artificial Sequence: Synthetic oligonucleotide
ccuauuccuggguuagua

SEQ ID NO: 133703 - RNA, 18 nt, Artificial Sequence
  Description of Artificial Sequence: Synthetic oligonucleotide
ggguaccuauuccugggu

SEQ ID NO: 133704 - RNA, 18 nt, Artificial Sequence
  Description of Artificial Sequence: Synthetic oligonucleotide
cuguuggguaccuauucc

SEQ ID NO: 133705 - RNA, 18 nt, Artificial Sequence
  Description of Artificial Sequence: Synthetic oligonucleotide
agugccuguuggguaccu

SEQ ID NO: 133706 - RNA, 18 nt, Artificial Sequence
  Description of Artificial Sequence: Synthetic oligonucleotide
uuggcagugccuguuggg

SEQ ID NO: 133707 - RNA, 18 nt, Artificial Sequence
  Description of Artificial Sequence: Synthetic oligonucleotide
caauauuggcagugccug

SEQ ID NO: 133708 - RNA, 18 nt, Artificial Sequence
  Description of Artificial Sequence: Synthetic oligonucleotide
ccauccaauauuggcagu

SEQ ID NO: 133709 - RNA, 18 nt, Artificial Sequence
  Description of Artificial Sequence: Synthetic oligonucleotide
ccagcccauccaauauug

SEQ ID NO: 133710 - RNA, 18 nt, Artificial Sequence
  Description of Artificial Sequence: Synthetic oligonucleotide
aucaaccagcccauccaa

SEQ ID NO: 133711 - RNA, 18 nt, Artificial Sequence
  Description of Artificial Sequence: Synthetic oligonucleotide
ggccaaucaaccagccca

SEQ ID NO: 133712 - RNA, 18 nt, Artificial Sequence
  Description of Artificial Sequence: Synthetic oligonucleotide
ggcguggccaaucaacca

SEQ ID NO: 133713 - RNA, 18 nt, Artificial Sequence
  Description of Artificial Sequence: Synthetic oligonucleotide
ccucaggcguggccaauc

SEQ ID NO: 133714 - RNA, 18 nt, Artificial Sequence
  Description of Artificial Sequence: Synthetic oligonucleotide
aucuuccucaggcguggc

SEQ ID NO: 133715 - RNA, 18 nt, Artificial Sequence
  Description of Artificial Sequence: Synthetic oligonucleotide
acgccaucuuccucaggc

SEQ ID NO: 133716 - RNA, 18 nt, Artificial Sequence
  Description of Artificial Sequence: Synthetic oligonucleotide
uugggacgccaucuuccu

SEQ ID NO: 133717 - RNA, 18 nt, Artificial Sequence
  Description of Artificial Sequence: Synthetic oligonucleotide
aggccuugggacgccauc

SEQ ID NO: 133718 - RNA, 18 nt, Artificial Sequence
  Description of Artificial Sequence: Synthetic oligonucleotide
accucaggccuugggacg

SEQ ID NO: 133719 - RNA, 18 nt, Artificial Sequence
  Description of Artificial Sequence: Synthetic oligonucleotide
ugcagaccucaggccuug

SEQ ID NO: 133720 - RNA, 18 nt, Artificial Sequence
  Description of Artificial Sequence: Synthetic oligonucleotide
ugggaugcagaccucagg

SEQ ID NO: 133721 - RNA, 18 nt, Artificial Sequence
  Description of Artificial Sequence: Synthetic oligonucleotide
gagucugggaugcagacc

SEQ ID NO: 133722 - RNA, 18 nt, Artificial Sequence
  Description of Artificial Sequence: Synthetic oligonucleotide
auggagagucugggaugc

SEQ ID NO: 133723 - RNA, 18 nt, Artificial Sequence
  Description of Artificial Sequence: Synthetic oligonucleotide
ucaggauggagagucugg

SEQ ID NO: 133724 - RNA, 18 nt, Artificial Sequence
  Description of Artificial Sequence: Synthetic oligonucleotide
gucgaucaggauggagag

SEQ ID NO: 133725 - RNA, 18 nt, Artificial Sequence
  Description of Artificial Sequence: Synthetic oligonucleotide
gcaucaggugagggugca

SEQ ID NO: 133726 - RNA, 18 nt, Artificial Sequence
  Description of Artificial Sequence: Synthetic oligonucleotide
uuccugcaucaggugagg

SEQ ID NO: 133727 - RNA, 18 nt, Artificial Sequence
  Description of Artificial Sequence: Synthetic oligonucleotide
auauguuccugcaucagg

SEQ ID NO: 133728 - RNA, 18 nt, Artificial Sequence
  Description of Artificial Sequence: Synthetic oligonucleotide
uucccauauguuccugca

SEQ ID NO: 133729 - RNA, 18 nt, Artificial Sequence
  Description of Artificial Sequence: Synthetic oligonucleotide
guugguucccauauguuc

SEQ ID NO: 133730 - RNA, 18 nt, Artificial Sequence
  Description of Artificial Sequence: Synthetic oligonucleotide
augacguugguucccaua

SEQ ID NO: 133731 - RNA, 18 nt, Artificial Sequence
  Description of Artificial Sequence: Synthetic oligonucleotide
caacgaugacguugguuc

SEQ ID NO: 133732 - RNA, 18 nt, Artificial Sequence
  Description of Artificial Sequence: Synthetic oligonucleotide
guuggcaacgaugacguu

SEQ ID NO: 133733 - RNA, 18 nt, Artificial Sequence
  Description of Artificial Sequence: Synthetic oligonucleotide
auuguguuggcaacgaug

SEQ ID NO: 133734 - RNA, 18 nt, Artificial Sequence
  Description of Artificial Sequence: Synthetic oligonucleotide
ugggcauuguguuggcaa

SEQ ID NO: 133735 - RNA, 18 nt, Artificial Sequence
  Description of Artificial Sequence: Synthetic oligonucleotide
gugagugggcauuguguu

SEQ ID NO: 133736 - RNA, 18 nt, Artificial Sequence
  Description of Artificial Sequence: Synthetic oligonucleotide
cugaggugagugggcauu

SEQ ID NO: 133737 - RNA, 18 nt, Artificial Sequence
  Description of Artificial Sequence: Synthetic oligonucleotide
cguugcugaggugagugg

SEQ ID NO: 133738 - RNA, 18 nt, Artificial Sequence
  Description of Artificial Sequence: Synthetic oligonucleotide
cuguccguugcugaggug

SEQ ID NO: 133739 - RNA, 18 nt, Artificial Sequence
  Description of Artificial Sequence: Synthetic oligonucleotide
cacaucuguccguugcug

SEQ ID NO: 133740 - RNA, 18 nt, Artificial Sequence
  Description of Artificial Sequence: Synthetic oligonucleotide
acucacacaucuguccgu

SEQ ID NO: 133741 - RNA, 18 nt, Artificial Sequence
  Description of Artificial Sequence: Synthetic oligonucleotide
gggccacucacacaucug

SEQ ID NO: 133742 - RNA, 18 nt, Artificial Sequence
  Description of Artificial Sequence: Synthetic oligonucleotide
ucaggugagggugcaggg

SEQ ID NO: 133743 - RNA, 18 nt, Artificial Sequence
  Description of Artificial Sequence: Synthetic oligonucleotide
ugcaucaggugagggugc

SEQ ID NO: 133744 - RNA, 18 nt, Artificial Sequence
  Description of Artificial Sequence: Synthetic oligonucleotide
guuccugcaucaggugag

SEQ ID NO: 133745 - RNA, 18 nt, Artificial Sequence
  Description of Artificial Sequence: Synthetic oligonucleotide
cauauguuccugcaucag

SEQ ID NO: 133746 - RNA, 18 nt, Artificial Sequence
  Description of Artificial Sequence: Synthetic oligonucleotide
guucccauauguuccugc

SEQ ID NO: 133747 - RNA, 18 nt, Artificial Sequence
  Description of Artificial Sequence: Synthetic oligonucleotide
cguugguucccauauguu

SEQ ID NO: 133748 - RNA, 18 nt, Artificial Sequence
  Description of Artificial Sequence: Synthetic oligonucleotide
gaugacguugguucccau

SEQ ID NO: 133749 - RNA, 18 nt, Artificial Sequence
  Description of Artificial Sequence: Synthetic oligonucleotide
gcaacgaugacguugguu

SEQ ID NO: 133750 - RNA, 18 nt, Artificial Sequence
  Description of Artificial Sequence: Synthetic oligonucleotide
uguuggcaacgaugacgu

SEQ ID NO: 133751 - RNA, 18 nt, Artificial Sequence
  Description of Artificial Sequence: Synthetic oligonucleotide
cauuguguuggcaacgau

SEQ ID NO: 133752 - RNA, 18 nt, Artificial Sequence
  Description of Artificial Sequence: Synthetic oligonucleotide
gugggcauuguguuggca

SEQ ID NO: 133753 - RNA, 18 nt, Artificial Sequence
  Description of Artificial Sequence: Synthetic oligonucleotide
ggugagugggcauugugu

SEQ ID NO: 133754 - RNA, 18 nt, Artificial Sequence
  Description of Artificial Sequence: Synthetic oligonucleotide
gcugaggugagugggcau

SEQ ID NO: 133755 - RNA, 18 nt, Artificial Sequence
  Description of Artificial Sequence: Synthetic oligonucleotide
ccguugcugaggugagug

SEQ ID NO: 133756 - RNA, 18 nt, Artificial Sequence
  Description of Artificial Sequence: Synthetic oligonucleotide
ucuguccguugcugaggu

SEQ ID NO: 133757 - RNA, 18 nt, Artificial Sequence
  Description of Artificial Sequence: Synthetic oligonucleotide
acacaucuguccguugcu

SEQ ID NO: 133758 - RNA, 18 nt, Artificial Sequence
  Description of Artificial Sequence: Synthetic oligonucleotide
cacucacacaucuguccg

SEQ ID NO: 133759 - RNA, 18 nt, Artificial Sequence
  Description of Artificial Sequence: Synthetic oligonucleotide
ccuguccccugggucggg

SEQ ID NO: 133760 - RNA, 18 nt, Artificial Sequence
  Description of Artificial Sequence: Synthetic oligonucleotide
guaaaaucccagaguuug

SEQ ID NO: 133761 - RNA, 18 nt, Artificial Sequence
  Description of Artificial Sequence: Synthetic oligonucleotide
gcaagguaaaaucccaga

SEQ ID NO: 133762 - RNA, 18 nt, Artificial Sequence
  Description of Artificial Sequence: Synthetic oligonucleotide
ccuuugcaagguaaaauc

SEQ ID NO: 133763 - RNA, 18 nt, Artificial Sequence
  Description of Artificial Sequence: Synthetic oligonucleotide
cucacccuuugcaaggua

SEQ ID NO: 133764 - RNA, 18 nt, Artificial Sequence
  Description of Artificial Sequence: Synthetic oligonucleotide
ccauccucacccuuugca

SEQ ID NO: 133765 - RNA, 18 nt, Artificial Sequence
  Description of Artificial Sequence: Synthetic oligonucleotide
aagccccauccucacccu

SEQ ID NO: 133766 - RNA, 18 nt, Artificial Sequence
  Description of Artificial Sequence: Synthetic oligonucleotide
gucuuaagccccauccuc

SEQ ID NO: 133767 - RNA, 18 nt, Artificial Sequence
  Description of Artificial Sequence: Synthetic oligonucleotide
cuccugucuuaagcccca

SEQ ID NO: 133768 - RNA, 18 nt, Artificial Sequence
  Description of Artificial Sequence: Synthetic oligonucleotide
ccugccuccugucuuaag

SEQ ID NO: 133769 - RNA, 18 nt, Artificial Sequence
  Description of Artificial Sequence: Synthetic oligonucleotide
uuucuccugccuccuguc

SEQ ID NO: 133770 - RNA, 18 nt, Artificial Sequence
  Description of Artificial Sequence: Synthetic oligonucleotide
uccacuuucuccugccuc

SEQ ID NO: 133771 - RNA, 18 nt, Artificial Sequence
  Description of Artificial Sequence: Synthetic oligonucleotide
uagacuccacuuucuccu

SEQ ID NO: 133772 - RNA, 18 nt, Artificial Sequence
  Description of Artificial Sequence: Synthetic oligonucleotide
ccuucuagacuccacuuu

SEQ ID NO: 133773 - RNA, 18 nt, Artificial Sequence
  Description of Artificial Sequence: Synthetic oligonucleotide
uucuaccuucuagacucc

SEQ ID NO: 133774 - RNA, 18 nt, Artificial Sequence
  Description of Artificial Sequence: Synthetic oligonucleotide
ccugguucuaccuucuag

SEQ ID NO: 133775 - RNA, 18 nt, Artificial Sequence
  Description of Artificial Sequence: Synthetic oligonucleotide
ugcauccugguucuaccu

SEQ ID NO: 133776 - RNA, 18 nt, Artificial Sequence
  Description of Artificial Sequence: Synthetic oligonucleotide
acuguugcauccugguuc

SEQ ID NO: 133777 - RNA, 18 nt, Artificial Sequence
  Description of Artificial Sequence: Synthetic oligonucleotide
agaaaacuguugcauccu

SEQ ID NO: 133778 - RNA, 18 nt, Artificial Sequence
  Description of Artificial Sequence: Synthetic oligonucleotide
aacccagaaaacuguugc

SEQ ID NO: 133779 - RNA, 18 nt, Artificial Sequence
  Description of Artificial Sequence: Synthetic oligonucleotide
ccuggaacccagaaaacu

SEQ ID NO: 133780 - RNA, 18 nt, Artificial Sequence
  Description of Artificial Sequence: Synthetic oligonucleotide
ccuacccuggaacccaga

SEQ ID NO: 133781 - RNA, 18 nt, Artificial Sequence
  Description of Artificial Sequence: Synthetic oligonucleotide
uauucccuacccuggaac

SEQ ID NO: 133782 - RNA, 18 nt, Artificial Sequence
  Description of Artificial Sequence: Synthetic oligonucleotide
cccuuuauucccuacccu

SEQ ID NO: 133783 - RNA, 18 nt, Artificial Sequence
  Description of Artificial Sequence: Synthetic oligonucleotide
ucuugcccuuuauucccu

SEQ ID NO: 133784 - RNA, 18 nt, Artificial Sequence
  Description of Artificial Sequence: Synthetic oligonucleotide
gacaaucuugcccuuuau

SEQ ID NO: 133785 - RNA, 18 nt, Artificial Sequence
  Description of Artificial Sequence: Synthetic oligonucleotide
aaauggacaaucuugccc

SEQ ID NO: 133786 - RNA, 18 nt, Artificial Sequence
  Description of Artificial Sequence: Synthetic oligonucleotide
ucaacaaauggacaaucu

SEQ ID NO: 133787 - RNA, 18 nt, Artificial Sequence
  Description of Artificial Sequence: Synthetic oligonucleotide
cagccucaacaaauggac

SEQ ID NO: 133788 - RNA, 18 nt, Artificial Sequence
  Description of Artificial Sequence: Synthetic oligonucleotide
auaaacagccucaacaaa

SEQ ID NO: 133789 - RNA, 18 nt, Artificial Sequence
  Description of Artificial Sequence: Synthetic oligonucleotide
acugaauaaacagccuca

SEQ ID NO: 133790 - RNA, 18 nt, Artificial Sequence
  Description of Artificial Sequence: Synthetic oligonucleotide
accuuacugaauaaacag

SEQ ID NO: 133791 - RNA, 18 nt, Artificial Sequence
  Description of Artificial Sequence: Synthetic oligonucleotide
cagucaccuuacugaaua

SEQ ID NO: 133792 - RNA, 18 nt, Artificial Sequence
  Description of Artificial Sequence: Synthetic oligonucleotide
gcugucagucaccuuacu

SEQ ID NO: 133793 - RNA, 18 nt, Artificial Sequence
  Description of Artificial Sequence: Synthetic oligonucleotide
uaaaggcugucagucacc

SEQ ID NO: 133794 - RNA, 18 nt, Artificial Sequence
  Description of Artificial Sequence: Synthetic oligonucleotide
uucaguaaaggcugucag

SEQ ID NO: 133795 - RNA, 18 nt, Artificial Sequence
  Description of Artificial Sequence: Synthetic oligonucleotide
cuucauucaguaaaggcu

SEQ ID NO: 133796 - RNA, 18 nt, Artificial Sequence
  Description of Artificial Sequence: Synthetic oligonucleotide
aauggcuucauucaguaa

SEQ ID NO: 133797 - RNA, 18 nt, Artificial Sequence
  Description of Artificial Sequence: Synthetic oligonucleotide
ccaacaauggcuucauuc

SEQ ID NO: 133798 - RNA, 18 nt, Artificial Sequence
  Description of Artificial Sequence: Synthetic oligonucleotide
ucaucccaacaauggcuu

SEQ ID NO: 133799 - RNA, 18 nt, Artificial Sequence
  Description of Artificial Sequence: Synthetic oligonucleotide
uugccucaucccaacaau

SEQ ID NO: 133800 - RNA, 18 nt, Artificial Sequence
  Description of Artificial Sequence: Synthetic oligonucleotide
guggauugccucauccca

SEQ ID NO: 133801 - RNA, 18 nt, Artificial Sequence
  Description of Artificial Sequence: Synthetic oligonucleotide
auccaguggauugccuca

SEQ ID NO: 133802 - RNA, 18 nt, Artificial Sequence
  Description of Artificial Sequence: Synthetic oligonucleotide
accucauccaguggauug

SEQ ID NO: 133803 - RNA, 18 nt, Artificial Sequence
  Description of Artificial Sequence: Synthetic oligonucleotide
ggguuaccucauccagug

SEQ ID NO: 133804 - RNA, 18 nt, Artificial Sequence
  Description of Artificial Sequence: Synthetic oligonucleotide
ccaauggguuaccucauc

SEQ ID NO: 133805 - RNA, 18 nt, Artificial Sequence
  Description of Artificial Sequence: Synthetic oligonucleotide
uucacccaauggguuacc

SEQ ID NO: 133806 - RNA, 18 nt, Artificial Sequence
  Description of Artificial Sequence: Synthetic oligonucleotide
acaucuucacccaauggg

SEQ ID NO: 133807 - RNA, 18 nt, Artificial Sequence
  Description of Artificial Sequence: Synthetic oligonucleotide
caagaacaucuucaccca

SEQ ID NO: 133808 - RNA, 18 nt, Artificial Sequence
  Description of Artificial Sequence: Synthetic oligonucleotide
ucacccaagaacaucuuc

SEQ ID NO: 133809 - RNA, 18 nt, Artificial Sequence
  Description of Artificial Sequence: Synthetic oligonucleotide
aauucucacccaagaaca

SEQ ID NO: 133810 - RNA, 18 nt, Artificial Sequence
  Description of Artificial Sequence: Synthetic oligonucleotide
aauggaauucucacccaa

SEQ ID NO: 133811 - RNA, 18 nt, Artificial Sequence
  Description of Artificial Sequence: Synthetic oligonucleotide
caacuaauggaauucuca

SEQ ID NO: 133812 - RNA, 18 nt, Artificial Sequence
  Description of Artificial Sequence: Synthetic oligonucleotide
aaugucaacuaauggaau

SEQ ID NO: 133813 - RNA, 18 nt, Artificial Sequence
  Description of Artificial Sequence: Synthetic oligonucleotide
uggacaaugucaacuaau

SEQ ID NO: 133814 - RNA, 18 nt, Artificial Sequence
  Description of Artificial Sequence: Synthetic oligonucleotide
cuuaauggacaaugucaa

SEQ ID NO: 133815 - RNA, 18 nt, Artificial Sequence
  Description of Artificial Sequence: Synthetic oligonucleotide
uuuuacuuaauggacaau

SEQ ID NO: 133816 - RNA, 18 nt, Artificial Sequence
  Description of Artificial Sequence: Synthetic oligonucleotide
accacuuuuacuuaaugg

SEQ ID NO: 133817 - RNA, 18 nt, Artificial Sequence
  Description of Artificial Sequence: Synthetic oligonucleotide
caaugaccacuuuuacuu

SEQ ID NO: 133818 - RNA, 18 nt, Artificial Sequence
  Description of Artificial Sequence: Synthetic oligonucleotide
uacuucaaugaccacuuu

SEQ ID NO: 133819 - RNA, 18 nt, Artificial Sequence
  Description of Artificial Sequence: Synthetic oligonucleotide
agccuuacuucaaugacc

SEQ ID NO: 133820 - RNA, 18 nt, Artificial Sequence
  Description of Artificial Sequence: Synthetic oligonucleotide
ugugcagccuuacuucaa

SEQ ID NO: 133821 - RNA, 18 nt, Artificial Sequence
  Description of Artificial Sequence: Synthetic oligonucleotide
ccaacugugcagccuuac

SEQ ID NO: 133822 - RNA, 18 nt, Artificial Sequence
  Description of Artificial Sequence: Synthetic oligonucleotide
cuuacccaacugugcagc

SEQ ID NO: 133823 - RNA, 18 nt, Artificial Sequence
  Description of Artificial Sequence: Synthetic oligonucleotide
auagccuuacccaacugu

SEQ ID NO: 133824 - RNA, 18 nt, Artificial Sequence
  Description of Artificial Sequence: Synthetic oligonucleotide
aauggauagccuuaccca

SEQ ID NO: 133825 - RNA, 18 nt, Artificial Sequence
  Description of Artificial Sequence: Synthetic oligonucleotide
ugucuaauggauagccuu

SEQ ID NO: 133826 - RNA, 18 nt, Artificial Sequence
  Description of Artificial Sequence: Synthetic oligonucleotide
cuaauugucuaauggaua

SEQ ID NO: 133827 - RNA, 18 nt, Artificial Sequence
  Description of Artificial Sequence: Synthetic oligonucleotide
cucaucuaauugucuaau

SEQ ID NO: 133828 - RNA, 18 nt, Artificial Sequence
  Description of Artificial Sequence: Synthetic oligonucleotide
guagucucaucuaauugu

SEQ ID NO: 133829 - RNA, 18 nt, Artificial Sequence
  Description of Artificial Sequence: Synthetic oligonucleotide
aauggguagucucaucua

SEQ ID NO: 133830 - RNA, 18 nt, Artificial Sequence
  Description of Artificial Sequence: Synthetic oligonucleotide
gacccaauggguagucuc

SEQ ID NO: 133831 - RNA, 18 nt, Artificial Sequence
  Description of Artificial Sequence: Synthetic oligonucleotide
auccugacccaaugggua

SEQ ID NO: 133832 - RNA, 18 nt, Artificial Sequence
  Description of Artificial Sequence: Synthetic oligonucleotide
cagacauccugacccaau

SEQ ID NO: 133833 - RNA, 18 nt, Artificial Sequence
  Description of Artificial Sequence: Synthetic oligonucleotide
cccagcagacauccugac

SEQ ID NO: 133834 - RNA, 18 nt, Artificial Sequence
  Description of Artificial Sequence: Synthetic oligonucleotide
ucuagcccagcagacauc

SEQ ID NO: 133835 - RNA, 18 nt, Artificial Sequence
  Description of Artificial Sequence: Synthetic oligonucleotide
gauggucuagcccagcag

SEQ ID NO: 133836 - RNA, 18 nt, Artificial Sequence
  Description of Artificial Sequence: Synthetic oligonucleotide
cagaggauggucuagccc

SEQ ID NO: 133837 - RNA, 18 nt, Artificial Sequence
  Description of Artificial Sequence: Synthetic oligonucleotide
gguuucagaggauggucu

SEQ ID NO: 133838 - RNA, 18 nt, Artificial Sequence
  Description of Artificial Sequence: Synthetic oligonucleotide
uuggagguuucagaggau

SEQ ID NO: 133839 - RNA, 18 nt, Artificial Sequence
  Description of Artificial Sequence: Synthetic oligonucleotide
auacuuuggagguuucag

SEQ ID NO: 133840 - RNA, 18 nt, Artificial Sequence
  Description of Artificial Sequence: Synthetic oligonucleotide
aguuuauacuuuggaggu

SEQ ID NO: 133841 - RNA, 18 nt, Artificial Sequence
  Description of Artificial Sequence: Synthetic oligonucleotide
ugacaaguuuauacuuug

SEQ ID NO: 133842 - RNA, 18 nt, Artificial Sequence
  Description of Artificial Sequence: Synthetic oligonucleotide
cccaaugacaaguuuaua

SEQ ID NO: 133843 - RNA, 18 nt, Artificial Sequence
  Description of Artificial Sequence: Synthetic oligonucleotide
cuuugcccaaugacaagu

SEQ ID NO: 133844 - RNA, 18 nt, Artificial Sequence
  Description of Artificial Sequence: Synthetic oligonucleotide
aagagcuuugcccaauga

SEQ ID NO: 133845 - RNA, 18 nt, Artificial Sequence
  Description of Artificial Sequence: Synthetic oligonucleotide
cuuugaagagcuuugccc

SEQ ID NO: 133846 - RNA, 18 nt, Artificial Sequence
  Description of Artificial Sequence: Synthetic oligonucleotide
uuauccuuugaagagcuu

SEQ ID NO: 133847 - RNA, 18 nt, Artificial Sequence
  Description of Artificial Sequence: Synthetic oligonucleotide
uaaucuuauccuuugaag

SEQ ID NO: 133848 - RNA, 18 nt, Artificial Sequence
  Description of Artificial Sequence: Synthetic oligonucleotide
auugauaaucuuauccuu

SEQ ID NO: 133849 - RNA, 18 nt, Artificial Sequence
  Description of Artificial Sequence: Synthetic oligonucleotide
aucccauugauaaucuua

SEQ ID NO: 133850 - RNA, 18 nt, Artificial Sequence
  Description of Artificial Sequence: Synthetic oligonucleotide
acuucaucccauugauaa

SEQ ID NO: 133851 - RNA, 18 nt, Artificial Sequence
  Description of Artificial Sequence: Synthetic oligonucleotide
ggaucacuucaucccauu

SEQ ID NO: 133852 - RNA, 18 nt, Artificial Sequence
  Description of Artificial Sequence: Synthetic oligonucleotide
ucaguggaucacuucauc

SEQ ID NO: 133853 - RNA, 18 nt, Artificial Sequence
  Description of Artificial Sequence: Synthetic oligonucleotide
uuaucucaguggaucacu

SEQ ID NO: 133854 - RNA, 18 nt, Artificial Sequence
  Description of Artificial Sequence: Synthetic oligonucleotide
ucaucuuaucucagugga

SEQ ID NO: 133855 - RNA, 18 nt, Artificial Sequence
  Description of Artificial Sequence: Synthetic oligonucleotide
aaauaucaucuuaucuca

SEQ ID NO: 133856 - RNA, 18 nt, Artificial Sequence
  Description of Artificial Sequence: Synthetic oligonucleotide
caguaaaauaucaucuua

SEQ ID NO: 133857 - RNA, 18 nt, Artificial Sequence
  Description of Artificial Sequence: Synthetic oligonucleotide
aaugucaguaaaauauca

SEQ ID NO: 133858 - RNA, 18 nt, Artificial Sequence
  Description of Artificial Sequence: Synthetic oligonucleotide
agaacaaugucaguaaaa

SEQ ID NO: 133859 - RNA, 18 nt, Artificial Sequence
  Description of Artificial Sequence: Synthetic oligonucleotide
ucuuuguucaauggaaaa

SEQ ID NO: 133860 - RNA, 18 nt, Artificial Sequence
  Description of Artificial Sequence: Synthetic oligonucleotide
ggccaucuuuguucaaug

SEQ ID NO: 133861 - RNA, 18 nt, Artificial Sequence
  Description of Artificial Sequence: Synthetic oligonucleotide
caauuggccaucuuuguu

SEQ ID NO: 133862 - RNA, 18 nt, Artificial Sequence
  Description of Artificial Sequence: Synthetic oligonucleotide
ugacccaauuggccaucu

SEQ ID NO: 133863 - RNA, 18 nt, Artificial Sequence
  Description of Artificial Sequence: Synthetic oligonucleotide
aaauuugacccaauuggc

SEQ ID NO: 133864 - RNA, 18 nt, Artificial Sequence
  Description of Artificial Sequence: Synthetic oligonucleotide
agagcaaauuugacccaa

SEQ ID NO: 133865 - RNA, 18 nt, Artificial Sequence
  Description of Artificial Sequence: Synthetic oligonucleotide
uuuggagagcaaauuuga

SEQ ID NO: 133866 - RNA, 18 nt, Artificial Sequence
  Description of Artificial Sequence: Synthetic oligonucleotide
gcagguuuggagagcaaa

SEQ ID NO: 133867 - RNA, 18 nt, Artificial Sequence
  Description of Artificial Sequence: Synthetic oligonucleotide
ucauggcagguuuggaga

SEQ ID NO: 133868 - RNA, 18 nt, Artificial Sequence
  Description of Artificial Sequence: Synthetic oligonucleotide
cacucucauggcagguuu

SEQ ID NO: 133869 - RNA, 18 nt, Artificial Sequence
  Description of Artificial Sequence: Synthetic oligonucleotide
ggccucacucucauggca

SEQ ID NO: 133870 - RNA, 18 nt, Artificial Sequence
  Description of Artificial Sequence: Synthetic oligonucleotide
uaauuggccucacucuca

SEQ ID NO: 133871 - RNA, 18 nt, Artificial Sequence
  Description of Artificial Sequence: Synthetic oligonucleotide
gaaacuaauuggccucac

SEQ ID NO: 133872 - RNA, 18 nt, Artificial Sequence
  Description of Artificial Sequence: Synthetic oligonucleotide
uaauagaaacuaauuggc

SEQ ID NO: 133873 - RNA, 18 nt, Artificial Sequence
  Description of Artificial Sequence: Synthetic oligonucleotide
augaguaauagaaacuaa

SEQ ID NO: 133874 - RNA, 18 nt, Artificial Sequence
  Description of Artificial Sequence: Synthetic oligonucleotide
aggagaugaguaauagaa

SEQ ID NO: 133875 - RNA, 18 nt, Artificial Sequence
  Description of Artificial Sequence: Synthetic oligonucleotide
uauuuaggagaugaguaa

SEQ ID NO: 133876 - RNA, 18 nt, Artificial Sequence
  Description of Artificial Sequence: Synthetic oligonucleotide
uuggauauuuaggagaug

SEQ ID NO: 133877 - RNA, 18 nt, Artificial Sequence
  Description of Artificial Sequence: Synthetic oligonucleotide
auuucuuggauauuuagg

SEQ ID NO: 133878 - RNA, 18 nt, Artificial Sequence
  Description of Artificial Sequence: Synthetic oligonucleotide
auaccauuucuuggauau

SEQ ID NO: 133879 - RNA, 18 nt, Artificial Sequence
  Description of Artificial Sequence: Synthetic oligonucleotide
aaaaaauaccauuucuug

SEQ ID NO: 133880 - RNA, 18 nt, Artificial Sequence
  Description of Artificial Sequence: Synthetic oligonucleotide
ggcucaaaaaauaccauu

SEQ ID NO: 133881 - RNA, 18 nt, Artificial Sequence
  Description of Artificial Sequence: Synthetic oligonucleotide
cagcuggcucaaaaaaua

SEQ ID NO: 133882 - RNA, 18 nt, Artificial Sequence
  Description of Artificial Sequence: Synthetic oligonucleotide
cggaccagcuggcucaaa

SEQ ID NO: 133883 - RNA, 18 nt, Artificial Sequence
  Description of Artificial Sequence: Synthetic oligonucleotide
aaccccggaccagcuggc

SEQ ID NO: 133884 - RNA, 18 nt, Artificial Sequence
  Description of Artificial Sequence: Synthetic oligonucleotide
gaugaaaccccggaccag

SEQ ID NO: 133885 - RNA, 18 nt, Artificial Sequence
  Description of Artificial Sequence: Synthetic oligonucleotide
caguugaugaaaccccgg

SEQ ID NO: 133886 - RNA, 18 nt, Artificial Sequence
  Description of Artificial Sequence: Synthetic oligonucleotide
agcagcaguugaugaaac

SEQ ID NO: 133887 - RNA, 18 nt, Artificial Sequence
  Description of Artificial Sequence: Synthetic oligonucleotide
gaaggagcagcaguugau

SEQ ID NO: 133888 - RNA, 18 nt, Artificial Sequence
  Description of Artificial Sequence: Synthetic oligonucleotide
ugggagaaggagcagcag

SEQ ID NO: 133889 - RNA, 18 nt, Artificial Sequence
  Description of Artificial Sequence: Synthetic oligonucleotide
uuuccugggagaaggagc

SEQ ID NO: 133890 - RNA, 18 nt, Artificial Sequence
  Description of Artificial Sequence: Synthetic oligonucleotide
uagucuuuccugggagaa

SEQ ID NO: 133891 - RNA, 18 nt, Artificial Sequence
  Description of Artificial Sequence: Synthetic oligonucleotide
agggauagucuuuccugg

SEQ ID NO: 133892 - RNA, 18 nt, Artificial Sequence
  Description of Artificial Sequence: Synthetic oligonucleotide
gugacagggauagucuuu

SEQ ID NO: 133893 - RNA, 18 nt, Artificial Sequence
  Description of Artificial Sequence: Synthetic oligonucleotide
gaugggugacagggauag

SEQ ID NO: 133894 - RNA, 18 nt, Artificial Sequence
  Description of Artificial Sequence: Synthetic oligonucleotide
aaugggaugggugacagg

SEQ ID NO: 133895 - RNA, 18 nt, Artificial Sequence
  Description of Artificial Sequence: Synthetic oligonucleotide
gcggcaaugggaugggug

SEQ ID NO: 133896 - RNA, 18 nt, Artificial Sequence
  Description of Artificial Sequence: Synthetic oligonucleotide
ccccagcggcaaugggau

SEQ ID NO: 133897 - RNA, 18 nt, Artificial Sequence
  Description of Artificial Sequence: Synthetic oligonucleotide
gcuguccccagcggcaau

SEQ ID NO: 133898 - RNA, 18 nt, Artificial Sequence
  Description of Artificial Sequence: Synthetic oligonucleotide
gccuggcuguccccagcg

SEQ ID NO: 133899 - RNA, 18 nt, Artificial Sequence
  Description of Artificial Sequence: Synthetic oligonucleotide
cccaggccuggcuguccc

SEQ ID NO: 133900 - RNA, 18 nt, Artificial Sequence
  Description of Artificial Sequence: Synthetic oligonucleotide
caaggcccaggccuggcu

SEQ ID NO: 133901 - RNA, 18 nt, Artificial Sequence
  Description of Artificial Sequence: Synthetic oligonucleotide
caaaccaaggcccaggcc

SEQ ID NO: 133902 - RNA, 18 nt, Artificial Sequence
  Description of Artificial Sequence: Synthetic oligonucleotide
ucucccaaaccaaggccc

SEQ ID NO: 133903 - RNA, 18 nt, Artificial Sequence
  Description of Artificial Sequence: Synthetic oligonucleotide
cugcuucucccaaaccaa

SEQ ID NO: 133904 - RNA, 18 nt, Artificial Sequence
  Description of Artificial Sequence: Synthetic oligonucleotide
uuggacugcuucucccaa

SEQ ID NO: 133905 - RNA, 18 nt, Artificial Sequence
  Description of Artificial Sequence: Synthetic oligonucleotide
cagacuuggacugcuucu

SEQ ID NO: 133906 - RNA, 18 nt, Artificial Sequence
  Description of Artificial Sequence: Synthetic oligonucleotide
auaugcagacuuggacug

SEQ ID NO: 133907 - RNA, 18 nt, Artificial Sequence
  Description of Artificial Sequence: Synthetic oligonucleotide
auuugauaugcagacuug

SEQ ID NO: 133908 - RNA, 18 nt, Artificial Sequence
  Description of Artificial Sequence: Synthetic oligonucleotide
cauuuauuugauaugcag

SEQ ID NO: 133909 - RNA, 18 nt, Artificial Sequence
  Description of Artificial Sequence: Synthetic oligonucleotide
uccaucauuuauuugaua

SEQ ID NO: 133910 - RNA, 18 nt, Artificial Sequence
  Description of Artificial Sequence: Synthetic oligonucleotide
ucuccuccaucauuuauu

SEQ ID NO: 133911 - RNA, 18 nt, Artificial Sequence
  Description of Artificial Sequence: Synthetic oligonucleotide
acccaucuccuccaucau

SEQ ID NO: 133912 - RNA, 18 nt, Artificial Sequence
  Description of Artificial Sequence: Synthetic oligonucleotide
cuaccacccaucuccucc

SEQ ID NO: 133913 - RNA, 18 nt, Artificial Sequence
  Description of Artificial Sequence: Synthetic oligonucleotide
agguccuaccacccaucu

SEQ ID NO: 133914 - RNA, 18 nt, Artificial Sequence
  Description of Artificial Sequence: Synthetic oligonucleotide
cuggaagguccuaccacc

SEQ ID NO: 133915 - RNA, 18 nt, Artificial Sequence
  Description of Artificial Sequence: Synthetic oligonucleotide
gaggucuggaagguccua

SEQ ID NO: 133916 - RNA, 18 nt, Artificial Sequence
  Description of Artificial Sequence: Synthetic oligonucleotide
uuuaugaggucuggaagg

SEQ ID NO: 133917 - RNA, 18 nt, Artificial Sequence
  Description of Artificial Sequence: Synthetic oligonucleotide
uaaguuuuaugaggucug

SEQ ID NO: 133918 - RNA, 18 nt, Artificial Sequence
  Description of Artificial Sequence: Synthetic oligonucleotide
aagccuaaguuuuaugag

SEQ ID NO: 133919 - RNA, 18 nt, Artificial Sequence
  Description of Artificial Sequence: Synthetic oligonucleotide
ucauaaagccuaaguuuu

SEQ ID NO: 133920 - RNA, 18 nt, Artificial Sequence
  Description of Artificial Sequence: Synthetic oligonucleotide
ccagaucauaaagccuaa

SEQ ID NO: 133921 - RNA, 18 nt, Artificial Sequence
  Description of Artificial Sequence: Synthetic oligonucleotide
gagucccagaucauaaag

SEQ ID NO: 133922 - RNA, 18 nt, Artificial Sequence
  Description of Artificial Sequence: Synthetic oligonucleotide
ucugugagucccagauca

SEQ ID NO: 133923 - RNA, 18 nt, Artificial Sequence
  Description of Artificial Sequence: Synthetic oligonucleotide
aaccuucugugaguccca

SEQ ID NO: 133924 - RNA, 18 nt, Artificial Sequence
  Description of Artificial Sequence: Synthetic oligonucleotide
ugcucaaccuucugugag

SEQ ID NO: 133925 - RNA, 18 nt, Artificial Sequence
  Description of Artificial Sequence: Synthetic oligonucleotide
uuuauugcucaaccuucu

SEQ ID NO: 133926 - RNA, 18 nt, Artificial Sequence
  Description of Artificial Sequence: Synthetic oligonucleotide
ggucuuuuauugcucaac

SEQ ID NO: 133927 - RNA, 18 nt, Artificial Sequence
  Description of Artificial Sequence: Synthetic oligonucleotide
ccuaaggucuuuuauugc

SEQ ID NO: 133928 - RNA, 18 nt, Artificial Sequence
  Description of Artificial Sequence: Synthetic oligonucleotide
uaaucccuaaggucuuuu

SEQ ID NO: 133929 - RNA, 18 nt, Artificial Sequence
  Description of Artificial Sequence: Synthetic oligonucleotide
ccagauaaucccuaaggu

SEQ ID NO: 133930 - RNA, 18 nt, Artificial Sequence
  Description of Artificial Sequence: Synthetic oligonucleotide
uuaaaccagauaaucccu

SEQ ID NO: 133931 - RNA, 18 nt, Artificial Sequence
  Description of Artificial Sequence: Synthetic oligonucleotide
auuaauuaaaccagauaa

SEQ ID NO: 133932 - RNA, 18 nt, Artificial Sequence
  Description of Artificial Sequence: Synthetic oligonucleotide
agagaauuaauuaaacca

SEQ ID NO: 133933 - RNA, 18 nt, Artificial Sequence
  Description of Artificial Sequence: Synthetic oligonucleotide
aaaugagagaauuaauua

SEQ ID NO: 133934 - RNA, 18 nt, Artificial Sequence
  Description of Artificial Sequence: Synthetic oligonucleotide
cuauaaaaugagagaauu

SEQ ID NO: 133935 - RNA, 18 nt, Artificial Sequence
  Description of Artificial Sequence: Synthetic oligonucleotide
uuccucuauaaaaugaga

SEQ ID NO: 133936 - RNA, 18 nt, Artificial Sequence
  Description of Artificial Sequence: Synthetic oligonucleotide
auuucuuccucuauaaaa

SEQ ID NO: 133937 - RNA, 18 nt, Artificial Sequence
  Description of Artificial Sequence: Synthetic oligonucleotide
acuuaauuucuuccucua

SEQ ID NO: 133938 - RNA, 18 nt, Artificial Sequence
  Description of Artificial Sequence: Synthetic oligonucleotide
ccuugacuuaauuucuuc

SEQ ID NO: 133939 - RNA, 18 nt, Artificial Sequence
  Description of Artificial Sequence: Synthetic oligonucleotide
ccccaccuugacuuaauu

SEQ ID NO: 133940 - RNA, 18 nt, Artificial Sequence
  Description of Artificial Sequence: Synthetic oligonucleotide
cccugccccaccuugacu

SEQ ID NO: 133941 - RNA, 18 nt, Artificial Sequence
  Description of Artificial Sequence: Synthetic oligonucleotide
ucccacccugccccaccu

SEQ ID NO: 133942 - RNA, 18 nt, Artificial Sequence
  Description of Artificial Sequence: Synthetic oligonucleotide
uccccucccacccugccc

SEQ ID NO: 133943 - RNA, 18 nt, Artificial Sequence
  Description of Artificial Sequence: Synthetic oligonucleotide
aguucuccccucccaccc

SEQ ID NO: 133944 - RNA, 18 nt, Artificial Sequence
  Description of Artificial Sequence: Synthetic oligonucleotide
gggaaaguucuccccucc

SEQ ID NO: 133945 - RNA, 18 nt, Artificial Sequence
  Description of Artificial Sequence: Synthetic oligonucleotide
ggcccgggaaaguucucc

SEQ ID NO: 133946 - RNA, 18 nt, Artificial Sequence
  Description of Artificial Sequence: Synthetic oligonucleotide
gaagaggcccgggaaagu

SEQ ID NO: 133947 - RNA, 18 nt, Artificial Sequence
  Description of Artificial Sequence: Synthetic oligonucleotide
uaaaugaagaggcccggg

SEQ ID NO: 133948 - RNA, 18 nt, Artificial Sequence
  Description of Artificial Sequence: Synthetic oligonucleotide
gggaguaaaugaagaggc

SEQ ID NO: 133949 - RNA, 18 nt, Artificial Sequence
  Description of Artificial Sequence: Synthetic oligonucleotide
uuugugggaguaaaugaa

SEQ ID NO: 133950 - RNA, 18 nt, Artificial Sequence
  Description of Artificial Sequence: Synthetic oligonucleotide
cagccuuugugggaguaa

SEQ ID NO: 133951 - RNA, 18 nt, Artificial Sequence
  Description of Artificial Sequence: Synthetic oligonucleotide
aauuccagccuuuguggg

SEQ ID NO: 133952 - RNA, 18 nt, Artificial Sequence
  Description of Artificial Sequence: Synthetic oligonucleotide
cucaaaauuccagccuuu

SEQ ID NO: 133953 - RNA, 18 nt, Artificial Sequence
  Description of Artificial Sequence: Synthetic oligonucleotide
ggcugcucaaaauuccag

SEQ ID NO: 133954 - RNA, 18 nt, Artificial Sequence
  Description of Artificial Sequence: Synthetic oligonucleotide
ccuggcggugagggcugu

SEQ ID NO: 133955 - RNA, 18 nt, Artificial Sequence
  Description of Artificial Sequence: Synthetic oligonucleotide
agccaccuggcggugagg

SEQ ID NO: 133956 - RNA, 18 nt, Artificial Sequence
  Description of Artificial Sequence: Synthetic oligonucleotide
cccugagccaccuggcgg

SEQ ID NO: 133957 - RNA, 18 nt, Artificial Sequence
  Description of Artificial Sequence: Synthetic oligonucleotide
ucagacccugagccaccu

SEQ ID NO: 133958 - RNA, 18 nt, Artificial Sequence
  Description of Artificial Sequence: Synthetic oligonucleotide
agggcucagacccugagc

SEQ ID NO: 133959 - RNA, 18 nt, Artificial Sequence
  Description of Artificial Sequence: Synthetic oligonucleotide
cuuauagggcucagaccc

SEQ ID NO: 133960 - RNA, 18 nt, Artificial Sequence
  Description of Artificial Sequence: Synthetic oligonucleotide
aggagcuuauagggcuca

SEQ ID NO: 133961 - RNA, 18 nt, Artificial Sequence
  Description of Artificial Sequence: Synthetic oligonucleotide
ccggcaggagcuuauagg

SEQ ID NO: 133962 - RNA, 18 nt, Artificial Sequence
  Description of Artificial Sequence: Synthetic oligonucleotide
ggcucccggcaggagcuu

SEQ ID NO: 133963 - RNA, 18 nt, Artificial Sequence
  Description of Artificial Sequence: Synthetic oligonucleotide
gcgacggcucccggcagg

SEQ ID NO: 133964 - RNA, 18 nt, Artificial Sequence
  Description of Artificial Sequence: Synthetic oligonucleotide
uuguggcgacggcucccg

SEQ ID NO: 133965 - RNA, 18 nt, Artificial Sequence
  Description of Artificial Sequence: Synthetic oligonucleotide
gacgauuguggcgacggc

SEQ ID NO: 133966 - RNA, 18 nt, Artificial Sequence
  Description of Artificial Sequence: Synthetic oligonucleotide
ggcuugacgauuguggcg

SEQ ID NO: 133967 - RNA, 18 nt, Artificial Sequence
  Description of Artificial Sequence: Synthetic oligonucleotide
gggcuugacgauuguggc

SEQ ID NO: 133968 - RNA, 18 nt, Artificial Sequence
  Description of Artificial Sequence: Synthetic oligonucleotide
uggugauggucggcuggg

SEQ ID NO: 133969 - RNA, 18 nt, Artificial Sequence
  Description of Artificial Sequence: Synthetic oligonucleotide
cugcuuggugauggucgg

SEQ ID NO: 133970 - RNA, 18 nt, Artificial Sequence
  Description of Artificial Sequence: Synthetic oligonucleotide
acuuccugcuuggugaug

SEQ ID NO: 133971 - RNA, 18 nt, Artificial Sequence
  Description of Artificial Sequence: Synthetic oligonucleotide
agauaacuuccugcuugg

SEQ ID NO: 133972 - RNA, 18 nt, Artificial Sequence
  Description of Artificial Sequence: Synthetic oligonucleotide
uugcuagauaacuuccug

SEQ ID NO: 133973 - RNA, 18 nt, Artificial Sequence
  Description of Artificial Sequence: Synthetic oligonucleotide
gcggcuugcuagauaacu

SEQ ID NO: 133974 - RNA, 18 nt, Artificial Sequence
  Description of Artificial Sequence: Synthetic oligonucleotide
ccccagcggcuugcuaga

SEQ ID NO: 133975 - RNA, 18 nt, Artificial Sequence
  Description of Artificial Sequence: Synthetic oligonucleotide
ccaagccccagcggcuug

SEQ ID NO: 133976 - RNA, 18 nt, Artificial Sequence
  Description of Artificial Sequence: Synthetic oligonucleotide
agcccccaagccccagcg

SEQ ID NO: 133977 - RNA, 18 nt, Artificial Sequence
  Description of Artificial Sequence: Synthetic oligonucleotide
aguggagcccccaagccc

SEQ ID NO: 133978 - RNA, 18 nt, Artificial Sequence
  Description of Artificial Sequence: Synthetic oligonucleotide
gagccaguggagccccca

SEQ ID NO: 133979 - RNA, 18 nt, Artificial Sequence
  Description of Artificial Sequence: Synthetic oligonucleotide
gggagccaguggagcccc

SEQ ID NO: 133980 - RNA, 18 nt, Artificial Sequence
  Description of Artificial Sequence: Synthetic oligonucleotide
ccaggugcucucuuaggg

SEQ ID NO: 133981 - RNA, 18 nt, Artificial Sequence
  Description of Artificial Sequence: Synthetic oligonucleotide
gaucaccaggugcucucu

SEQ ID NO: 133982 - RNA, 18 nt, Artificial Sequence
  Description of Artificial Sequence: Synthetic oligonucleotide
cacgugaucaccaggugc

SEQ ID NO: 133983 - RNA, 18 nt, Artificial Sequence
  Description of Artificial Sequence: Synthetic oligonucleotide
gugaccacgugaucacca

SEQ ID NO: 133984 - RNA, 18 nt, Artificial Sequence
  Description of Artificial Sequence: Synthetic oligonucleotide
uugccgugaccacgugau

SEQ ID NO: 133985 - RNA, 18 nt, Artificial Sequence
  Description of Artificial Sequence: Synthetic oligonucleotide
uuccuuugccgugaccac

SEQ ID NO: 133986 - RNA, 18 nt, Artificial Sequence
  Description of Artificial Sequence: Synthetic oligonucleotide
acgucuuccuuugccgug

SEQ ID NO: 133987 - RNA, 18 nt, Artificial Sequence
  Description of Artificial Sequence: Synthetic oligonucleotide
gcaucacgucuuccuuug

SEQ ID NO: 133988 - RNA, 18 nt, Artificial Sequence
  Description of Artificial Sequence: Synthetic oligonucleotide
uccuggcaucacgucuuc

SEQ ID NO: 133989 - RNA, 18 nt, Artificial Sequence
  Description of Artificial Sequence: Synthetic oligonucleotide
acugguccuggcaucacg

SEQ ID NO: 133990 - RNA, 18 nt, Artificial Sequence
  Description of Artificial Sequence: Synthetic oligonucleotide
cugggacugguccuggca

SEQ ID NO: 133991 - RNA, 18 nt, Artificial Sequence
  Description of Artificial Sequence: Synthetic oligonucleotide
cugcucugggacuggucc

SEQ ID NO: 133992 - RNA, 18 nt, Artificial Sequence
  Description of Artificial Sequence: Synthetic oligonucleotide
cauuccugcucugggacu

SEQ ID NO: 133993 - RNA, 18 nt, Artificial Sequence
  Description of Artificial Sequence: Synthetic oligonucleotide
cuucccauuccugcucug

SEQ ID NO: 133994 - RNA, 18 nt, Artificial Sequence
  Description of Artificial Sequence: Synthetic oligonucleotide
ucauccuucccauuccug

SEQ ID NO: 133995 - RNA, 18 nt, Artificial Sequence
  Description of Artificial Sequence: Synthetic oligonucleotide
gcccuucauccuucccau

SEQ ID NO: 133996 - RNA, 18 nt, Artificial Sequence
  Description of Artificial Sequence: Synthetic oligonucleotide
cucgggcccuucauccuu

SEQ ID NO: 133997 - RNA, 18 nt, Artificial Sequence
  Description of Artificial Sequence: Synthetic oligonucleotide
auguucucgggcccuuca

SEQ ID NO: 133998 - RNA, 18 nt, Artificial Sequence
  Description of Artificial Sequence: Synthetic oligonucleotide
aggccauguucucgggcc

SEQ ID NO: 133999 - RNA, 18 nt, Artificial Sequence
  Description of Artificial Sequence: Synthetic oligonucleotide
cccuuaggccauguucuc

SEQ ID NO: 134000 - RNA, 18 nt, Artificial Sequence
  Description of Artificial Sequence: Synthetic oligonucleotide
uguggcccuuaggccaug

SEQ ID NO: 134001 - RNA, 18 nt, Artificial Sequence
  Description of Artificial Sequence: Synthetic oligonucleotide
ugggauguggcccuuagg

SEQ ID NO: 134002 - RNA, 18 nt, Artificial Sequence
  Description of Artificial Sequence: Synthetic oligonucleotide
ggcagugggauguggccc

SEQ ID NO: 134003 - RNA, 18 nt, Artificial Sequence
  Description of Artificial Sequence: Synthetic oligonucleotide
aggguggcagugggaugu

SEQ ID NO: 134004 - RNA, 18 nt, Artificial Sequence
  Description of Artificial Sequence: Synthetic oligonucleotide
cgucaaggguggcagugg

SEQ ID NO: 134005 - RNA, 18 nt, Artificial Sequence
  Description of Artificial Sequence: Synthetic oligonucleotide
cagggcgucaaggguggc

SEQ ID NO: 134006 - RNA, 18 nt, Artificial Sequence
  Description of Artificial Sequence: Synthetic oligonucleotide
cagagcagggcgucaagg

SEQ ID NO: 134007 - RNA, 18 nt, Artificial Sequence
  Description of Artificial Sequence: Synthetic oligonucleotide
uuauccagagcagggcgu

SEQ ID NO: 134008 - RNA, 18 nt, Artificial Sequence
  Description of Artificial Sequence: Synthetic oligonucleotide
ucuuguuauccagagcag

SEQ ID NO: 134009 - RNA, 18 nt, Artificial Sequence
  Description of Artificial Sequence: Synthetic oligonucleotide
caaagucuuguuauccag

SEQ ID NO: 134010 - RNA, 18 nt, Artificial Sequence
  Description of Artificial Sequence: Synthetic oligonucleotide
caagucaaagucuuguua

SEQ ID NO: 134011 - RNA, 18 nt, Artificial Sequence
  Description of Artificial Sequence: Synthetic oligonucleotide
cuccccaagucaaagucu

SEQ ID NO: 134012 - RNA, 18 nt, Artificial Sequence
  Description of Artificial Sequence: Synthetic oligonucleotide
gaggucuccccaagucaa

SEQ ID NO: 134013 - RNA, 18 nt, Artificial Sequence
  Description of Artificial Sequence: Synthetic oligonucleotide
caguagaggucuccccaa

SEQ ID NO: 134014 - RNA, 18 nt, Artificial Sequence
  Description of Artificial Sequence: Synthetic oligonucleotide
caaggcaguagaggucuc

SEQ ID NO: 134015 - RNA, 18 nt, Artificial Sequence
  Description of Artificial Sequence: Synthetic oligonucleotide
uuguccaaggcaguagag

SEQ ID NO: 134016 - RNA, 18 nt, Artificial Sequence
  Description of Artificial Sequence: Synthetic oligonucleotide
aaaaguuguccaaggcag

SEQ ID NO: 134017 - RNA, 18 nt, Artificial Sequence
  Description of Artificial Sequence: Synthetic oligonucleotide
augagaaaaguuguccaa

SEQ ID NO: 134018 - RNA, 18 nt, Artificial Sequence
  Description of Artificial Sequence: Synthetic oligonucleotide
ucaacaugagaaaaguug

SEQ ID NO: 134019 - RNA, 18 nt, Artificial Sequence
  Description of Artificial Sequence: Synthetic oligonucleotide
uggcuucaacaugagaaa

SEQ ID NO: 134020 - RNA, 18 nt, Artificial Sequence
  Description of Artificial Sequence: Synthetic oligonucleotide
ggcaguggcuucaacaug

SEQ ID NO: 134021 - RNA, 18 nt, Artificial Sequence
  Description of Artificial Sequence: Synthetic oligonucleotide
gugaaggcaguggcuuca

SEQ ID NO: 134022 - RNA, 18 nt, Artificial Sequence
  Description of Artificial Sequence: Synthetic oligonucleotide
ugaaggugaaggcagugg

SEQ ID NO: 134023 - RNA, 18 nt, Artificial Sequence
  Description of Artificial Sequence: Synthetic oligonucleotide
gaaggugaaggugaaggc

SEQ ID NO: 134024 - RNA, 18 nt, Artificial Sequence
  Description of Artificial Sequence: Synthetic oligonucleotide
uggaugaaggugaaggug

SEQ ID NO: 134025 - RNA, 18 nt, Artificial Sequence
  Description of Artificial Sequence: Synthetic oligonucleotide
ggacauggaugaagguga

SEQ ID NO: 134026 - RNA, 18 nt, Artificial Sequence
  Description of Artificial Sequence: Synthetic oligonucleotide
ggguuggacauggaugaa

SEQ ID NO: 134027 - RNA, 18 nt, Artificial Sequence
  Description of Artificial Sequence: Synthetic oligonucleotide
guccuuugggaugaaguc

SEQ ID NO: 134028 - RNA, 18 nt, Artificial Sequence
  Description of Artificial Sequence: Synthetic oligonucleotide
cggcuguccuuugggaug

SEQ ID NO: 134029 - RNA, 18 nt, Artificial Sequence
  Description of Artificial Sequence: Synthetic oligonucleotide
ccaggcggcuguccuuug

SEQ ID NO: 134030 - RNA, 18 nt, Artificial Sequence
  Description of Artificial Sequence: Synthetic oligonucleotide
caucuccaggcggcuguc

SEQ ID NO: 134031 - RNA, 18 nt, Artificial Sequence
  Description of Artificial Sequence: Synthetic oligonucleotide
caagucaucuccaggcgg

SEQ ID NO: 134032 - RNA, 18 nt, Artificial Sequence
  Description of Artificial Sequence: Synthetic oligonucleotide
ggccucaagucaucucca

SEQ ID NO: 134033 - RNA, 18 nt, Artificial Sequence
  Description of Artificial Sequence: Synthetic oligonucleotide
aguaaggccucaagucau

SEQ ID NO: 134034 - RNA, 18 nt, Artificial Sequence
  Description of Artificial Sequence: Synthetic oligonucleotide
guuuaaguaaggccucaa

SEQ ID NO: 134035 - RNA, 18 nt, Artificial Sequence
  Description of Artificial Sequence: Synthetic oligonucleotide
gcuggguuuaaguaaggc

SEQ ID NO: 134036 - RNA, 18 nt, Artificial Sequence
  Description of Artificial Sequence: Synthetic oligonucleotide
agggagcuggguuuaagu

SEQ ID NO: 134037 - RNA, 18 nt, Artificial Sequence
  Description of Artificial Sequence: Synthetic oligonucleotide
gaagaagggagcuggguu

SEQ ID NO: 134038 - RNA, 18 nt, Artificial Sequence
  Description of Artificial Sequence: Synthetic oligonucleotide
cuagggaagaagggagcu

SEQ ID NO: 134039 - RNA, 18 nt, Artificial Sequence
  Description of Artificial Sequence: Synthetic oligonucleotide
ccaggcuagggaagaagg

SEQ ID NO: 134040 - RNA, 18 nt, Artificial Sequence
  Description of Artificial Sequence: Synthetic oligonucleotide
aagcaccaggcuagggaa

SEQ ID NO: 134041 - RNA, 18 nt, Artificial Sequence
  Description of Artificial Sequence: Synthetic oligonucleotide
aggagaagcaccaggcua

SEQ ID NO: 134042 - RNA, 18 nt, Artificial Sequence
  Description of Artificial Sequence: Synthetic oligonucleotide
aggagaggagaagcacca

SEQ ID NO: 134043 - RNA, 18 nt, Artificial Sequence
  Description of Artificial Sequence: Synthetic oligonucleotide
gggcuaggagaggagaag

SEQ ID NO: 134044 - RNA, 18 nt, Artificial Sequence
  Description of Artificial Sequence: Synthetic oligonucleotide
cugucuggacaccaugac

SEQ ID NO: 134045 - RNA, 18 nt, Artificial Sequence
  Description of Artificial Sequence: Synthetic oligonucleotide
gggcucugucuggacacc

SEQ ID NO: 134046 - RNA, 18 nt, Artificial Sequence
  Description of Artificial Sequence: Synthetic oligonucleotide
ucacagggcucugucugg

SEQ ID NO: 134047 - RNA, 18 nt, Artificial Sequence
  Description of Artificial Sequence: Synthetic oligonucleotide
cagccucacagggcucug

SEQ ID NO: 134048 - RNA, 18 nt, Artificial Sequence
  Description of Artificial Sequence: Synthetic oligonucleotide
ggacccagccucacaggg

SEQ ID NO: 134049 - RNA, 18 nt, Artificial Sequence
  Description of Artificial Sequence: Synthetic oligonucleotide
caauuggacccagccuca

SEQ ID NO: 134050 - RNA, 18 nt, Artificial Sequence
  Description of Artificial Sequence: Synthetic oligonucleotide
ugccacaauuggacccag

SEQ ID NO: 134051 - RNA, 18 nt, Artificial Sequence
  Description of Artificial Sequence: Synthetic oligonucleotide
ccaagugccacaauugga

SEQ ID NO: 134052 - RNA, 18 nt, Artificial Sequence
  Description of Artificial Sequence: Synthetic oligonucleotide
gugccccaagugccacaa

SEQ ID NO: 134053 - RNA, 18 nt, Artificial Sequence
  Description of Artificial Sequence: Synthetic oligonucleotide
gcaaggugccccaagugc

SEQ ID NO: 134054 - RNA, 18 nt, Artificial Sequence
  Description of Artificial Sequence: Synthetic oligonucleotide
gaggagcaaggugcccca

SEQ ID NO: 134055 - RNA, 18 nt, Artificial Sequence
  Description of Artificial Sequence: Synthetic oligonucleotide
agaaggaggagcaaggug

SEQ ID NO: 134056 - RNA, 18 nt, Artificial Sequence
  Description of Artificial Sequence: Synthetic oligonucleotide
gcagcagaaggaggagca

SEQ ID NO: 134057 - RNA, 18 nt, Artificial Sequence
  Description of Artificial Sequence: Synthetic oligonucleotide
gggcagcagcagaaggag

SEQ ID NO: 134058 - RNA, 18 nt, Artificial Sequence
  Description of Artificial Sequence: Synthetic oligonucleotide
gagggaggcagcagaggu

SEQ ID NO: 134059 - RNA, 18 nt, Artificial Sequence
  Description of Artificial Sequence: Synthetic oligonucleotide
cagcagagggaggcagca

SEQ ID NO: 134060 - RNA, 18 nt, Artificial Sequence
  Description of Artificial Sequence: Synthetic oligonucleotide
ggugacagcagagggagg

SEQ ID NO: 134061 - RNA, 18 nt, Artificial Sequence
  Description of Artificial Sequence: Synthetic oligonucleotide
agcaaggugacagcagag

SEQ ID NO: 134062 - RNA, 18 nt, Artificial Sequence
  Description of Artificial Sequence: Synthetic oligonucleotide
ggcugagcaaggugacag

SEQ ID NO: 134063 - RNA, 18 nt, Artificial Sequence
  Description of Artificial Sequence: Synthetic oligonucleotide
gggauggcugagcaaggu

SEQ ID NO: 134064 - RNA, 18 nt, Artificial Sequence
  Description of Artificial Sequence: Synthetic oligonucleotide
aagacgggauggcugagc

SEQ ID NO: 134065 - RNA, 18 nt, Artificial Sequence
  Description of Artificial Sequence: Synthetic oligonucleotide
uggagaagacgggauggc

SEQ ID NO: 134066 - RNA, 18 nt, Artificial Sequence
  Description of Artificial Sequence: Synthetic oligonucleotide
gguguuggagaagacggg

SEQ ID NO: 134067 - RNA, 18 nt, Artificial Sequence
  Description of Artificial Sequence: Synthetic oligonucleotide
gaggugguguuggagaag

SEQ ID NO: 134068 - RNA, 18 nt, Artificial Sequence
  Description of Artificial Sequence: Synthetic oligonucleotide
cuggagaggugguguugg

SEQ ID NO: 134069 - RNA, 18 nt, Artificial Sequence
  Description of Artificial Sequence: Synthetic oligonucleotide
ggccucuggagagguggu

SEQ ID NO: 134070 - RNA, 18 nt, Artificial Sequence
  Description of Artificial Sequence: Synthetic oligonucleotide
uccuuggccucuggagag

SEQ ID NO: 134071 - RNA, 18 nt, Artificial Sequence
  Description of Artificial Sequence: Synthetic oligonucleotide
aggccuccuuggccucug

SEQ ID NO: 134072 - RNA, 18 nt, Artificial Sequence
  Description of Artificial Sequence: Synthetic oligonucleotide
uuccaaggccuccuuggc

SEQ ID NO: 134073 - RNA, 18 nt, Artificial Sequence
  Description of Artificial Sequence: Synthetic oligonucleotide
aucguuuccaaggccucc

SEQ ID NO: 134074 - RNA, 18 nt, Artificial Sequence
  Description of Artificial Sequence: Synthetic oligonucleotide
gggaaucguuuccaaggc

SEQ ID NO: 134075 - RNA, 18 nt, Artificial Sequence
  Description of Artificial Sequence: Synthetic oligonucleotide
guucccagaaugacuggg

SEQ ID NO: 134076 - RNA, 18 nt, Artificial Sequence
  Description of Artificial Sequence: Synthetic oligonucleotide
aacauguucccagaauga

SEQ ID NO: 134077 - RNA, 18 nt, Artificial Sequence
  Description of Artificial Sequence: Synthetic oligonucleotide
cuuacaacauguucccag

SEQ ID NO: 134078 - RNA, 18 nt, Artificial Sequence
  Description of Artificial Sequence: Synthetic oligonucleotide
cagugcuuacaacauguu

SEQ ID NO: 134079 - RNA, 18 nt, Artificial Sequence
  Description of Artificial Sequence: Synthetic oligonucleotide
ccagucagugcuuacaac

SEQ ID NO: 134080 - RNA, 18 nt, Artificial Sequence
  Description of Artificial Sequence: Synthetic oligonucleotide
uggucccagucagugcuu

SEQ ID NO: 134081 - RNA, 18 nt, Artificial Sequence
  Description of Artificial Sequence: Synthetic oligonucleotide
gugccuggucccagucag

SEQ ID NO: 134082 - RNA, 18 nt, Artificial Sequence
  Description of Artificial Sequence: Synthetic oligonucleotide
gccuggugccugguccca

SEQ ID NO: 134083 - RNA, 18 nt, Artificial Sequence
  Description of Artificial Sequence: Synthetic oligonucleotide
acccugccuggugccugg

SEQ ID NO: 134084 - RNA, 18 nt, Artificial Sequence
  Description of Artificial Sequence: Synthetic oligonucleotide
ucuagacccugccuggug

SEQ ID NO: 134085 - RNA, 18 nt, Artificial Sequence
  Description of Artificial Sequence: Synthetic oligonucleotide
agccuucuagacccugcc

SEQ ID NO: 134086 - RNA, 18 nt, Artificial Sequence
  Description of Artificial Sequence: Synthetic oligonucleotide
accacagccuucuagacc

SEQ ID NO: 134087 - RNA, 18 nt, Artificial Sequence
  Description of Artificial Sequence: Synthetic oligonucleotide
cccucaccacagccuucu

SEQ ID NO: 134088 - RNA, 18 nt, Artificial Sequence
  Description of Artificial Sequence: Synthetic oligonucleotide
gucuucccucaccacagc

SEQ ID NO: 134089 - RNA, 18 nt, Artificial Sequence
  Description of Artificial Sequence: Synthetic oligonucleotide
aaggcgucuucccucacc

SEQ ID NO: 134090 - RNA, 18 nt, Artificial Sequence
  Description of Artificial Sequence: Synthetic oligonucleotide
ggagaaaggcgucuuccc

SEQ ID NO: 134091 - RNA, 18 nt, Artificial Sequence
  Description of Artificial Sequence: Synthetic oligonucleotide
uuggaggagaaaggcguc

SEQ ID NO: 134092 - RNA, 18 nt, Artificial Sequence
  Description of Artificial Sequence: Synthetic oligonucleotide
uuggguuggaggagaaag

SEQ ID NO: 134093 - RNA, 18 nt, Artificial Sequence
  Description of Artificial Sequence: Synthetic oligonucleotide
ugagguuggguuggagga

SEQ ID NO: 134094 - RNA, 18 nt, Artificial Sequence
  Description of Artificial Sequence: Synthetic oligonucleotide
gaggaugagguuggguug

SEQ ID NO: 134095 - RNA, 18 nt, Artificial Sequence
  Description of Artificial Sequence: Synthetic oligonucleotide
agaaggaggaugagguug

SEQ ID NO: 134096 - RNA, 18 nt, Artificial Sequence
  Description of Artificial Sequence: Synthetic oligonucleotide
ccugaagaaggaggauga

SEQ ID NO: 134097 - RNA, 18 nt, Artificial Sequence
  Description of Artificial Sequence: Synthetic oligonucleotide
aagucccugaagaaggag

SEQ ID NO: 134098 - RNA, 18 nt, Artificial Sequence
  Description of Artificial Sequence: Synthetic oligonucleotide
cacccaagucccugaaga

SEQ ID NO: 134099 - RNA, 18 nt, Artificial Sequence
  Description of Artificial Sequence: Synthetic oligonucleotide
guacccacccaagucccu

SEQ ID NO: 134100 - RNA, 18 nt, Artificial Sequence
  Description of Artificial Sequence: Synthetic oligonucleotide
cccaaguacccacccaag

SEQ ID NO: 134101 - RNA, 18 nt, Artificial Sequence
  Description of Artificial Sequence: Synthetic oligonucleotide
ccucacccaaguacccac

SEQ ID NO: 134102 - RNA, 18 nt, Artificial Sequence
  Description of Artificial Sequence: Synthetic oligonucleotide
gggauccucacccaagua

SEQ ID NO: 134103 - RNA, 18 nt, Artificial Sequence
  Description of Artificial Sequence: Synthetic oligonucleotide
cuucagggauccucaccc

SEQ ID NO: 134104 - RNA, 18 nt, Artificial Sequence
  Description of Artificial Sequence: Synthetic oligonucleotide
aaggccuucagggauccu

SEQ ID NO: 134105 - RNA, 18 nt, Artificial Sequence
  Description of Artificial Sequence: Synthetic oligonucleotide
gguugaaggccuucaggg

SEQ ID NO: 134106 - RNA, 18 nt, Artificial Sequence
  Description of Artificial Sequence: Synthetic oligonucleotide
ucucggguugaaggccuu

SEQ ID NO: 134107 - RNA, 18 nt, Artificial Sequence
  Description of Artificial Sequence: Synthetic oligonucleotide
uguuuucucggguugaag

SEQ ID NO: 134108 - RNA, 18 nt, Artificial Sequence
  Description of Artificial Sequence: Synthetic oligonucleotide
ggguuuguuuucucgggu

SEQ ID NO: 134109 - RNA, 18 nt, Artificial Sequence
  Description of Artificial Sequence: Synthetic oligonucleotide
aaccuggguuuguuuucu

SEQ ID NO: 134110 - RNA, 18 nt, Artificial Sequence
  Description of Artificial Sequence: Synthetic oligonucleotide
ucgccaaccuggguuugu

SEQ ID NO: 134111 - RNA, 18 nt, Artificial Sequence
  Description of Artificial Sequence: Synthetic oligonucleotide
ugcagucgccaaccuggg

SEQ ID NO: 134112 - RNA, 18 nt, Artificial Sequence
  Description of Artificial Sequence: Synthetic oligonucleotide
ccuguugcagucgccaac

SEQ ID NO: 134113 - RNA, 18 nt, Artificial Sequence
  Description of Artificial Sequence: Synthetic oligonucleotide
aaguuccuguugcagucg

SEQ ID NO: 134114 - RNA, 18 nt, Artificial Sequence
  Description of Artificial Sequence: Synthetic oligonucleotide
acuccaaguuccuguugc

SEQ ID NO: 134115 - RNA, 18 nt, Artificial Sequence
  Description of Artificial Sequence: Synthetic oligonucleotide
ucuccacuccaaguuccu

SEQ ID NO: 134116 - RNA, 18 nt, Artificial Sequence
  Description of Artificial Sequence: Synthetic oligonucleotide
uuuccucuccacuccaag

SEQ ID NO: 134117 - RNA, 18 nt, Artificial Sequence
  Description of Artificial Sequence: Synthetic oligonucleotide
augcuuuuccucuccacu

SEQ ID NO: 134118 - RNA, 18 nt, Artificial Sequence
  Description of Artificial Sequence: Synthetic oligonucleotide
uucugaugcuuuuccucu

SEQ ID NO: 134119 - RNA, 18 nt, Artificial Sequence
  Description of Artificial Sequence: Synthetic oligonucleotide
ccucuuucugaugcuuuu

SEQ ID NO: 134120 - RNA, 18 nt, Artificial Sequence
  Description of Artificial Sequence: Synthetic oligonucleotide
gucugccucuuucugaug

SEQ ID NO: 134121 - RNA, 18 nt, Artificial Sequence
  Description of Artificial Sequence: Synthetic oligonucleotide
ggauggucugccucuuuc

SEQ ID NO: 134122 - RNA, 18 nt, Artificial Sequence
  Description of Artificial Sequence: Synthetic oligonucleotide
cugguggauggucugccu

SEQ ID NO: 134123 - RNA, 18 nt, Artificial Sequence
  Description of Artificial Sequence: Synthetic oligonucleotide
aaggccugguggaugguc

SEQ ID NO: 134124 - RNA, 18 nt, Artificial Sequence
  Description of Artificial Sequence: Synthetic oligonucleotide
ucucaaaggccuggugga

SEQ ID NO: 134125 - RNA, 18 nt, Artificial Sequence
  Description of Artificial Sequence: Synthetic oligonucleotide
cccuuucucaaaggccug

SEQ ID NO: 134126 - RNA, 18 nt, Artificial Sequence
  Description of Artificial Sequence: Synthetic oligonucleotide
uucuacccuuucucaaag

SEQ ID NO: 134127 - RNA, 18 nt, Artificial Sequence
  Description of Artificial Sequence: Synthetic oligonucleotide
cagaauucuacccuuucu

SEQ ID NO: 134128 - RNA, 18 nt, Artificial Sequence
  Description of Artificial Sequence: Synthetic oligonucleotide
ccagccagaauucuaccc

SEQ ID NO: 134129 - RNA, 18 nt, Artificial Sequence
  Description of Artificial Sequence: Synthetic oligonucleotide
cucuaccagccagaauuc

SEQ ID NO: 134130 - RNA, 18 nt, Artificial Sequence
  Description of Artificial Sequence: Synthetic oligonucleotide
accugcucuaccagccag

SEQ ID NO: 134131 - RNA, 18 nt, Artificial Sequence
  Description of Artificial Sequence: Synthetic oligonucleotide
aucucaccugcucuacca

SEQ ID NO: 134132 - RNA, 18 nt, Artificial Sequence
  Description of Artificial Sequence: Synthetic oligonucleotide
gucccaucucaccugcuc

SEQ ID NO: 134133 - RNA, 18 nt, Artificial Sequence
  Description of Artificial Sequence: Synthetic oligonucleotide
ggaaugucccaucucacc

SEQ ID NO: 134134 - RNA, 18 nt, Artificial Sequence
  Description of Artificial Sequence: Synthetic oligonucleotide
ucuuuggaaugucccauc

SEQ ID NO: 134135 - RNA, 18 nt, Artificial Sequence
  Description of Artificial Sequence: Synthetic oligonucleotide
gcuguucuuuggaauguc

SEQ ID NO: 134136 - RNA, 18 nt, Artificial Sequence
  Description of Artificial Sequence: Synthetic oligonucleotide
cucaggcuguucuuugga

SEQ ID NO: 134137 - RNA, 18 nt, Artificial Sequence
  Description of Artificial Sequence: Synthetic oligonucleotide
cuuggcucaggcuguucu

SEQ ID NO: 134138 - RNA, 18 nt, Artificial Sequence
  Description of Artificial Sequence: Synthetic oligonucleotide
uaggccuuggcucaggcu

SEQ ID NO: 134139 - RNA, 18 nt, Artificial Sequence
  Description of Artificial Sequence: Synthetic oligonucleotide
accacuaggccuuggcuc

SEQ ID NO: 134140 - RNA, 18 nt, Artificial Sequence
  Description of Artificial Sequence: Synthetic oligonucleotide
uuacuaccacuaggccuu

SEQ ID NO: 134141 - RNA, 18 nt, Artificial Sequence
  Description of Artificial Sequence: Synthetic oligonucleotide
gauucuuacuaccacuag

SEQ ID NO: 134142 - RNA, 18 nt, Artificial Sequence
  Description of Artificial Sequence: Synthetic oligonucleotide
ugcuagauucuuacuacc

SEQ ID NO: 134143 - RNA, 18 nt, Artificial Sequence
  Description of Artificial Sequence: Synthetic oligonucleotide
auucuugcuagauucuua

SEQ ID NO: 134144 - RNA, 18 nt, Artificial Sequence
  Description of Artificial Sequence: Synthetic oligonucleotide
ccucaauucuugcuagau

SEQ ID NO: 134145 - RNA, 18 nt, Artificial Sequence
  Description of Artificial Sequence: Synthetic oligonucleotide
uucuuccucaauucuugc

SEQ ID NO: 134146 - RNA, 18 nt, Artificial Sequence
  Description of Artificial Sequence: Synthetic oligonucleotide
caccauucuuccucaauu

SEQ ID NO: 134147 - RNA, 18 nt, Artificial Sequence
  Description of Artificial Sequence: Synthetic oligonucleotide
ucccacaccauucuuccu

SEQ ID NO: 134148 - RNA, 18 nt, Artificial Sequence
  Description of Artificial Sequence: Synthetic oligonucleotide
cccucucccacaccauuc

SEQ ID NO: 134149 - RNA, 18 nt, Artificial Sequence
  Description of Artificial Sequence: Synthetic oligonucleotide
aucaucccucucccacac

SEQ ID NO: 134150 - RNA, 18 nt, Artificial Sequence
  Description of Artificial Sequence: Synthetic oligonucleotide
ucuucaucaucccucucc

SEQ ID NO: 134151 - RNA, 18 nt, Artificial Sequence
  Description of Artificial Sequence: Synthetic oligonucleotide
cucucucuucaucauccc

SEQ ID NO: 134152 - RNA, 18 nt, Artificial Sequence
  Description of Artificial Sequence: Synthetic oligonucleotide
gcccucucucucuucauc

SEQ ID NO: 134153 - RNA, 18 nt, Artificial Sequence
  Description of Artificial Sequence: Synthetic oligonucleotide
agcaggcccucucucucu

SEQ ID NO: 134154 - RNA, 18 nt, Artificial Sequence
  Description of Artificial Sequence: Synthetic oligonucleotide
ucuccagcaggcccucuc

SEQ ID NO: 134155 - RNA, 18 nt, Artificial Sequence
  Description of Artificial Sequence: Synthetic oligonucleotide
uaugcucuccagcaggcc

SEQ ID NO: 134156 - RNA, 18 nt, Artificial Sequence
  Description of Artificial Sequence: Synthetic oligonucleotide
gacccuaugcucuccagc

SEQ ID NO: 134157 - RNA, 18 nt, Artificial Sequence
  Description of Artificial Sequence: Synthetic oligonucleotide
uuccagacccuaugcucu

SEQ ID NO: 134158 - RNA, 18 nt, Artificial Sequence
  Description of Artificial Sequence: Synthetic oligonucleotide
ugguguuccagacccuau

SEQ ID NO: 134159 - RNA, 18 nt, Artificial Sequence
  Description of Artificial Sequence: Synthetic oligonucleotide
cagccugguguuccagac

SEQ ID NO: 134160 - RNA, 18 nt, Artificial Sequence
  Description of Artificial Sequence: Synthetic oligonucleotide
gaccucagccugguguuc

SEQ ID NO: 134161 - RNA, 18 nt, Artificial Sequence
  Description of Artificial Sequence: Synthetic oligonucleotide
aucaggaccucagccugg

SEQ ID NO: 134162 - RNA, 18 nt, Artificial Sequence
  Description of Artificial Sequence: Synthetic oligonucleotide
agcugaucaggaccucag

SEQ ID NO: 134163 - RNA, 18 nt, Artificial Sequence
  Description of Artificial Sequence: Synthetic oligonucleotide
cuugaagcugaucaggac

SEQ ID NO: 134164 - RNA, 18 nt, Artificial Sequence
  Description of Artificial Sequence: Synthetic oligonucleotide
uacuccuugaagcugauc

SEQ ID NO: 134165 - RNA, 18 nt, Artificial Sequence
  Description of Artificial Sequence: Synthetic oligonucleotide
cugcauacuccuugaagc

SEQ ID NO: 134166 - RNA, 18 nt, Artificial Sequence
  Description of Artificial Sequence: Synthetic oligonucleotide
gcucccugcauacuccuu

SEQ ID NO: 134167 - RNA, 18 nt, Artificial Sequence
  Description of Artificial Sequence: Synthetic oligonucleotide
gcccagcucccugcauac

SEQ ID NO: 134168 - RNA, 18 nt, Artificial Sequence
  Description of Artificial Sequence: Synthetic oligonucleotide
uggaagcccagcucccug

SEQ ID NO: 134169 - RNA, 18 nt, Artificial Sequence
  Description of Artificial Sequence: Synthetic oligonucleotide
uuuucuggaagcccagcu

SEQ ID NO: 134170 - RNA, 18 nt, Artificial Sequence
  Description of Artificial Sequence: Synthetic oligonucleotide
guucauuuucuggaagcc

SEQ ID NO: 134171 - RNA, 18 nt, Artificial Sequence
  Description of Artificial Sequence: Synthetic oligonucleotide
gcuguguucauuuucugg

SEQ ID NO: 134172 - RNA, 18 nt, Artificial Sequence
  Description of Artificial Sequence: Synthetic oligonucleotide
gaacugcuguguucauuu

SEQ ID NO: 134173 - RNA, 18 nt, Artificial Sequence
  Description of Artificial Sequence: Synthetic oligonucleotide
cugcagaacugcuguguu

SEQ ID NO: 134174 - RNA, 18 nt, Artificial Sequence
  Description of Artificial Sequence: Synthetic oligonucleotide
guccucugcagaacugcu

SEQ ID NO: 134175 - RNA, 18 nt, Artificial Sequence
  Description of Artificial Sequence: Synthetic oligonucleotide
cucccguccucugcagaa

SEQ ID NO: 134176 - RNA, 18 nt, Artificial Sequence
  Description of Artificial Sequence: Synthetic oligonucleotide
ccagccucccguccucug

SEQ ID NO: 134177 - RNA, 18 nt, Artificial Sequence
  Description of Artificial Sequence: Synthetic oligonucleotide
agcuuccagccucccguc

SEQ ID NO: 134178 - RNA, 18 nt, Artificial Sequence
  Description of Artificial Sequence: Synthetic oligonucleotide
cucccagcuuccagccuc

SEQ ID NO: 134179 - RNA, 18 nt, Artificial Sequence
  Description of Artificial Sequence: Synthetic oligonucleotide
cugaccucccagcuucca

SEQ ID NO: 134180 - RNA, 18 nt, Artificial Sequence
  Description of Artificial Sequence: Synthetic oligonucleotide
cccaccugaccucccagc

SEQ ID NO: 134181 - RNA, 18 nt, Artificial Sequence
  Description of Artificial Sequence: Synthetic oligonucleotide
uccaccccaccugaccuc

SEQ ID NO: 134182 - RNA, 18 nt, Artificial Sequence
  Description of Artificial Sequence: Synthetic oligonucleotide
uaucauccaccccaccug

SEQ ID NO: 134183 - RNA, 18 nt, Artificial Sequence
  Description of Artificial Sequence: Synthetic oligonucleotide
cauuauaucauccacccc

SEQ ID NO: 134184 - RNA, 18 nt, Artificial Sequence
  Description of Artificial Sequence: Synthetic oligonucleotide
acccgcauuauaucaucc

SEQ ID NO: 134185 - RNA, 18 nt, Artificial Sequence
  Description of Artificial Sequence: Synthetic oligonucleotide
cucucacccgcauuauau

SEQ ID NO: 134186 - RNA, 18 nt, Artificial Sequence
  Description of Artificial Sequence: Synthetic oligonucleotide
cauuacucucacccgcau

SEQ ID NO: 134187 - RNA, 18 nt, Artificial Sequence
  Description of Artificial Sequence: Synthetic oligonucleotide
agccucauuacucucacc

SEQ ID NO: 134188 - RNA, 18 nt, Artificial Sequence
  Description of Artificial Sequence: Synthetic oligonucleotide
ccccaagccucauuacuc

SEQ ID NO: 134189 - RNA, 18 nt, Artificial Sequence
  Description of Artificial Sequence: Synthetic oligonucleotide
uccagccccaagccucau

SEQ ID NO: 134190 - RNA, 18 nt, Artificial Sequence
  Description of Artificial Sequence: Synthetic oligonucleotide
uccucuccagccccaagc

SEQ ID NO: 134191 - RNA, 18 nt, Artificial Sequence
  Description of Artificial Sequence: Synthetic oligonucleotide
ucuuguccucuccagccc

SEQ ID NO: 134192 - RNA, 18 nt, Artificial Sequence
  Description of Artificial Sequence: Synthetic oligonucleotide
acccaucuuguccucucc

SEQ ID NO: 134193 - RNA, 18 nt, Artificial Sequence
  Description of Artificial Sequence: Synthetic oligonucleotide
gguuuacccaucuugucc

SEQ ID NO: 134194 - RNA, 18 nt, Artificial Sequence
  Description of Artificial Sequence: Synthetic oligonucleotide
gugaggguuuacccaucu

SEQ ID NO: 134195 - RNA, 18 nt, Artificial Sequence
  Description of Artificial Sequence: Synthetic oligonucleotide
cugaugugaggguuuacc

SEQ ID NO: 134196 - RNA, 18 nt, Artificial Sequence
  Description of Artificial Sequence: Synthetic oligonucleotide
ucacucugaugugagggu

SEQ ID NO: 134197 - RNA, 18 nt, Artificial Sequence
  Description of Artificial Sequence: Synthetic oligonucleotide
ggaugucacucugaugug

SEQ ID NO: 134198 - RNA, 18 nt, Artificial Sequence
  Description of Artificial Sequence: Synthetic oligonucleotide
cuccuggaugucacucug

SEQ ID NO: 134199 - RNA, 18 nt, Artificial Sequence
  Description of Artificial Sequence: Synthetic oligonucleotide
uauuccuccuggauguca

SEQ ID NO: 134200 - RNA, 18 nt, Artificial Sequence
  Description of Artificial Sequence: Synthetic oligonucleotide
gagcuuauuccuccugga

SEQ ID NO: 134201 - RNA, 18 nt, Artificial Sequence
  Description of Artificial Sequence: Synthetic oligonucleotide
ccugggagcuuauuccuc

SEQ ID NO: 134202 - RNA, 18 nt, Artificial Sequence
  Description of Artificial Sequence: Synthetic oligonucleotide
caggcccugggagcuuau

SEQ ID NO: 134203 - RNA, 18 nt, Artificial Sequence
  Description of Artificial Sequence: Synthetic oligonucleotide
ugagacaggcccugggag

SEQ ID NO: 134204 - RNA, 18 nt, Artificial Sequence
  Description of Artificial Sequence: Synthetic oligonucleotide
gagcuugagacaggcccu

SEQ ID NO: 134205 - RNA, 18 nt, Artificial Sequence
  Description of Artificial Sequence: Synthetic oligonucleotide
aggaagagcuugagacag

SEQ ID NO: 134206 - RNA, 18 nt, Artificial Sequence
  Description of Artificial Sequence: Synthetic oligonucleotide
gaguaaggaagagcuuga

SEQ ID NO: 134207 - RNA, 18 nt, Artificial Sequence
  Description of Artificial Sequence: Synthetic oligonucleotide
ccugggaguaaggaagag

SEQ ID NO: 134208 - RNA, 18 nt, Artificial Sequence
  Description of Artificial Sequence: Synthetic oligonucleotide
cagugccugggaguaagg

SEQ ID NO: 134209 - RNA, 18 nt, Artificial Sequence
  Description of Artificial Sequence: Synthetic oligonucleotide
uaagacagugccugggag

SEQ ID NO: 134210 - RNA, 18 nt, Artificial Sequence
  Description of Artificial Sequence: Synthetic oligonucleotide
ugccuuaagacagugccu

SEQ ID NO: 134211 - RNA, 18 nt, Artificial Sequence
  Description of Artificial Sequence: Synthetic oligonucleotide
ucagaugccuuaagacag

SEQ ID NO: 134212 - RNA, 18 nt, Artificial Sequence
  Description of Artificial Sequence: Synthetic oligonucleotide
gcaugucagaugccuuaa

SEQ ID NO: 134213 - RNA, 18 nt, Artificial Sequence
  Description of Artificial Sequence: Synthetic oligonucleotide
augaugcaugucagaugc

SEQ ID NO: 134214 - RNA, 18 nt, Artificial Sequence
  Description of Artificial Sequence: Synthetic oligonucleotide
augagaugaugcauguca

SEQ ID NO: 134215 - RNA, 18 nt, Artificial Sequence
  Description of Artificial Sequence: Synthetic oligonucleotide
auuaaaugagaugaugca

SEQ ID NO: 134216 - RNA, 18 nt, Artificial Sequence
  Description of Artificial Sequence: Synthetic oligonucleotide
ggaggauuaaaugagaug

SEQ ID NO: 134217 - RNA, 18 nt, Artificial Sequence
  Description of Artificial Sequence: Synthetic oligonucleotide
ggaagggaggauuaaaug

SEQ ID NO: 134218 - RNA, 18 nt, Artificial Sequence
  Description of Artificial Sequence: Synthetic oligonucleotide
agggaggaagggaggauu

SEQ ID NO: 134219 - RNA, 18 nt, Artificial Sequence
  Description of Artificial Sequence: Synthetic oligonucleotide
uuaauagggaggaaggga

SEQ ID NO: 134220 - RNA, 18 nt, Artificial Sequence
  Description of Artificial Sequence: Synthetic oligonucleotide
cuagguuaauagggagga

SEQ ID NO: 134221 - RNA, 18 nt, Artificial Sequence
  Description of Artificial Sequence: Synthetic oligonucleotide
aaucucuagguuaauagg

SEQ ID NO: 134222 - RNA, 18 nt, Artificial Sequence
  Description of Artificial Sequence: Synthetic oligonucleotide
aaaacaaucucuagguua

SEQ ID NO: 134223 - RNA, 18 nt, Artificial Sequence
  Description of Artificial Sequence: Synthetic oligonucleotide
aaacaaaaacaaucucua

SEQ ID NO: 134224 - RNA, 18 nt, Artificial Sequence
  Description of Artificial Sequence: Synthetic oligonucleotide
auaaaaaacaaaaacaau

SEQ ID NO: 134225 - RNA, 18 nt, Artificial Sequence
  Description of Artificial Sequence: Synthetic oligonucleotide
ggagaauaaaaaacaaaa

SEQ ID NO: 134226 - RNA, 18 nt, Artificial Sequence
  Description of Artificial Sequence: Synthetic oligonucleotide
gaggaggagaauaaaaaa

SEQ ID NO: 134227 - RNA, 18 nt, Artificial Sequence
  Description of Artificial Sequence: Synthetic oligonucleotide
ggagggaggaggagaaua

SEQ ID NO: 134228 - RNA, 18 nt, Artificial Sequence
  Description of Artificial Sequence: Synthetic oligonucleotide
gggagggaggaggagaau

SEQ ID NO: 134229 - RNA, 18 nt, Artificial Sequence
  Description of Artificial Sequence: Synthetic oligonucleotide
agguuaggagggaguggg

SEQ ID NO: 134230 - RNA, 18 nt, Artificial Sequence
  Description of Artificial Sequence: Synthetic oligonucleotide
ucucuagguuaggaggga

SEQ ID NO: 134231 - RNA, 18 nt, Artificial Sequence
  Description of Artificial Sequence: Synthetic oligonucleotide
aacaaucucuagguuagg

SEQ ID NO: 134232 - RNA, 18 nt, Artificial Sequence
  Description of Artificial Sequence: Synthetic oligonucleotide
ucuguaacaaucucuagg

SEQ ID NO: 134233 - RNA, 18 nt, Artificial Sequence
  Description of Artificial Sequence: Synthetic oligonucleotide
cagcuucuguaacaaucu

SEQ ID NO: 134234 - RNA, 18 nt, Artificial Sequence
  Description of Artificial Sequence: Synthetic oligonucleotide
aauuucagcuucuguaac

SEQ ID NO: 134235 - RNA, 18 nt, Artificial Sequence
  Description of Artificial Sequence: Synthetic oligonucleotide
aacgcaauuucagcuucu

SEQ ID NO: 134236 - RNA, 18 nt, Artificial Sequence
  Description of Artificial Sequence: Synthetic oligonucleotide
cuuagaacgcaauuucag

SEQ ID NO: 134237 - RNA, 18 nt, Artificial Sequence
  Description of Artificial Sequence: Synthetic oligonucleotide
caccucuuagaacgcaau

SEQ ID NO: 134238 - RNA, 18 nt, Artificial Sequence
  Description of Artificial Sequence: Synthetic oligonucleotide
cacuucaccucuuagaac

SEQ ID NO: 134239 - RNA, 18 nt, Artificial Sequence
  Description of Artificial Sequence: Synthetic oligonucleotide
aaaaucacuucaccucuu

SEQ ID NO: 134240 - RNA, 18 nt, Artificial Sequence
  Description of Artificial Sequence: Synthetic oligonucleotide
gaaaaaaaaucacuucac

SEQ ID NO: 134241 - RNA, 18 nt, Artificial Sequence
  Description of Artificial Sequence: Synthetic oligonucleotide
uuucagaaaaaaaaucac

SEQ ID NO: 134242 - RNA, 18 nt, Artificial Sequence
  Description of Artificial Sequence: Synthetic oligonucleotide
gugaguuucagaaaaaaa

SEQ ID NO: 134243 - RNA, 18 nt, Artificial Sequence
  Description of Artificial Sequence: Synthetic oligonucleotide
guugugugaguuucagaa

SEQ ID NO: 134244 - RNA, 18 nt, Artificial Sequence
  Description of Artificial Sequence: Synthetic oligonucleotide
uccuaguugugugaguuu

SEQ ID NO: 134245 - RNA, 18 nt, Artificial Sequence
  Description of Artificial Sequence: Synthetic oligonucleotide
ccacuuccuaguugugug

SEQ ID NO: 134246 - RNA, 18 nt, Artificial Sequence
  Description of Artificial Sequence: Synthetic oligonucleotide
cucagccacuuccuaguu

SEQ ID NO: 134247 - RNA, 18 nt, Artificial Sequence
  Description of Artificial Sequence: Synthetic oligonucleotide
ccugacucagccacuucc

SEQ ID NO: 134248 - RNA, 18 nt, Artificial Sequence
  Description of Artificial Sequence: Synthetic oligonucleotide
caaguccugacucagcca

SEQ ID NO: 134249 - RNA, 18 nt, Artificial Sequence
  Description of Artificial Sequence: Synthetic oligonucleotide
ggguucaaguccugacuc

SEQ ID NO: 134250 - RNA, 18 nt, Artificial Sequence
  Description of Artificial Sequence: Synthetic oligonucleotide
gaccuggguucaaguccu

SEQ ID NO: 134251 - RNA, 18 nt, Artificial Sequence
  Description of Artificial Sequence: Synthetic oligonucleotide
agggagaccuggguucaa

SEQ ID NO: 134252 - RNA, 18 nt, Artificial Sequence
  Description of Artificial Sequence: Synthetic oligonucleotide
gauccagggagaccuggg

SEQ ID NO: 134253 - RNA, 18 nt, Artificial Sequence
  Description of Artificial Sequence: Synthetic oligonucleotide
guucugauccagggagac

SEQ ID NO: 134254 - RNA, 18 nt, Artificial Sequence
  Description of Artificial Sequence: Synthetic oligonucleotide
cuccuguucugauccagg

SEQ ID NO: 134255 - RNA, 18 nt, Artificial Sequence
  Description of Artificial Sequence: Synthetic oligonucleotide
aagagcuccuguucugau

SEQ ID NO: 134256 - RNA, 18 nt, Artificial Sequence
  Description of Artificial Sequence: Synthetic oligonucleotide
uaguuaagagcuccuguu

SEQ ID NO: 134257 - RNA, 18 nt, Artificial Sequence
  Description of Artificial Sequence: Synthetic oligonucleotide
cacuguaguuaagagcuc

SEQ ID NO: 134258 - RNA, 18 nt, Artificial Sequence
  Description of Artificial Sequence: Synthetic oligonucleotide
ucagccacuguaguuaag

SEQ ID NO: 134259 - RNA, 18 nt, Artificial Sequence
  Description of Artificial Sequence: Synthetic oligonucleotide
gcuauucagccacuguag

SEQ ID NO: 134260 - RNA, 18 nt, Artificial Sequence
  Description of Artificial Sequence: Synthetic oligonucleotide
gagaagcuauucagccac

SEQ ID NO: 134261 - RNA, 18 nt, Artificial Sequence
  Description of Artificial Sequence: Synthetic oligonucleotide
cuuuggagaagcuauuca

SEQ ID NO: 134262 - RNA, 18 nt, Artificial Sequence
  Description of Artificial Sequence: Synthetic oligonucleotide
ggagccuuuggagaagcu

SEQ ID NO: 134263 - RNA, 18 nt, Artificial Sequence
  Description of Artificial Sequence: Synthetic oligonucleotide
cacagggagccuuuggag

SEQ ID NO: 134264 - RNA, 18 nt, Artificial Sequence
  Description of Artificial Sequence: Synthetic oligonucleotide
gagaacacagggagccuu

SEQ ID NO: 134265 - RNA, 18 nt, Artificial Sequence
  Description of Artificial Sequence: Synthetic oligonucleotide
acggugagaacacaggga

SEQ ID NO: 134266 - RNA, 18 nt, Artificial Sequence
  Description of Artificial Sequence: Synthetic oligonucleotide
ugaucacggugagaacac

SEQ ID NO: 134267 - RNA, 18 nt, Artificial Sequence
  Description of Artificial Sequence: Synthetic oligonucleotide
caacuugaucacggugag

SEQ ID NO: 134268 - RNA, 18 nt, Artificial Sequence
  Description of Artificial Sequence: Synthetic oligonucleotide
ccccucaacuugaucacg

SEQ ID NO: 134269 - RNA, 18 nt, Artificial Sequence
  Description of Artificial Sequence: Synthetic oligonucleotide
ggaagccccucaacuuga

SEQ ID NO: 134270 - RNA, 18 nt, Artificial Sequence
  Description of Artificial Sequence: Synthetic oligonucleotide
gagccggaagccccucaa

SEQ ID NO: 134271 - RNA, 18 nt, Artificial Sequence
  Description of Artificial Sequence: Synthetic oligonucleotide
gaagggagccggaagccc

SEQ ID NO: 134272 - RNA, 18 nt, Artificial Sequence
  Description of Artificial Sequence: Synthetic oligonucleotide
cuguagaagggagccgga

SEQ ID NO: 134273 - RNA, 18 nt, Artificial Sequence
  Description of Artificial Sequence: Synthetic oligonucleotide
ugaggcuguagaagggag

SEQ ID NO: 134274 - RNA, 18 nt, Artificial Sequence
  Description of Artificial Sequence: Synthetic oligonucleotide
guuucugaggcuguagaa

SEQ ID NO: 134275 - RNA, 18 nt, Artificial Sequence
  Description of Artificial Sequence: Synthetic oligonucleotide
gucugguuucugaggcug

SEQ ID NO: 134276 - RNA, 18 nt, Artificial Sequence
  Description of Artificial Sequence: Synthetic oligonucleotide
aacgagucugguuucuga

SEQ ID NO: 134277 - RNA, 18 nt, Artificial Sequence
  Description of Artificial Sequence: Synthetic oligonucleotide
agaagaacgagucugguu

SEQ ID NO: 134278 - RNA, 18 nt, Artificial Sequence
  Description of Artificial Sequence: Synthetic oligonucleotide
uucccagaagaacgaguc

SEQ ID NO: 134279 - RNA, 18 nt, Artificial Sequence
  Description of Artificial Sequence: Synthetic oligonucleotide
caggguucccagaagaac

SEQ ID NO: 134280 - RNA, 18 nt, Artificial Sequence
  Description of Artificial Sequence: Synthetic oligonucleotide
gugggcaggguucccaga

SEQ ID NO: 134281 - RNA, 18 nt, Artificial Sequence
  Description of Artificial Sequence: Synthetic oligonucleotide
ugggagugggcaggguuc

SEQ ID NO: 134282 - RNA, 18 nt, Artificial Sequence
  Description of Artificial Sequence: Synthetic oligonucleotide
gguccugggagugggcag

SEQ ID NO: 134283 - RNA, 18 nt, Artificial Sequence
  Description of Artificial Sequence: Synthetic oligonucleotide
aucuugguccugggagug

SEQ ID NO: 134284 - RNA, 18 nt, Artificial Sequence
  Description of Artificial Sequence: Synthetic oligonucleotide
ggccaaucuugguccugg

SEQ ID NO: 134285 - RNA, 18 nt, Artificial Sequence
  Description of Artificial Sequence: Synthetic oligonucleotide
ccucaggccaaucuuggu

SEQ ID NO: 134286 - RNA, 18 nt, Artificial Sequence
  Description of Artificial Sequence: Synthetic oligonucleotide
ugcagccucaggccaauc

SEQ ID NO: 134287 - RNA, 18 nt, Artificial Sequence
  Description of Artificial Sequence: Synthetic oligonucleotide
uuuagugcagccucaggc

SEQ ID NO: 134288 - RNA, 18 nt, Artificial Sequence
  Description of Artificial Sequence: Synthetic oligonucleotide
ugaauuuuagugcagccu

SEQ ID NO: 134289 - RNA, 18 nt, Artificial Sequence
  Description of Artificial Sequence: Synthetic oligonucleotide
cuaagugaauuuuagugc

SEQ ID NO: 134290 - RNA, 18 nt, Artificial Sequence
  Description of Artificial Sequence: Synthetic oligonucleotide
cgacccuaagugaauuuu

SEQ ID NO: 134291 - RNA, 18 nt, Artificial Sequence
  Description of Artificial Sequence: Synthetic oligonucleotide
augcucgacccuaaguga

SEQ ID NO: 134292 - RNA, 18 nt, Artificial Sequence
  Description of Artificial Sequence: Synthetic oligonucleotide
acaggaugcucgacccua

SEQ ID NO: 134293 - RNA, 18 nt, Artificial Sequence
  Description of Artificial Sequence: Synthetic oligonucleotide
agcaaacaggaugcucga

SEQ ID NO: 134294 - RNA, 18 nt, Artificial Sequence
  Description of Artificial Sequence: Synthetic oligonucleotide
uuaucagcaaacaggaug

SEQ ID NO: 134295 - RNA, 18 nt, Artificial Sequence
  Description of Artificial Sequence: Synthetic oligonucleotide
aauauuuaucagcaaaca

SEQ ID NO: 134296 - RNA, 18 nt, Artificial Sequence
  Description of Artificial Sequence: Synthetic oligonucleotide
uccuuaauauuuaucagc

SEQ ID NO: 134297 - RNA, 18 nt, Artificial Sequence
  Description of Artificial Sequence: Synthetic oligonucleotide
aauucuccuuaauauuua

SEQ ID NO: 134298 - RNA, 18 nt, Artificial Sequence
  Description of Artificial Sequence: Synthetic oligonucleotide
ucaugaauucuccuuaau

SEQ ID NO: 134299 - RNA, 18 nt, Artificial Sequence
  Description of Artificial Sequence: Synthetic oligonucleotide
aagagucaugaauucucc

SEQ ID NO: 134300 - RNA, 18 nt, Artificial Sequence
  Description of Artificial Sequence: Synthetic oligonucleotide
cugucaagagucaugaau

SEQ ID NO: 134301 - RNA, 18 nt, Artificial Sequence
  Description of Artificial Sequence: Synthetic oligonucleotide
aaaagcugucaagaguca

SEQ ID NO: 134302 - RNA, 18 nt, Artificial Sequence
  Description of Artificial Sequence: Synthetic oligonucleotide
gagagaaaagcugucaag

SEQ ID NO: 134303 - RNA, 18 nt, Artificial Sequence
  Description of Artificial Sequence: Synthetic oligonucleotide
gugaagagagaaaagcug

SEQ ID NO: 134304 - RNA, 18 nt, Artificial Sequence
  Description of Artificial Sequence: Synthetic oligonucleotide
gggagugaagagagaaaa

SEQ ID NO: 134305 - RNA, 18 nt, Artificial Sequence
  Description of Artificial Sequence: Synthetic oligonucleotide
cccuccccuugacuuggg

SEQ ID NO: 134306 - RNA, 18 nt, Artificial Sequence
  Description of Artificial Sequence: Synthetic oligonucleotide
gccaccccuccccuugac

SEQ ID NO: 134307 - RNA, 18 nt, Artificial Sequence
  Description of Artificial Sequence: Synthetic oligonucleotide
ccccugccaccccucccc

SEQ ID NO: 134308 - RNA, 18 nt, Artificial Sequence
  Description of Artificial Sequence: Synthetic oligonucleotide
acagaccccugccacccc

SEQ ID NO: 134309 - RNA, 18 nt, Artificial Sequence
  Description of Artificial Sequence: Synthetic oligonucleotide
aggaaacagaccccugcc

SEQ ID NO: 134310 - RNA, 18 nt, Artificial Sequence
  Description of Artificial Sequence: Synthetic oligonucleotide
cuuccaggaaacagaccc

SEQ ID NO: 134311 - RNA, 18 nt, Artificial Sequence
  Description of Artificial Sequence: Synthetic oligonucleotide
ccugacuuccaggaaaca

SEQ ID NO: 134312 - RNA, 18 nt, Artificial Sequence
  Description of Artificial Sequence: Synthetic oligonucleotide
augagccugacuuccagg

SEQ ID NO: 134313 - RNA, 18 nt, Artificial Sequence
  Description of Artificial Sequence: Synthetic oligonucleotide
gccagaugagccugacuu

SEQ ID NO: 134314 - RNA, 18 nt, Artificial Sequence
  Description of Artificial Sequence: Synthetic oligonucleotide
aacaggccagaugagccu

SEQ ID NO: 134315 - RNA, 18 nt, Artificial Sequence
  Description of Artificial Sequence: Synthetic oligonucleotide
augccaacaggccagaug

SEQ ID NO: 134316 - RNA, 18 nt, Artificial Sequence
  Description of Artificial Sequence: Synthetic oligonucleotide
cccccaugccaacaggcc

SEQ ID NO: 134317 - RNA, 18 nt, Artificial Sequence
  Description of Artificial Sequence: Synthetic oligonucleotide
ucccacccccaugccaac

SEQ ID NO: 134318 - RNA, 18 nt, Artificial Sequence
  Description of Artificial Sequence: Synthetic oligonucleotide
cacugucccacccccaug

SEQ ID NO: 134319 - RNA, 18 nt, Artificial Sequence
  Description of Artificial Sequence: Synthetic oligonucleotide
gugcacacugucccaccc

SEQ ID NO: 134320 - RNA, 18 nt, Artificial Sequence
  Description of Artificial Sequence: Synthetic oligonucleotide
acacugugcacacugucc

SEQ ID NO: 134321 - RNA, 18 nt, Artificial Sequence
  Description of Artificial Sequence: Synthetic oligonucleotide
cccccacacugugcacac

SEQ ID NO: 134322 - RNA, 18 nt, Artificial Sequence
  Description of Artificial Sequence: Synthetic oligonucleotide
cccugcccccacacugug

SEQ ID NO: 134323 - RNA, 18 nt, Artificial Sequence
  Description of Artificial Sequence: Synthetic oligonucleotide
cccuccccugcccccaca

SEQ ID NO: 134324 - RNA, 18 nt, Artificial Sequence
  Description of Artificial Sequence: Synthetic oligonucleotide
cuuagcccuccccugccc

SEQ ID NO: 134325 - RNA, 18 nt, Artificial Sequence
  Description of Artificial Sequence: Synthetic oligonucleotide
gccugcuuagcccucccc

SEQ ID NO: 134326 - RNA, 18 nt, Artificial Sequence
  Description of Artificial Sequence: Synthetic oligonucleotide
cccaggccugcuuagccc

SEQ ID NO: 134327 - RNA, 18 nt, Artificial Sequence
  Description of Artificial Sequence: Synthetic oligonucleotide
ucaaacccaggccugcuu

SEQ ID NO: 134328 - RNA, 18 nt, Artificial Sequence
  Description of Artificial Sequence: Synthetic oligonucleotide
agcccucaaacccaggcc

SEQ ID NO: 134329 - RNA, 18 nt, Artificial Sequence
  Description of Artificial Sequence: Synthetic oligonucleotide
ggagcagcccucaaaccc

SEQ ID NO: 134330 - RNA, 18 nt, Artificial Sequence
  Description of Artificial Sequence: Synthetic oligonucleotide
ucuccggagcagcccuca

SEQ ID NO: 134331 - RNA, 18 nt, Artificial Sequence
  Description of Artificial Sequence: Synthetic oligonucleotide
gacggucuccggagcagc

SEQ ID NO: 134332 - RNA, 18 nt, Artificial Sequence
  Description of Artificial Sequence: Synthetic oligonucleotide
ggagugacggucuccgga

SEQ ID NO: 134333 - RNA, 18 nt, Artificial Sequence
  Description of Artificial Sequence: Synthetic oligonucleotide
caccuggagugacggucu

SEQ ID NO: 134334 - RNA, 18 nt, Artificial Sequence
  Description of Artificial Sequence: Synthetic oligonucleotide
gaaugcaccuggagugac

SEQ ID NO: 134335 - RNA, 18 nt, Artificial Sequence
  Description of Artificial Sequence: Synthetic oligonucleotide
uuccagaaugcaccugga

SEQ ID NO: 134336 - RNA, 18 nt, Artificial Sequence
  Description of Artificial Sequence: Synthetic oligonucleotide
aaugcuuccagaaugcac

SEQ ID NO: 134337 - RNA, 18 nt, Artificial Sequence
  Description of Artificial Sequence: Synthetic oligonucleotide
ggucuaaugcuuccagaa

SEQ ID NO: 134338 - RNA, 18 nt, Artificial Sequence
  Description of Artificial Sequence: Synthetic oligonucleotide
gggucuaaugcuuccaga

SEQ ID NO: 134339 - RNA, 18 nt, Artificial Sequence
  Description of Artificial Sequence: Synthetic oligonucleotide
uggucgcuccauccuggg

SEQ ID NO: 134340 - RNA, 18 nt, Artificial Sequence
  Description of Artificial Sequence: Synthetic oligonucleotide
caugcuggucgcuccauc

SEQ ID NO: 134341 - RNA, 18 nt, Artificial Sequence
  Description of Artificial Sequence: Synthetic oligonucleotide
gaugacaugcuggucgcu

SEQ ID NO: 134342 - RNA, 18 nt, Artificial Sequence
  Description of Artificial Sequence: Synthetic oligonucleotide
acauggaugacaugcugg

SEQ ID NO: 134343 - RNA, 18 nt, Artificial Sequence
  Description of Artificial Sequence: Synthetic oligonucleotide
auuccacauggaugacau

SEQ ID NO: 134344 - RNA, 18 nt, Artificial Sequence
  Description of Artificial Sequence: Synthetic oligonucleotide
ccaagauuccacauggau

SEQ ID NO: 134345 - RNA, 18 nt, Artificial Sequence
  Description of Artificial Sequence: Synthetic oligonucleotide
agccaccaagauuccaca

SEQ ID NO: 134346 - RNA, 18 nt, Artificial Sequence
  Description of Artificial Sequence: Synthetic oligonucleotide
cucaaagccaccaagauu

SEQ ID NO: 134347 - RNA, 18 nt, Artificial Sequence
  Description of Artificial Sequence: Synthetic oligonucleotide
auguccucaaagccacca

SEQ ID NO: 134348 - RNA, 18 nt, Artificial Sequence
  Description of Artificial Sequence: Synthetic oligonucleotide
ccagaauguccucaaagc

SEQ ID NO: 134349 - RNA, 18 nt, Artificial Sequence
  Description of Artificial Sequence: Synthetic oligonucleotide
auuuuccagaauguccuc

SEQ ID NO: 134350 - RNA, 18 nt, Artificial Sequence
  Description of Artificial Sequence: Synthetic oligonucleotide
guggcauuuuccagaaug

SEQ ID NO: 134351 - RNA, 18 nt, Artificial Sequence
  Description of Artificial Sequence: Synthetic oligonucleotide
ggucaguggcauuuucca

SEQ ID NO: 134352 - RNA, 18 nt, Artificial Sequence
  Description of Artificial Sequence: Synthetic oligonucleotide
acacuggucaguggcauu

SEQ ID NO: 134353 - RNA, 18 nt, Artificial Sequence
  Description of Artificial Sequence: Synthetic oligonucleotide
uguucacacuggucagug

SEQ ID NO: 134354 - RNA, 18 nt, Artificial Sequence
  Description of Artificial Sequence: Synthetic oligonucleotide
ccuuuuguucacacuggu

SEQ ID NO: 134355 - RNA, 18 nt, Artificial Sequence
  Description of Artificial Sequence: Synthetic oligonucleotide
acaucccuuuuguucaca

SEQ ID NO: 134356 - RNA, 18 nt, Artificial Sequence
  Description of Artificial Sequence: Synthetic oligonucleotide
auaacacaucccuuuugu

SEQ ID NO: 134357 - RNA, 18 nt, Artificial Sequence
  Description of Artificial Sequence: Synthetic oligonucleotide
gccccauaacacaucccu

SEQ ID NO: 134358 - RNA, 18 nt, Artificial Sequence
  Description of Artificial Sequence: Synthetic oligonucleotide
cuccagccccauaacaca

SEQ ID NO: 134359 - RNA, 18 nt, Artificial Sequence
  Description of Artificial Sequence: Synthetic oligonucleotide
cacaccuccagccccaua

SEQ ID NO: 134360 - RNA, 18 nt, Artificial Sequence
  Description of Artificial Sequence: Synthetic oligonucleotide
cuaaucacaccuccagcc

SEQ ID NO: 134361 - RNA, 18 nt, Artificial Sequence
  Description of Artificial Sequence: Synthetic oligonucleotide
ccuaccuaaucacaccuc

SEQ ID NO: 134362 - RNA, 18 nt, Artificial Sequence
  Description of Artificial Sequence: Synthetic oligonucleotide
ucccuccuaccuaaucac

SEQ ID NO: 134363 - RNA, 18 nt, Artificial Sequence
  Description of Artificial Sequence: Synthetic oligonucleotide
caguuucccuccuaccua

SEQ ID NO: 134364 - RNA, 18 nt, Artificial Sequence
  Description of Artificial Sequence: Synthetic oligonucleotide
uccaacaguuucccuccu

SEQ ID NO: 134365 - RNA, 18 nt, Artificial Sequence
  Description of Artificial Sequence: Synthetic oligonucleotide
gucgguccaacaguuucc

SEQ ID NO: 134366 - RNA, 18 nt, Artificial Sequence
  Description of Artificial Sequence: Synthetic oligonucleotide
caggagucgguccaacag

SEQ ID NO: 134367 - RNA, 18 nt, Artificial Sequence
  Description of Artificial Sequence: Synthetic oligonucleotide
gggcaggagucgguccaa

SEQ ID NO: 134368 - RNA, 18 nt, Artificial Sequence
  Description of Artificial Sequence: Synthetic oligonucleotide
ggucaguguugagcaggg

SEQ ID NO: 134369 - RNA, 18 nt, Artificial Sequence
  Description of Artificial Sequence: Synthetic oligonucleotide
gggucaguguugagcagg

SEQ ID NO: 134370 - RNA, 18 nt, Artificial Sequence
  Description of Artificial Sequence: Synthetic oligonucleotide
cuccaaccacucagaggg

SEQ ID NO: 134371 - RNA, 18 nt, Artificial Sequence
  Description of Artificial Sequence: Synthetic oligonucleotide
acugccuccaaccacuca

SEQ ID NO: 134372 - RNA, 18 nt, Artificial Sequence
  Description of Artificial Sequence: Synthetic oligonucleotide
gggcacugccuccaacca

SEQ ID NO: 134373 - RNA, 18 nt, Artificial Sequence
  Description of Artificial Sequence: Synthetic oligonucleotide
ggauuucugggcacuggg

SEQ ID NO: 134374 - RNA, 18 nt, Artificial Sequence
  Description of Artificial Sequence: Synthetic oligonucleotide
uggugggauuucugggca

SEQ ID NO: 134375 - RNA, 18 nt, Artificial Sequence
  Description of Artificial Sequence: Synthetic oligonucleotide
acuaauggugggauuucu

SEQ ID NO: 134376 - RNA, 18 nt, Artificial Sequence
  Description of Artificial Sequence: Synthetic oligonucleotide
caaucacuaaugguggga

SEQ ID NO: 134377 - RNA, 18 nt, Artificial Sequence
  Description of Artificial Sequence: Synthetic oligonucleotide
aaaaacaaucacuaaugg

SEQ ID NO: 134378 - RNA, 18 nt, Artificial Sequence
  Description of Artificial Sequence: Synthetic oligonucleotide
ucauaaaaaacaaucacu

SEQ ID NO: 134379 - RNA, 18 nt, Artificial Sequence
  Description of Artificial Sequence: Synthetic oligonucleotide
cuuucucauaaaaaacaa

SEQ ID NO: 134380 - RNA, 18 nt, Artificial Sequence
  Description of Artificial Sequence: Synthetic oligonucleotide
cgccucuuucucauaaaa

SEQ ID NO: 134381 - RNA, 18 nt, Artificial Sequence
  Description of Artificial Sequence: Synthetic oligonucleotide
cuccacgccucuuucuca

SEQ ID NO: 134382 - RNA, 18 nt, Artificial Sequence
  Description of Artificial Sequence: Synthetic oligonucleotide
uacuucuccacgccucuu

SEQ ID NO: 134383 - RNA, 18 nt, Artificial Sequence
  Description of Artificial Sequence: Synthetic oligonucleotide
cccaauacuucuccacgc

SEQ ID NO: 134384 - RNA, 18 nt, Artificial Sequence
  Description of Artificial Sequence: Synthetic oligonucleotide
auugccccaauacuucuc

SEQ ID NO: 134385 - RNA, 18 nt, Artificial Sequence
  Description of Artificial Sequence: Synthetic oligonucleotide
gacacauugccccaauac

SEQ ID NO: 134386 - RNA, 18 nt, Artificial Sequence
  Description of Artificial Sequence: Synthetic oligonucleotide
ucccugacacauugcccc

SEQ ID NO: 134387 - RNA, 18 nt, Artificial Sequence
  Description of Artificial Sequence: Synthetic oligonucleotide
auuccucccugacacauu

SEQ ID NO: 134388 - RNA, 18 nt, Artificial Sequence
  Description of Artificial Sequence: Synthetic oligonucleotide
uggugauuccucccugac

SEQ ID NO: 134389 - RNA, 18 nt, Artificial Sequence
  Description of Artificial Sequence: Synthetic oligonucleotide
ggauguggugauuccucc

SEQ ID NO: 134390 - RNA, 18 nt, Artificial Sequence
  Description of Artificial Sequence: Synthetic oligonucleotide
cguagggauguggugauu

SEQ ID NO: 134391 - RNA, 18 nt, Artificial Sequence
  Description of Artificial Sequence: Synthetic oligonucleotide
acugccguagggaugugg

SEQ ID NO: 134392 - RNA, 18 nt, Artificial Sequence
  Description of Artificial Sequence: Synthetic oligonucleotide
cugggacugccguaggga

SEQ ID NO: 134393 - RNA, 18 nt, Artificial Sequence
  Description of Artificial Sequence: Synthetic oligonucleotide
cuuggcugggacugccgu

SEQ ID NO: 134394 - RNA, 18 nt, Artificial Sequence
  Description of Artificial Sequence: Synthetic oligonucleotide
gggcuuggcugggacugc

SEQ ID NO: 134395 - RNA, 18 nt, Artificial Sequence
  Description of Artificial Sequence: Synthetic oligonucleotide
gucuccgcugggauuggg

SEQ ID NO: 134396 - RNA, 18 nt, Artificial Sequence
  Description of Artificial Sequence: Synthetic oligonucleotide
gcacagucuccgcuggga

SEQ ID NO: 134397 - RNA, 18 nt, Artificial Sequence
  Description of Artificial Sequence: Synthetic oligonucleotide
gcagggcacagucuccgc

SEQ ID NO: 134398 - RNA, 18 nt, Artificial Sequence
  Description of Artificial Sequence: Synthetic oligonucleotide
ucugagcagggcacaguc

SEQ ID NO: 134399 - RNA, 18 nt, Artificial Sequence
  Description of Artificial Sequence: Synthetic oligonucleotide
ggagcucugagcagggca

SEQ ID NO: 134400 - RNA, 18 nt, Artificial Sequence
  Description of Artificial Sequence: Synthetic oligonucleotide
gcuugggagcucugagca

SEQ ID NO: 134401 - RNA, 18 nt, Artificial Sequence
  Description of Artificial Sequence: Synthetic oligonucleotide
ggaaggcuugggagcucu

SEQ ID NO: 134402 - RNA, 18 nt, Artificial Sequence
  Description of Artificial Sequence: Synthetic oligonucleotide
gggaaggcuugggagcuc

SEQ ID NO: 134403 - RNA, 18 nt, Artificial Sequence
  Description of Artificial Sequence: Synthetic oligonucleotide
cuugagugaggugguggg

SEQ ID NO: 134404 - RNA, 18 nt, Artificial Sequence
  Description of Artificial Sequence: Synthetic oligonucleotide
gggcacuugagugaggug

SEQ ID NO: 134405 - RNA, 18 nt, Artificial Sequence
  Description of Artificial Sequence: Synthetic oligonucleotide
ccgucuggcagggauuuc

SEQ ID NO: 134406 - RNA, 18 nt, Artificial Sequence
  Description of Artificial Sequence: Synthetic oligonucleotide
cugagccgucuggcaggg

SEQ ID NO: 134407 - RNA, 18 nt, Artificial Sequence
  Description of Artificial Sequence: Synthetic oligonucleotide
ccaggcugagccgucugg

SEQ ID NO: 134408 - RNA, 18 nt, Artificial Sequence
  Description of Artificial Sequence: Synthetic oligonucleotide
gcagaccaggcugagccg

SEQ ID NO: 134409 - RNA, 18 nt, Artificial Sequence
  Description of Artificial Sequence: Synthetic oligonucleotide
uuaccgcagaccaggcug

SEQ ID NO: 134410 - RNA, 18 nt, Artificial Sequence
  Description of Artificial Sequence: Synthetic oligonucleotide
cugccuuaccgcagacca

SEQ ID NO: 134411 - RNA, 18 nt, Artificial Sequence
  Description of Artificial Sequence: Synthetic oligonucleotide
ccucccugccuuaccgca

SEQ ID NO: 134412 - RNA, 18 nt, Artificial Sequence
  Description of Artificial Sequence: Synthetic oligonucleotide
uccagccucccugccuua

SEQ ID NO: 134413 - RNA, 18 nt, Artificial Sequence
  Description of Artificial Sequence: Synthetic oligonucleotide
augguuccagccucccug

SEQ ID NO: 134414 - RNA, 18 nt, Artificial Sequence
  Description of Artificial Sequence: Synthetic oligonucleotide
cagaaaugguuccagccu

SEQ ID NO: 134415 - RNA, 18 nt, Artificial Sequence
  Description of Artificial Sequence: Synthetic oligonucleotide
augcccagaaaugguucc

SEQ ID NO: 134416 - RNA, 18 nt, Artificial Sequence
  Description of Artificial Sequence: Synthetic oligonucleotide
ccacaaugcccagaaaug

SEQ ID NO: 134417 - RNA, 18 nt, Artificial Sequence
  Description of Artificial Sequence: Synthetic oligonucleotide
aaugaccacaaugcccag

SEQ ID NO: 134418 - RNA, 18 nt, Artificial Sequence
  Description of Artificial Sequence: Synthetic oligonucleotide
gugggaaugaccacaaug

SEQ ID NO: 134419 - RNA, 18 nt, Artificial Sequence
  Description of Artificial Sequence: Synthetic oligonucleotide
acacagugggaaugacca

SEQ ID NO: 134420 - RNA, 18 nt, Artificial Sequence
  Description of Artificial Sequence: Synthetic oligonucleotide
gaggaacacagugggaau

SEQ ID NO: 134421 - RNA, 18 nt, Artificial Sequence
  Description of Artificial Sequence: Synthetic oligonucleotide
agguggaggaacacagug

SEQ ID NO: 134422 - RNA, 18 nt, Artificial Sequence
  Description of Artificial Sequence: Synthetic oligonucleotide
ggaggagguggaggaaca

SEQ ID NO: 134423 - RNA, 18 nt, Artificial Sequence
  Description of Artificial Sequence: Synthetic oligonucleotide
uggagggaggagguggag

SEQ ID NO: 134424 - RNA, 18 nt, Artificial Sequence
  Description of Artificial Sequence: Synthetic oligonucleotide
aacgcuggagggaggagg

SEQ ID NO: 134425 - RNA, 18 nt, Artificial Sequence
  Description of Artificial Sequence: Synthetic oligonucleotide
ugagcaacgcuggaggga

SEQ ID NO: 134426 - RNA, 18 nt, Artificial Sequence
  Description of Artificial Sequence: Synthetic oligonucleotide
aggucugagcaacgcugg

SEQ ID NO: 134427 - RNA, 18 nt, Artificial Sequence
  Description of Artificial Sequence: Synthetic oligonucleotide
gacagaggucugagcaac

SEQ ID NO: 134428 - RNA, 18 nt, Artificial Sequence
  Description of Artificial Sequence: Synthetic oligonucleotide
cccaagacagaggucuga

SEQ ID NO: 134429 - RNA, 18 nt, Artificial Sequence
  Description of Artificial Sequence: Synthetic oligonucleotide
uuucucccaagacagagg

SEQ ID NO: 134430 - RNA, 18 nt, Artificial Sequence
  Description of Artificial Sequence: Synthetic oligonucleotide
caaccuuucucccaagac

SEQ ID NO: 134431 - RNA, 18 nt, Artificial Sequence
  Description of Artificial Sequence: Synthetic oligonucleotide
uaucucaaccuuucuccc

SEQ ID NO: 134432 - RNA, 18 nt, Artificial Sequence
  Description of Artificial Sequence: Synthetic oligonucleotide
auucuuaucucaaccuuu

SEQ ID NO: 134433 - RNA, 18 nt, Artificial Sequence
  Description of Artificial Sequence: Synthetic oligonucleotide
gggacauucuuaucucaa

SEQ ID NO: 134434 - RNA, 18 nt, Artificial Sequence
  Description of Artificial Sequence: Synthetic oligonucleotide
uccaugggacauucuuau

SEQ ID NO: 134435 - RNA, 18 nt, Artificial Sequence
  Description of Artificial Sequence: Synthetic oligonucleotide
ggcacuccaugggacauu

SEQ ID NO: 134436 - RNA, 18 nt, Artificial Sequence
  Description of Artificial Sequence: Synthetic oligonucleotide
cccacggcacuccauggg

SEQ ID NO: 134437 - RNA, 18 nt, Artificial Sequence
  Description of Artificial Sequence: Synthetic oligonucleotide
uguugcccacggcacucc

SEQ ID NO: 134438 - RNA, 18 nt, Artificial Sequence
  Description of Artificial Sequence: Synthetic oligonucleotide
gccacuguugcccacggc

SEQ ID NO: 134439 - RNA, 18 nt, Artificial Sequence
  Description of Artificial Sequence: Synthetic oligonucleotide
gaagggccacuguugccc

SEQ ID NO: 134440 - RNA, 18 nt, Artificial Sequence
  Description of Artificial Sequence: Synthetic oligonucleotide
cccaugaagggccacugu

SEQ ID NO: 134441 - RNA, 18 nt, Artificial Sequence
  Description of Artificial Sequence: Synthetic oligonucleotide
uuguucccaugaagggcc

SEQ ID NO: 134442 - RNA, 18 nt, Artificial Sequence
  Description of Artificial Sequence: Synthetic oligonucleotide
acagauuguucccaugaa

SEQ ID NO: 134443 - RNA, 18 nt, Artificial Sequence
  Description of Artificial Sequence: Synthetic oligonucleotide
cuccaacagauuguuccc

SEQ ID NO: 134444 - RNA, 18 nt, Artificial Sequence
  Description of Artificial Sequence: Synthetic oligonucleotide
cccugcuccaacagauug

SEQ ID NO: 134445 - RNA, 18 nt, Artificial Sequence
  Description of Artificial Sequence: Synthetic oligonucleotide
ugacccccugcuccaaca

SEQ ID NO: 134446 - RNA, 18 nt, Artificial Sequence
  Description of Artificial Sequence: Synthetic oligonucleotide
agaacugacccccugcuc

SEQ ID NO: 134447 - RNA, 18 nt, Artificial Sequence
  Description of Artificial Sequence: Synthetic oligonucleotide
agcagagaacugaccccc

SEQ ID NO: 134448 - RNA, 18 nt, Artificial Sequence
  Description of Artificial Sequence: Synthetic oligonucleotide
uucccagcagagaacuga

SEQ ID NO: 134449 - RNA, 18 nt, Artificial Sequence
  Description of Artificial Sequence: Synthetic oligonucleotide
guagauucccagcagaga

SEQ ID NO: 134450 - RNA, 18 nt, Artificial Sequence
  Description of Artificial Sequence: Synthetic oligonucleotide
ggguagauucccagcaga

SEQ ID NO: 134451 - RNA, 18 nt, Artificial Sequence
  Description of Artificial Sequence: Synthetic oligonucleotide
uuucuccuccagaaaggg

SEQ ID NO: 134452 - RNA, 18 nt, Artificial Sequence
  Description of Artificial Sequence: Synthetic oligonucleotide
auggguuucuccuccaga

SEQ ID NO: 134453 - RNA, 18 nt, Artificial Sequence
  Description of Artificial Sequence: Synthetic oligonucleotide
guggaauggguuucuccu

SEQ ID NO: 134454 - RNA, 18 nt, Artificial Sequence
  Description of Artificial Sequence: Synthetic oligonucleotide
uuaagguggaauggguuu

SEQ ID NO: 134455 - RNA, 18 nt, Artificial Sequence
  Description of Artificial Sequence: Synthetic oligonucleotide
aguuauuaagguggaaug

SEQ ID NO: 134456 - RNA, 18 nt, Artificial Sequence
  Description of Artificial Sequence: Synthetic oligonucleotide
aauaaaguuauuaaggug

SEQ ID NO: 134457 - RNA, 18 nt, Artificial Sequence
  Description of Artificial Sequence: Synthetic oligonucleotide
auuacaauaaaguuauua

SEQ ID NO: 134458 - RNA, 18 nt, Artificial Sequence
  Description of Artificial Sequence: Synthetic oligonucleotide
cucacauuacaauaaagu

SEQ ID NO: 134459 - RNA, 18 nt, Artificial Sequence
  Description of Artificial Sequence: Synthetic oligonucleotide
uguuucucacauuacaau

SEQ ID NO: 134460 - RNA, 18 nt, Artificial Sequence
  Description of Artificial Sequence: Synthetic oligonucleotide
uuuuguguuucucacauu

SEQ ID NO: 134461 - RNA, 18 nt, Artificial Sequence
  Description of Artificial Sequence: Synthetic oligonucleotide
cuuuguuuuguguuucuc

SEQ ID NO: 134462 - RNA, 18 nt, Artificial Sequence
  Description of Artificial Sequence: Synthetic oligonucleotide
guaaacuuuguuuugugu

SEQ ID NO: 134463 - RNA, 18 nt, Artificial Sequence
  Description of Artificial Sequence: Synthetic oligonucleotide
aaaaaguaaacuuuguuu

SEQ ID NO: 134464 - RNA, 18 nt, Artificial Sequence
  Description of Artificial Sequence: Synthetic oligonucleotide
agucaaaaaaguaaacuu

SEQ ID NO: 134465 - RNA, 18 nt, Artificial Sequence
  Description of Artificial Sequence: Synthetic oligonucleotide
cuuagagucaaaaaagua

SEQ ID NO: 134466 - RNA, 18 nt, Artificial Sequence
  Description of Artificial Sequence: Synthetic oligonucleotide
gucagcuuagagucaaaa

SEQ ID NO: 134467 - RNA, 18 nt, Artificial Sequence
  Description of Artificial Sequence: Synthetic oligonucleotide
aucaugucagcuuagagu

SEQ ID NO: 134468 - RNA, 18 nt, Artificial Sequence
  Description of Artificial Sequence: Synthetic oligonucleotide
cuaauaucaugucagcuu

SEQ ID NO: 134469 - RNA, 18 nt, Artificial Sequence
  Description of Artificial Sequence: Synthetic oligonucleotide
auuuucuaauaucauguc

SEQ ID NO: 134470 - RNA, 18 nt, Artificial Sequence
  Description of Artificial Sequence: Synthetic oligonucleotide
gagagauuuucuaauauc

SEQ ID NO: 134471 - RNA, 18 nt, Artificial Sequence
  Description of Artificial Sequence: Synthetic oligonucleotide
agagcgagagauuuucua

SEQ ID NO: 134472 - RNA, 18 nt, Artificial Sequence
  Description of Artificial Sequence: Synthetic oligonucleotide
aaaagagagcgagagauu

SEQ ID NO: 134473 - RNA, 18 nt, Artificial Sequence
  Description of Artificial Sequence: Synthetic oligonucleotide
aaaaaaaaagagagcgag

SEQ ID NO: 134474 - RNA, 18 nt, Artificial Sequence
  Description of Artificial Sequence: Synthetic oligonucleotide
aaaaaaaaaaaaaagaga

SEQ ID NO: 134475 - RNA, 18 nt, Artificial Sequence
  Description of Artificial Sequence: Synthetic oligonucleotide
aaaaaaaaaaaaaaaaaa

SEQ ID NO: 134476 - RNA, 18 nt, Artificial Sequence
  Description of Artificial Sequence: Synthetic oligonucleotide
aaaaaaaaaaaaaaaaaa

SEQ ID NO: 134477 - RNA, 18 nt, Artificial Sequence
  Description of Artificial Sequence: Synthetic oligonucleotide
uagccaaaaaaaaaaaaa

SEQ ID NO: 134478 - RNA, 18 nt, Artificial Sequence
  Description of Artificial Sequence: Synthetic oligonucleotide
ucaaguagccaaaaaaaa

SEQ ID NO: 134479 - RNA, 18 nt, Artificial Sequence
  Description of Artificial Sequence: Synthetic oligonucleotide
acaacucaaguagccaaa

SEQ ID NO: 134480 - RNA, 18 nt, Artificial Sequence
  Description of Artificial Sequence: Synthetic oligonucleotide
ggaccacaacucaaguag

SEQ ID NO: 134481 - RNA, 18 nt, Artificial Sequence
  Description of Artificial Sequence: Synthetic oligonucleotide
uuuuaggaccacaacuca

SEQ ID NO: 134482 - RNA, 18 nt, Artificial Sequence
  Description of Artificial Sequence: Synthetic oligonucleotide
uuauguuuuaggaccaca

SEQ ID NO: 134483 - RNA, 18 nt, Artificial Sequence
  Description of Artificial Sequence: Synthetic oligonucleotide
agauuuuauguuuuagga

SEQ ID NO: 134484 - RNA, 18 nt, Artificial Sequence
  Description of Artificial Sequence: Synthetic oligonucleotide
ccaucagauuuuauguuu

SEQ ID NO: 134485 - RNA, 18 nt, Artificial Sequence
  Description of Artificial Sequence: Synthetic oligonucleotide
uuuguccaucagauuuua

SEQ ID NO: 134486 - RNA, 18 nt, Artificial Sequence
  Description of Artificial Sequence: Synthetic oligonucleotide
cucuguuuguccaucaga

SEQ ID NO: 134487 - RNA, 18 nt, Artificial Sequence
  Description of Artificial Sequence: Synthetic oligonucleotide
caacccucuguuugucca

SEQ ID NO: 134488 - RNA, 18 nt, Artificial Sequence
  Description of Artificial Sequence: Synthetic oligonucleotide
cccagcaacccucuguuu

SEQ ID NO: 134489 - RNA, 18 nt, Artificial Sequence
  Description of Artificial Sequence: Synthetic oligonucleotide
guccccccagcaacccuc

SEQ ID NO: 134490 - RNA, 18 nt, Artificial Sequence
  Description of Artificial Sequence: Synthetic oligonucleotide
cgcuuguccccccagcaa

SEQ ID NO: 134491 - RNA, 18 nt, Artificial Sequence
  Description of Artificial Sequence: Synthetic oligonucleotide
gcccacgcuugucccccc

SEQ ID NO: 134492 - RNA, 18 nt, Artificial Sequence
  Description of Artificial Sequence: Synthetic oligonucleotide
auugugcccacgcuuguc

SEQ ID NO: 134493 - RNA, 18 nt, Artificial Sequence
  Description of Artificial Sequence: Synthetic oligonucleotide
gggaaauugugcccacgc

SEQ ID NO: 134494 - RNA, 18 nt, Artificial Sequence
  Description of Artificial Sequence: Synthetic oligonucleotide
aagaucagggugucuugg

SEQ ID NO: 134495 - RNA, 18 nt, Artificial Sequence
  Description of Artificial Sequence: Synthetic oligonucleotide
gccugaagaucagggugu

SEQ ID NO: 134496 - RNA, 18 nt, Artificial Sequence
  Description of Artificial Sequence: Synthetic oligonucleotide
gacccgccugaagaucag

SEQ ID NO: 134497 - RNA, 18 nt, Artificial Sequence
  Description of Artificial Sequence: Synthetic oligonucleotide
ccugagacccgccugaag

SEQ ID NO: 134498 - RNA, 18 nt, Artificial Sequence
  Description of Artificial Sequence: Synthetic oligonucleotide
aagcuccugagacccgcc

SEQ ID NO: 134499 - RNA, 18 nt, Artificial Sequence
  Description of Artificial Sequence: Synthetic oligonucleotide
uuuagaagcuccugagac

SEQ ID NO: 134500 - RNA, 18 nt, Artificial Sequence
  Description of Artificial Sequence: Synthetic oligonucleotide
ggauuuuuagaagcuccu

SEQ ID NO: 134501 - RNA, 18 nt, Artificial Sequence
  Description of Artificial Sequence: Synthetic oligonucleotide
caugcggauuuuuagaag

SEQ ID NO: 134502 - RNA, 18 nt, Artificial Sequence
  Description of Artificial Sequence: Synthetic oligonucleotide
agagccaugcggauuuuu

SEQ ID NO: 134503 - RNA, 18 nt, Artificial Sequence
  Description of Artificial Sequence: Synthetic oligonucleotide
ucaggagagccaugcgga

SEQ ID NO: 134504 - RNA, 18 nt, Artificial Sequence
  Description of Artificial Sequence: Synthetic oligonucleotide
cacucucaggagagccau

SEQ ID NO: 134505 - RNA, 18 nt, Artificial Sequence
  Description of Artificial Sequence: Synthetic oligonucleotide
cuguccacucucaggaga

SEQ ID NO: 134506 - RNA, 18 nt, Artificial Sequence
  Description of Artificial Sequence: Synthetic oligonucleotide
cuccucuguccacucuca

SEQ ID NO: 134507 - RNA, 18 nt, Artificial Sequence
  Description of Artificial Sequence: Synthetic oligonucleotide
cuccucuccucuguccac

SEQ ID NO: 134508 - RNA, 18 nt, Artificial Sequence
  Description of Artificial Sequence: Synthetic oligonucleotide
acccucuccucuccucug

SEQ ID NO: 134509 - RNA, 18 nt, Artificial Sequence
  Description of Artificial Sequence: Synthetic oligonucleotide
uucugacccucuccucuc

SEQ ID NO: 134510 - RNA, 18 nt, Artificial Sequence
  Description of Artificial Sequence: Synthetic oligonucleotide
uucauuucugacccucuc

SEQ ID NO: 134511 - RNA, 18 nt, Artificial Sequence
  Description of Artificial Sequence: Synthetic oligonucleotide
gagcguucauuucugacc

SEQ ID NO: 134512 - RNA, 18 nt, Artificial Sequence
  Description of Artificial Sequence: Synthetic oligonucleotide
uagaagagcguucauuuc

SEQ ID NO: 134513 - RNA, 18 nt, Artificial Sequence
  Description of Artificial Sequence: Synthetic oligonucleotide
agaaauagaagagcguuc

SEQ ID NO: 134514 - RNA, 18 nt, Artificial Sequence
  Description of Artificial Sequence: Synthetic oligonucleotide
ugacaagaaauagaagag

SEQ ID NO: 134515 - RNA, 18 nt, Artificial Sequence
  Description of Artificial Sequence: Synthetic oligonucleotide
gguaaugacaagaaauag

SEQ ID NO: 134516 - RNA, 18 nt, Artificial Sequence
  Description of Artificial Sequence: Synthetic oligonucleotide
ggcuugguaaugacaaga

SEQ ID NO: 134517 - RNA, 18 nt, Artificial Sequence
  Description of Artificial Sequence: Synthetic oligonucleotide
uaauuggcuugguaauga

SEQ ID NO: 134518 - RNA, 18 nt, Artificial Sequence
  Description of Artificial Sequence: Synthetic oligonucleotide
aaaaguaauuggcuuggu

SEQ ID NO: 134519 - RNA, 18 nt, Artificial Sequence
  Description of Artificial Sequence: Synthetic oligonucleotide
uuggcaaaaguaauuggc

SEQ ID NO: 134520 - RNA, 18 nt, Artificial Sequence
  Description of Artificial Sequence: Synthetic oligonucleotide
aaaauuuggcaaaaguaa

SEQ ID NO: 134521 - RNA, 18 nt, Artificial Sequence
  Description of Artificial Sequence: Synthetic oligonucleotide
acagaaaaauuuggcaaa

SEQ ID NO: 134522 - RNA, 18 nt, Artificial Sequence
  Description of Artificial Sequence: Synthetic oligonucleotide
agaucacagaaaaauuug

SEQ ID NO: 134523 - RNA, 18 nt, Artificial Sequence
  Description of Artificial Sequence: Synthetic oligonucleotide
agggcagaucacagaaaa

SEQ ID NO: 134524 - RNA, 18 nt, Artificial Sequence
  Description of Artificial Sequence: Synthetic oligonucleotide
uaaucagggcagaucaca

SEQ ID NO: 134525 - RNA, 18 nt, Artificial Sequence
  Description of Artificial Sequence: Synthetic oligonucleotide
caucuuaaucagggcaga

SEQ ID NO: 134526 - RNA, 18 nt, Artificial Sequence
  Description of Artificial Sequence: Synthetic oligonucleotide
caauucaucuuaaucagg

SEQ ID NO: 134527 - RNA, 18 nt, Artificial Sequence
  Description of Artificial Sequence: Synthetic oligonucleotide
uuucacaauucaucuuaa

SEQ ID NO: 134528 - RNA, 18 nt, Artificial Sequence
  Description of Artificial Sequence: Synthetic oligonucleotide
guaaauuucacaauucau

SEQ ID NO: 134529 - RNA, 18 nt, Artificial Sequence
  Description of Artificial Sequence: Synthetic oligonucleotide
uugauguaaauuucacaa

SEQ ID NO: 134530 - RNA, 18 nt, Artificial Sequence
  Description of Artificial Sequence: Synthetic oligonucleotide
auugcuugauguaaauuu

SEQ ID NO: 134531 - RNA, 18 nt, Artificial Sequence
  Description of Artificial Sequence: Synthetic oligonucleotide
ugauaauugcuugaugua

SEQ ID NO: 134532 - RNA, 18 nt, Artificial Sequence
  Description of Artificial Sequence: Synthetic oligonucleotide
cgcuuugauaauugcuug

SEQ ID NO: 134533 - RNA, 18 nt, Artificial Sequence
  Description of Artificial Sequence: Synthetic oligonucleotide
cagcccgcuuugauaauu

SEQ ID NO: 134534 - RNA, 18 nt, Artificial Sequence
  Description of Artificial Sequence: Synthetic oligonucleotide
ggacccagcccgcuuuga

SEQ ID NO: 134535 - RNA, 18 nt, Artificial Sequence
  Description of Artificial Sequence: Synthetic oligonucleotide
ugaugggacccagcccgc

SEQ ID NO: 134536 - RNA, 18 nt, Artificial Sequence
  Description of Artificial Sequence: Synthetic oligonucleotide
cguucugaugggacccag

SEQ ID NO: 134537 - RNA, 18 nt, Artificial Sequence
  Description of Artificial Sequence: Synthetic oligonucleotide
ugggucguucugauggga

SEQ ID NO: 134538 - RNA, 18 nt, Artificial Sequence
  Description of Artificial Sequence: Synthetic oligonucleotide
agaugugggucguucuga

SEQ ID NO: 134539 - RNA, 18 nt, Artificial Sequence
  Description of Artificial Sequence: Synthetic oligonucleotide
cagaaagaugugggucgu

SEQ ID NO: 134540 - RNA, 18 nt, Artificial Sequence
  Description of Artificial Sequence: Synthetic oligonucleotide
acccacagaaagaugugg

SEQ ID NO: 134541 - RNA, 18 nt, Artificial Sequence
  Description of Artificial Sequence: Synthetic oligonucleotide
uucacacccacagaaaga

SEQ ID NO: 134542 - RNA, 18 nt, Artificial Sequence
  Description of Artificial Sequence: Synthetic oligonucleotide
ugacauucacacccacag

SEQ ID NO: 134543 - RNA, 18 nt, Artificial Sequence
  Description of Artificial Sequence: Synthetic oligonucleotide
ccuaaugacauucacacc

SEQ ID NO: 134544 - RNA, 18 nt, Artificial Sequence
  Description of Artificial Sequence: Synthetic oligonucleotide
caagaccuaaugacauuc

SEQ ID NO: 134545 - RNA, 18 nt, Artificial Sequence
  Description of Artificial Sequence: Synthetic oligonucleotide
cagcgcaagaccuaauga

SEQ ID NO: 134546 - RNA, 18 nt, Artificial Sequence
  Description of Artificial Sequence: Synthetic oligonucleotide
gggucagcgcaagaccua

SEQ ID NO: 134547 - RNA, 18 nt, Artificial Sequence
  Description of Artificial Sequence: Synthetic oligonucleotide
ucaggcggcagugauggg

SEQ ID NO: 134548 - RNA, 18 nt, Artificial Sequence
  Description of Artificial Sequence: Synthetic oligonucleotide
ccccaucaggcggcagug

SEQ ID NO: 134549 - RNA, 18 nt, Artificial Sequence
  Description of Artificial Sequence: Synthetic oligonucleotide
cuuugccccaucaggcgg

SEQ ID NO: 134550 - RNA, 18 nt, Artificial Sequence
  Description of Artificial Sequence: Synthetic oligonucleotide
uguuucuuugccccauca

SEQ ID NO: 134551 - RNA, 18 nt, Artificial Sequence
  Description of Artificial Sequence: Synthetic oligonucleotide
uuuuuuguuucuuugccc

SEQ ID NO: 134552 - RNA, 18 nt, Artificial Sequence
  Description of Artificial Sequence: Synthetic oligonucleotide
aaauguuuuuuguuucuu

SEQ ID NO: 134553 - RNA, 18 nt, Artificial Sequence
  Description of Artificial Sequence: Synthetic oligonucleotide
guaagaaauguuuuuugu

SEQ ID NO: 134554 - RNA, 18 nt, Artificial Sequence
  Description of Artificial Sequence: Synthetic oligonucleotide
gaagaguaagaaauguuu

SEQ ID NO: 134555 - RNA, 18 nt, Artificial Sequence
  Description of Artificial Sequence: Synthetic oligonucleotide
acacagaagaguaagaaa

SEQ ID NO: 134556 - RNA, 18 nt, Artificial Sequence
  Description of Artificial Sequence: Synthetic oligonucleotide
uuaaaacacagaagagua

SEQ ID NO: 134557 - RNA, 18 nt, Artificial Sequence
  Description of Artificial Sequence: Synthetic oligonucleotide
uuuuguuaaaacacagaa

SEQ ID NO: 134558 - RNA, 18 nt, Artificial Sequence
  Description of Artificial Sequence: Synthetic oligonucleotide
uaaacuuuuguuaaaaca

SEQ ID NO: 134559 - RNA, 18 nt, Artificial Sequence
  Description of Artificial Sequence: Synthetic oligonucleotide
uuuuauaaacuuuuguua

SEQ ID NO: 134560 - RNA, 18 nt, Artificial Sequence
  Description of Artificial Sequence: Synthetic oligonucleotide
uuuuguuuuauaaacuuu

SEQ ID NO: 134561 - RNA, 18 nt, Artificial Sequence
  Description of Artificial Sequence: Synthetic oligonucleotide
auuuauuuuguuuuauaa

SEQ ID NO: 134562 - RNA, 18 nt, Artificial Sequence
  Description of Artificial Sequence: Synthetic oligonucleotide
gcgccauuuauuuuguuu

SEQ ID NO: 134563 - RNA, 18 nt, Artificial Sequence
  Description of Artificial Sequence: Synthetic oligonucleotide
cauaugcgccauuuauuu

SEQ ID NO: 134564 - RNA, 18 nt, Artificial Sequence
  Description of Artificial Sequence: Synthetic oligonucleotide
gaaaacauaugcgccauu

SEQ ID NO: 134565 - RNA, 18 nt, Artificial Sequence
  Description of Artificial Sequence: Synthetic oligonucleotide
ucugccuuccuuucaaac

SEQ ID NO: 134566 - RNA, 18 nt, Artificial Sequence
  Description of Artificial Sequence: Synthetic oligonucleotide
cccucucugccuuccuuu

SEQ ID NO: 134567 - RNA, 18 nt, Artificial Sequence
  Description of Artificial Sequence: Synthetic oligonucleotide
cagugcccucucugccuu

SEQ ID NO: 134568 - RNA, 18 nt, Artificial Sequence
  Description of Artificial Sequence: Synthetic oligonucleotide
ccucccagugcccucucu

SEQ ID NO: 134569 - RNA, 18 nt, Artificial Sequence
  Description of Artificial Sequence: Synthetic oligonucleotide
ugccuccucccagugccc

SEQ ID NO: 134570 - RNA, 18 nt, Artificial Sequence
  Description of Artificial Sequence: Synthetic oligonucleotide
cccacugccuccucccag

SEQ ID NO: 134571 - RNA, 18 nt, Artificial Sequence
  Description of Artificial Sequence: Synthetic oligonucleotide
gcccucccacugccuccu

SEQ ID NO: 134572 - RNA, 18 nt, Artificial Sequence
  Description of Artificial Sequence: Synthetic oligonucleotide
ccuccgcccucccacugc

SEQ ID NO: 134573 - RNA, 18 nt, Artificial Sequence
  Description of Artificial Sequence: Synthetic oligonucleotide
cccgcccuccgcccuccc

SEQ ID NO: 134574 - RNA, 18 nt, Artificial Sequence
  Description of Artificial Sequence: Synthetic oligonucleotide
aggcccccgcccuccgcc

SEQ ID NO: 134575 - RNA, 18 nt, Artificial Sequence
  Description of Artificial Sequence: Synthetic oligonucleotide
cccgaaggcccccgcccu

SEQ ID NO: 134576 - RNA, 18 nt, Artificial Sequence
  Description of Artificial Sequence: Synthetic oligonucleotide
cccaccccgaaggccccc

SEQ ID NO: 134577 - RNA, 18 nt, Artificial Sequence
  Description of Artificial Sequence: Synthetic oligonucleotide
gggcgcccaccccgaagg

SEQ ID NO: 134578 - RNA, 18 nt, Artificial Sequence
  Description of Artificial Sequence: Synthetic oligonucleotide
acccugggcgcccacccc

SEQ ID NO: 134579 - RNA, 18 nt, Artificial Sequence
  Description of Artificial Sequence: Synthetic oligonucleotide
gcccuacccugggcgccc

SEQ ID NO: 134580 - RNA, 18 nt, Artificial Sequence
  Description of Artificial Sequence: Synthetic oligonucleotide
caccugcccuacccuggg

SEQ ID NO: 134581 - RNA, 18 nt, Artificial Sequence
  Description of Artificial Sequence: Synthetic oligonucleotide
gcggccaccugcccuacc

SEQ ID NO: 134582 - RNA, 18 nt, Artificial Sequence
  Description of Artificial Sequence: Synthetic oligonucleotide
acgccgcggccaccugcc

SEQ ID NO: 134583 - RNA, 18 nt, Artificial Sequence
  Description of Artificial Sequence: Synthetic oligonucleotide
ccuccacgccgcggccac

SEQ ID NO: 134584 - RNA, 18 nt, Artificial Sequence
  Description of Artificial Sequence: Synthetic oligonucleotide
cccugccuccacgccgcg

SEQ ID NO: 134585 - RNA, 18 nt, Artificial Sequence
  Description of Artificial Sequence: Synthetic oligonucleotide
auucucccugccuccacg

SEQ ID NO: 134586 - RNA, 18 nt, Artificial Sequence
  Description of Artificial Sequence: Synthetic oligonucleotide
gucgcauucucccugccu

SEQ ID NO: 134587 - RNA, 18 nt, Artificial Sequence
  Description of Artificial Sequence: Synthetic oligonucleotide
ggagagucgcauucuccc

SEQ ID NO: 134588 - RNA, 18 nt, Artificial Sequence
  Description of Artificial Sequence: Synthetic oligonucleotide
guuuuggagagucgcauu

SEQ ID NO: 134589 - RNA, 18 nt, Artificial Sequence
  Description of Artificial Sequence: Synthetic oligonucleotide
cgaggguuuuggagaguc

SEQ ID NO: 134590 - RNA, 18 nt, Artificial Sequence
  Description of Artificial Sequence: Synthetic oligonucleotide
gucgacgaggguuuugga

SEQ ID NO: 134591 - RNA, 18 nt, Artificial Sequence
  Description of Artificial Sequence: Synthetic oligonucleotide
uccaugucgacgaggguu

SEQ ID NO: 134592 - RNA, 18 nt, Artificial Sequence
  Description of Artificial Sequence: Synthetic oligonucleotide
ccauguccaugucgacga

SEQ ID NO: 134593 - RNA, 18 nt, Artificial Sequence
  Description of Artificial Sequence: Synthetic oligonucleotide
gucggccauguccauguc

SEQ ID NO: 134594 - RNA, 18 nt, Artificial Sequence
  Description of Artificial Sequence: Synthetic oligonucleotide
cuguagucggccaugucc

SEQ ID NO: 134595 - RNA, 18 nt, Artificial Sequence
  Description of Artificial Sequence: Synthetic oligonucleotide
cagcacuguagucggcca

SEQ ID NO: 134596 - RNA, 18 nt, Artificial Sequence
  Description of Artificial Sequence: Synthetic oligonucleotide
cagugcagcacuguaguc

SEQ ID NO: 134597 - RNA, 18 nt, Artificial Sequence
  Description of Artificial Sequence: Synthetic oligonucleotide
ggguccagugcagcacug

SEQ ID NO: 134598 - RNA, 18 nt, Artificial Sequence
  Description of Artificial Sequence: Synthetic oligonucleotide
aggcuggguccagugcag

SEQ ID NO: 134599 - RNA, 18 nt, Artificial Sequence
  Description of Artificial Sequence: Synthetic oligonucleotide
gguguaggcuggguccag

SEQ ID NO: 134600 - RNA, 18 nt, Artificial Sequence
  Description of Artificial Sequence: Synthetic oligonucleotide
agggugguguaggcuggg

SEQ ID NO: 134601 - RNA, 18 nt, Artificial Sequence
  Description of Artificial Sequence: Synthetic oligonucleotide
auuccagggugguguagg

SEQ ID NO: 134602 - RNA, 18 nt, Artificial Sequence
  Description of Artificial Sequence: Synthetic oligonucleotide
cucaaauuccaggguggu

SEQ ID NO: 134603 - RNA, 18 nt, Artificial Sequence
  Description of Artificial Sequence: Synthetic oligonucleotide
acauucucaaauuccagg

SEQ ID NO: 134604 - RNA, 18 nt, Artificial Sequence
  Description of Artificial Sequence: Synthetic oligonucleotide
ccugcacauucucaaauu

SEQ ID NO: 134605 - RNA, 18 nt, Artificial Sequence
  Description of Artificial Sequence: Synthetic oligonucleotide
caacaccugcacauucuc

SEQ ID NO: 134606 - RNA, 18 nt, Artificial Sequence
  Description of Artificial Sequence: Synthetic oligonucleotide
aucgucaacaccugcaca

SEQ ID NO: 134607 - RNA, 18 nt, Artificial Sequence
  Description of Artificial Sequence: Synthetic oligonucleotide
ugcccaucgucaacaccu

SEQ ID NO: 134608 - RNA, 18 nt, Artificial Sequence
  Description of Artificial Sequence: Synthetic oligonucleotide
ugggcacaucugccccca

SEQ ID NO: 134609 - RNA, 18 nt, Artificial Sequence
  Description of Artificial Sequence: Synthetic oligonucleotide
acaccugggcacaucugc

SEQ ID NO: 134610 - RNA, 18 nt, Artificial Sequence
  Description of Artificial Sequence: Synthetic oligonucleotide
cuggcacaccugggcaca

SEQ ID NO: 134611 - RNA, 18 nt, Artificial Sequence
  Description of Artificial Sequence: Synthetic oligonucleotide
ccccacuggcacaccugg

SEQ ID NO: 134612 - RNA, 18 nt, Artificial Sequence
  Description of Artificial Sequence: Synthetic oligonucleotide
ccugcccccacuggcaca

SEQ ID NO: 134613 - RNA, 18 nt, Artificial Sequence
  Description of Artificial Sequence: Synthetic oligonucleotide
gcacaccugcccccacug

SEQ ID NO: 134614 - RNA, 18 nt, Artificial Sequence
  Description of Artificial Sequence: Synthetic oligonucleotide
cccaggcacaccugcccc

SEQ ID NO: 134615 - RNA, 18 nt, Artificial Sequence
  Description of Artificial Sequence: Synthetic oligonucleotide
cuggacccaggcacaccu

SEQ ID NO: 134616 - RNA, 18 nt, Artificial Sequence
  Description of Artificial Sequence: Synthetic oligonucleotide
ugcuccuggacccaggca

SEQ ID NO: 134617 - RNA, 18 nt, Artificial Sequence
  Description of Artificial Sequence: Synthetic oligonucleotide
agaucugcuccuggaccc

SEQ ID NO: 134618 - RNA, 18 nt, Artificial Sequence
  Description of Artificial Sequence: Synthetic oligonucleotide
gccaaagaucugcuccug

SEQ ID NO: 134619 - RNA, 18 nt, Artificial Sequence
  Description of Artificial Sequence: Synthetic oligonucleotide
ugagugccaaagaucugc

SEQ ID NO: 134620 - RNA, 18 nt, Artificial Sequence
  Description of Artificial Sequence: Synthetic oligonucleotide
aaaguugagugccaaaga

SEQ ID NO: 134621 - RNA, 18 nt, Artificial Sequence
  Description of Artificial Sequence: Synthetic oligonucleotide
accccaaaguugagugcc

SEQ ID NO: 134622 - RNA, 18 nt, Artificial Sequence
  Description of Artificial Sequence: Synthetic oligonucleotide
cucccaccccaaaguuga

SEQ ID NO: 134623 - RNA, 18 nt, Artificial Sequence
  Description of Artificial Sequence: Synthetic oligonucleotide
uucuccucccaccccaaa

SEQ ID NO: 134624 - RNA, 18 nt, Artificial Sequence
  Description of Artificial Sequence: Synthetic oligonucleotide
uaucauucuccucccacc

SEQ ID NO: 134625 - RNA, 18 nt, Artificial Sequence
  Description of Artificial Sequence: Synthetic oligonucleotide
uuuuguaucauucuccuc

SEQ ID NO: 134626 - RNA, 18 nt, Artificial Sequence
  Description of Artificial Sequence: Synthetic oligonucleotide
uaccauuuuguaucauuc

SEQ ID NO: 134627 - RNA, 18 nt, Artificial Sequence
  Description of Artificial Sequence: Synthetic oligonucleotide
caaccuaccauuuuguau

SEQ ID NO: 134628 - RNA, 18 nt, Artificial Sequence
  Description of Artificial Sequence: Synthetic oligonucleotide
aggaccaaccuaccauuu

SEQ ID NO: 134629 - RNA, 18 nt, Artificial Sequence
  Description of Artificial Sequence: Synthetic oligonucleotide
ccuguaggaccaaccuac

SEQ ID NO: 134630 - RNA, 18 nt, Artificial Sequence
  Description of Artificial Sequence: Synthetic oligonucleotide
gcuggccuguaggaccaa

SEQ ID NO: 134631 - RNA, 18 nt, Artificial Sequence
  Description of Artificial Sequence: Synthetic oligonucleotide
ccugugcuggccuguagg

SEQ ID NO: 134632 - RNA, 18 nt, Artificial Sequence
  Description of Artificial Sequence: Synthetic oligonucleotide
caacaccugugcuggccu

SEQ ID NO: 134633 - RNA, 18 nt, Artificial Sequence
  Description of Artificial Sequence: Synthetic oligonucleotide
cuuggcaacaccugugcu

SEQ ID NO: 134634 - RNA, 18 nt, Artificial Sequence
  Description of Artificial Sequence: Synthetic oligonucleotide
cuucacuuggcaacaccu

SEQ ID NO: 134635 - RNA, 18 nt, Artificial Sequence
  Description of Artificial Sequence: Synthetic oligonucleotide
augggcuucacuuggcaa

SEQ ID NO: 134636 - RNA, 18 nt, Artificial Sequence
  Description of Artificial Sequence: Synthetic oligonucleotide
ggcacaugggcuucacuu

SEQ ID NO: 134637 - RNA, 18 nt, Artificial Sequence
  Description of Artificial Sequence: Synthetic oligonucleotide
gccugggcacaugggcuu

SEQ ID NO: 134638 - RNA, 18 nt, Artificial Sequence
  Description of Artificial Sequence: Synthetic oligonucleotide
acugugccugggcacaug

SEQ ID NO: 134639 - RNA, 18 nt, Artificial Sequence
  Description of Artificial Sequence: Synthetic oligonucleotide
ugaucacugugccugggc

SEQ ID NO: 134640 - RNA, 18 nt, Artificial Sequence
  Description of Artificial Sequence: Synthetic oligonucleotide
gccugugaucacugugcc

SEQ ID NO: 134641 - RNA, 18 nt, Artificial Sequence
  Description of Artificial Sequence: Synthetic oligonucleotide
agaaugccugugaucacu

SEQ ID NO: 134642 - RNA, 18 nt, Artificial Sequence
  Description of Artificial Sequence: Synthetic oligonucleotide
cacccagaaugccuguga

SEQ ID NO: 134643 - RNA, 18 nt, Artificial Sequence
  Description of Artificial Sequence: Synthetic oligonucleotide
cccuucacccagaaugcc

SEQ ID NO: 134644 - RNA, 18 nt, Artificial Sequence
  Description of Artificial Sequence: Synthetic oligonucleotide
ggccucccuucacccaga

SEQ ID NO: 134645 - RNA, 18 nt, Artificial Sequence
  Description of Artificial Sequence: Synthetic oligonucleotide
uugcaggccucccuucac

SEQ ID NO: 134646 - RNA, 18 nt, Artificial Sequence
  Description of Artificial Sequence: Synthetic oligonucleotide
ggcccuugcaggccuccc

SEQ ID NO: 134647 - RNA, 18 nt, Artificial Sequence
  Description of Artificial Sequence: Synthetic oligonucleotide
aaauuggcccuugcaggc

SEQ ID NO: 134648 - RNA, 18 nt, Artificial Sequence
  Description of Artificial Sequence: Synthetic oligonucleotide
gcuggaaauuggcccuug

SEQ ID NO: 134649 - RNA, 18 nt, Artificial Sequence
  Description of Artificial Sequence: Synthetic oligonucleotide
cuuuugcuggaaauuggc

SEQ ID NO: 134650 - RNA, 18 nt, Artificial Sequence
  Description of Artificial Sequence: Synthetic oligonucleotide
aucgacuuuugcuggaaa

SEQ ID NO: 134651 - RNA, 18 nt, Artificial Sequence
  Description of Artificial Sequence: Synthetic oligonucleotide
ccgggaucgacuuuugcu

SEQ ID NO: 134652 - RNA, 18 nt, Artificial Sequence
  Description of Artificial Sequence: Synthetic oligonucleotide
aauagccgggaucgacuu

SEQ ID NO: 134653 - RNA, 18 nt, Artificial Sequence
  Description of Artificial Sequence: Synthetic oligonucleotide
ggaggaauagccgggauc

SEQ ID NO: 134654 - RNA, 18 nt, Artificial Sequence
  Description of Artificial Sequence: Synthetic oligonucleotide
gccugggaggaauagccg

SEQ ID NO: 134655 - RNA, 18 nt, Artificial Sequence
  Description of Artificial Sequence: Synthetic oligonucleotide
gaagggccugggaggaau

SEQ ID NO: 134656 - RNA, 18 nt, Artificial Sequence
  Description of Artificial Sequence: Synthetic oligonucleotide
gacuggaagggccuggga

SEQ ID NO: 134657 - RNA, 18 nt, Artificial Sequence
  Description of Artificial Sequence: Synthetic oligonucleotide
gugaggacuggaagggcc

SEQ ID NO: 134658 - RNA, 18 nt, Artificial Sequence
  Description of Artificial Sequence: Synthetic oligonucleotide
aggcagugaggacuggaa

SEQ ID NO: 134659 - RNA, 18 nt, Artificial Sequence
  Description of Artificial Sequence: Synthetic oligonucleotide
cugugaggcagugaggac

SEQ ID NO: 134660 - RNA, 18 nt, Artificial Sequence
  Description of Artificial Sequence: Synthetic oligonucleotide
agccacugugaggcagug

SEQ ID NO: 134661 - RNA, 18 nt, Artificial Sequence
  Description of Artificial Sequence: Synthetic oligonucleotide
agcagagccacugugagg

SEQ ID NO: 134662 - RNA, 18 nt, Artificial Sequence
  Description of Artificial Sequence: Synthetic oligonucleotide
cgccaagcagagccacug

SEQ ID NO: 134663 - RNA, 18 nt, Artificial Sequence
  Description of Artificial Sequence: Synthetic oligonucleotide
ccaagcgccaagcagagc

SEQ ID NO: 134664 - RNA, 18 nt, Artificial Sequence
  Description of Artificial Sequence: Synthetic oligonucleotide
cugugccaagcgccaagc

SEQ ID NO: 134665 - RNA, 18 nt, Artificial Sequence
  Description of Artificial Sequence: Synthetic oligonucleotide
cgucacugugccaagcgc

SEQ ID NO: 134666 - RNA, 18 nt, Artificial Sequence
  Description of Artificial Sequence: Synthetic oligonucleotide
caucacgucacugugcca

SEQ ID NO: 134667 - RNA, 18 nt, Artificial Sequence
  Description of Artificial Sequence: Synthetic oligonucleotide
cucaccaucacgucacug

SEQ ID NO: 134668 - RNA, 18 nt, Artificial Sequence
  Description of Artificial Sequence: Synthetic oligonucleotide
gggagcucaccaucacgu

SEQ ID NO: 134669 - RNA, 18 nt, Artificial Sequence
  Description of Artificial Sequence: Synthetic oligonucleotide
gcuggagcugggcaccaa

SEQ ID NO: 134670 - RNA, 18 nt, Artificial Sequence
  Description of Artificial Sequence: Synthetic oligonucleotide
gaaucgcuggagcugggc

SEQ ID NO: 134671 - RNA, 18 nt, Artificial Sequence
  Description of Artificial Sequence: Synthetic oligonucleotide
gggcugaaucgcuggagc

SEQ ID NO: 134672 - RNA, 18 nt, Artificial Sequence
  Description of Artificial Sequence: Synthetic oligonucleotide
gugcugggcugaaucgcu

SEQ ID NO: 134673 - RNA, 18 nt, Artificial Sequence
  Description of Artificial Sequence: Synthetic oligonucleotide
gggccgugcugggcugaa

SEQ ID NO: 134674 - RNA, 18 nt, Artificial Sequence
  Description of Artificial Sequence: Synthetic oligonucleotide
ucugaaccuaggcccaag

SEQ ID NO: 134675 - RNA, 18 nt, Artificial Sequence
  Description of Artificial Sequence: Synthetic oligonucleotide
gucucucugaaccuaggc

SEQ ID NO: 134676 - RNA, 18 nt, Artificial Sequence
  Description of Artificial Sequence: Synthetic oligonucleotide
uugccgucucucugaacc

SEQ ID NO: 134677 - RNA, 18 nt, Artificial Sequence
  Description of Artificial Sequence: Synthetic oligonucleotide
aucccuugccgucucucu

SEQ ID NO: 134678 - RNA, 18 nt, Artificial Sequence
  Description of Artificial Sequence: Synthetic oligonucleotide
acaacaucccuugccguc

SEQ ID NO: 134679 - RNA, 18 nt, Artificial Sequence
  Description of Artificial Sequence: Synthetic oligonucleotide
gggauacaacaucccuug

SEQ ID NO: 134680 - RNA, 18 nt, Artificial Sequence
  Description of Artificial Sequence: Synthetic oligonucleotide
cuccagggauacaacauc

SEQ ID NO: 134681 - RNA, 18 nt, Artificial Sequence
  Description of Artificial Sequence: Synthetic oligonucleotide
accaucuccagggauaca

SEQ ID NO: 134682 - RNA, 18 nt, Artificial Sequence
  Description of Artificial Sequence: Synthetic oligonucleotide
caaccaccaucuccaggg

SEQ ID NO: 134683 - RNA, 18 nt, Artificial Sequence
  Description of Artificial Sequence: Synthetic oligonucleotide
gucuccaaccaccaucuc

SEQ ID NO: 134684 - RNA, 18 nt, Artificial Sequence
  Description of Artificial Sequence: Synthetic oligonucleotide
guuaugucuccaaccacc

SEQ ID NO: 134685 - RNA, 18 nt, Artificial Sequence
  Description of Artificial Sequence: Synthetic oligonucleotide
augcgguuaugucuccaa

SEQ ID NO: 134686 - RNA, 18 nt, Artificial Sequence
  Description of Artificial Sequence: Synthetic oligonucleotide
gagaaaugcgguuauguc

SEQ ID NO: 134687 - RNA, 18 nt, Artificial Sequence
  Description of Artificial Sequence: Synthetic oligonucleotide
acaccgagaaaugcgguu

SEQ ID NO: 134688 - RNA, 18 nt, Artificial Sequence
  Description of Artificial Sequence: Synthetic oligonucleotide
caaagacaccgagaaaug

SEQ ID NO: 134689 - RNA, 18 nt, Artificial Sequence
  Description of Artificial Sequence: Synthetic oligonucleotide
agucccaaagacaccgag

SEQ ID NO: 134690 - RNA, 18 nt, Artificial Sequence
  Description of Artificial Sequence: Synthetic oligonucleotide
aggaaagucccaaagaca

SEQ ID NO: 134691 - RNA, 18 nt, Artificial Sequence
  Description of Artificial Sequence: Synthetic oligonucleotide
ucccuaggaaagucccaa

SEQ ID NO: 134692 - RNA, 18 nt, Artificial Sequence
  Description of Artificial Sequence: Synthetic oligonucleotide
ucauuucccuaggaaagu

SEQ ID NO: 134693 - RNA, 18 nt, Artificial Sequence
  Description of Artificial Sequence: Synthetic oligonucleotide
caauuucauuucccuagg

SEQ ID NO: 134694 - RNA, 18 nt, Artificial Sequence
  Description of Artificial Sequence: Synthetic oligonucleotide
agugccaauuucauuucc

SEQ ID NO: 134695 - RNA, 18 nt, Artificial Sequence
  Description of Artificial Sequence: Synthetic oligonucleotide
cccuaagugccaauuuca

SEQ ID NO: 134696 - RNA, 18 nt, Artificial Sequence
  Description of Artificial Sequence: Synthetic oligonucleotide
auuuucccuaagugccaa

SEQ ID NO: 134697 - RNA, 18 nt, Artificial Sequence
  Description of Artificial Sequence: Synthetic oligonucleotide
gcuccauuuucccuaagu

SEQ ID NO: 134698 - RNA, 18 nt, Artificial Sequence
  Description of Artificial Sequence: Synthetic oligonucleotide
ugagagcuccauuuuccc

SEQ ID NO: 134699 - RNA, 18 nt, Artificial Sequence
  Description of Artificial Sequence: Synthetic oligonucleotide
uccuaggagggucuggac

SEQ ID NO: 134700 - RNA, 18 nt, Artificial Sequence
  Description of Artificial Sequence: Synthetic oligonucleotide
uggccuccuaggaggguc

SEQ ID NO: 134701 - RNA, 18 nt, Artificial Sequence
  Description of Artificial Sequence: Synthetic oligonucleotide
ucauguggccuccuagga

SEQ ID NO: 134702 - RNA, 18 nt, Artificial Sequence
  Description of Artificial Sequence: Synthetic oligonucleotide
cacacucauguggccucc

SEQ ID NO: 134703 - RNA, 18 nt, Artificial Sequence
  Description of Artificial Sequence: Synthetic oligonucleotide
acagucacacucaugugg

SEQ ID NO: 134704 - RNA, 18 nt, Artificial Sequence
  Description of Artificial Sequence: Synthetic oligonucleotide
cgagaacagucacacuca

SEQ ID NO: 134705 - RNA, 18 nt, Artificial Sequence
  Description of Artificial Sequence: Synthetic oligonucleotide
ugggccgagaacagucac

SEQ ID NO: 134706 - RNA, 18 nt, Artificial Sequence
  Description of Artificial Sequence: Synthetic oligonucleotide
agacuugggccgagaaca

SEQ ID NO: 134707 - RNA, 18 nt, Artificial Sequence
  Description of Artificial Sequence: Synthetic oligonucleotide
gagaaagacuugggccga

SEQ ID NO: 134708 - RNA, 18 nt, Artificial Sequence
  Description of Artificial Sequence: Synthetic oligonucleotide
ggaacgagaaagacuugg

SEQ ID NO: 134709 - RNA, 18 nt, Artificial Sequence
  Description of Artificial Sequence: Synthetic oligonucleotide
ucugaggaacgagaaaga

SEQ ID NO: 134710 - RNA, 18 nt, Artificial Sequence
  Description of Artificial Sequence: Synthetic oligonucleotide
aauucucugaggaacgag

SEQ ID NO: 134711 - RNA, 18 nt, Artificial Sequence
  Description of Artificial Sequence: Synthetic oligonucleotide
ccgcaaauucucugagga

SEQ ID NO: 134712 - RNA, 18 nt, Artificial Sequence
  Description of Artificial Sequence: Synthetic oligonucleotide
gggccccgcaaauucucu

SEQ ID NO: 134713 - RNA, 18 nt, Artificial Sequence
  Description of Artificial Sequence: Synthetic oligonucleotide
cagcuugugugcccaggg

SEQ ID NO: 134714 - RNA, 18 nt, Artificial Sequence
  Description of Artificial Sequence: Synthetic oligonucleotide
ucucagcuugugugccca

SEQ ID NO: 134715 - RNA, 18 nt, Artificial Sequence
  Description of Artificial Sequence: Synthetic oligonucleotide
guggaucucagcuugugu

SEQ ID NO: 134716 - RNA, 18 nt, Artificial Sequence
  Description of Artificial Sequence: Synthetic oligonucleotide
gcuggguggaucucagcu

SEQ ID NO: 134717 - RNA, 18 nt, Artificial Sequence
  Description of Artificial Sequence: Synthetic oligonucleotide
ccagggcuggguggaucu

SEQ ID NO: 134718 - RNA, 18 nt, Artificial Sequence
  Description of Artificial Sequence: Synthetic oligonucleotide
agggaccagggcugggug

SEQ ID NO: 134719 - RNA, 18 nt, Artificial Sequence
  Description of Artificial Sequence: Synthetic oligonucleotide
ugccaagggaccagggcu

SEQ ID NO: 134720 - RNA, 18 nt, Artificial Sequence
  Description of Artificial Sequence: Synthetic oligonucleotide
guucuugccaagggacca

SEQ ID NO: 134721 - RNA, 18 nt, Artificial Sequence
  Description of Artificial Sequence: Synthetic oligonucleotide
ccucaguucuugccaagg

SEQ ID NO: 134722 - RNA, 18 nt, Artificial Sequence
  Description of Artificial Sequence: Synthetic oligonucleotide
cugucccucaguucuugc

SEQ ID NO: 134723 - RNA, 18 nt, Artificial Sequence
  Description of Artificial Sequence: Synthetic oligonucleotide
agguccugucccucaguu

SEQ ID NO: 134724 - RNA, 18 nt, Artificial Sequence
  Description of Artificial Sequence: Synthetic oligonucleotide
gaaccagguccugucccu

SEQ ID NO: 134725 - RNA, 18 nt, Artificial Sequence
  Description of Artificial Sequence: Synthetic oligonucleotide
ccccagaaccagguccug

SEQ ID NO: 134726 - RNA, 18 nt, Artificial Sequence
  Description of Artificial Sequence: Synthetic oligonucleotide
auuuuccccagaaccagg

SEQ ID NO: 134727 - RNA, 18 nt, Artificial Sequence
  Description of Artificial Sequence: Synthetic oligonucleotide
ccugcauuuuccccagaa

SEQ ID NO: 134728 - RNA, 18 nt, Artificial Sequence
  Description of Artificial Sequence: Synthetic oligonucleotide
auuccccugcauuuuccc

SEQ ID NO: 134729 - RNA, 18 nt, Artificial Sequence
  Description of Artificial Sequence: Synthetic oligonucleotide
gaaacauuccccugcauu

SEQ ID NO: 134730 - RNA, 18 nt, Artificial Sequence
  Description of Artificial Sequence: Synthetic oligonucleotide
agggagaaacauuccccu

SEQ ID NO: 134731 - RNA, 18 nt, Artificial Sequence
  Description of Artificial Sequence: Synthetic oligonucleotide
guggaagggagaaacauu

SEQ ID NO: 134732 - RNA, 18 nt, Artificial Sequence
  Description of Artificial Sequence: Synthetic oligonucleotide
gggcuguggaagggagaa

SEQ ID NO: 134733 - RNA, 18 nt, Artificial Sequence
  Description of Artificial Sequence: Synthetic oligonucleotide
ccuccuaacucgcaaggg

SEQ ID NO: 134734 - RNA, 18 nt, Artificial Sequence
  Description of Artificial Sequence: Synthetic oligonucleotide
cggccuccuaacucgcaa

SEQ ID NO: 134735 - RNA, 18 nt, Artificial Sequence
  Description of Artificial Sequence: Synthetic oligonucleotide
ggagccggccuccuaacu

SEQ ID NO: 134736 - RNA, 18 nt, Artificial Sequence
  Description of Artificial Sequence: Synthetic oligonucleotide
gggugggagccggccucc

SEQ ID NO: 134737 - RNA, 18 nt, Artificial Sequence
  Description of Artificial Sequence: Synthetic oligonucleotide
accuggccaccuucuggg

SEQ ID NO: 134738 - RNA, 18 nt, Artificial Sequence
  Description of Artificial Sequence: Synthetic oligonucleotide
gaaaaccuggccaccuuc

SEQ ID NO: 134739 - RNA, 18 nt, Artificial Sequence
  Description of Artificial Sequence: Synthetic oligonucleotide
ggcaugaaaaccuggcca

SEQ ID NO: 134740 - RNA, 18 nt, Artificial Sequence
  Description of Artificial Sequence: Synthetic oligonucleotide
aggaaggcaugaaaaccu

SEQ ID NO: 134741 - RNA, 18 nt, Artificial Sequence
  Description of Artificial Sequence: Synthetic oligonucleotide
ucucuaggaaggcaugaa

SEQ ID NO: 134742 - RNA, 18 nt, Artificial Sequence
  Description of Artificial Sequence: Synthetic oligonucleotide
agcuuucucuaggaaggc

SEQ ID NO: 134743 - RNA, 18 nt, Artificial Sequence
  Description of Artificial Sequence: Synthetic oligonucleotide
gccccagcuuucucuagg

SEQ ID NO: 134744 - RNA, 18 nt, Artificial Sequence
  Description of Artificial Sequence: Synthetic oligonucleotide
cacgagccccagcuuucu

SEQ ID NO: 134745 - RNA, 18 nt, Artificial Sequence
  Description of Artificial Sequence: Synthetic oligonucleotide
gaggccacgagccccagc

SEQ ID NO: 134746 - RNA, 18 nt, Artificial Sequence
  Description of Artificial Sequence: Synthetic oligonucleotide
ugguggaggccacgagcc

SEQ ID NO: 134747 - RNA, 18 nt, Artificial Sequence
  Description of Artificial Sequence: Synthetic oligonucleotide
uccugugguggaggccac

SEQ ID NO: 134748 - RNA, 18 nt, Artificial Sequence
  Description of Artificial Sequence: Synthetic oligonucleotide
cgucuuccugugguggag

SEQ ID NO: 134749 - RNA, 18 nt, Artificial Sequence
  Description of Artificial Sequence: Synthetic oligonucleotide
gucugcgucuuccugugg

SEQ ID NO: 134750 - RNA, 18 nt, Artificial Sequence
  Description of Artificial Sequence: Synthetic oligonucleotide
ugagggucugcgucuucc

SEQ ID NO: 134751 - RNA, 18 nt, Artificial Sequence
  Description of Artificial Sequence: Synthetic oligonucleotide
guuucugagggucugcgu

SEQ ID NO: 134752 - RNA, 18 nt, Artificial Sequence
  Description of Artificial Sequence: Synthetic oligonucleotide
gacuuguuucugaggguc

SEQ ID NO: 134753 - RNA, 18 nt, Artificial Sequence
  Description of Artificial Sequence: Synthetic oligonucleotide
ucacagacuuguuucuga

SEQ ID NO: 134754 - RNA, 18 nt, Artificial Sequence
  Description of Artificial Sequence: Synthetic oligonucleotide
ugacuucacagacuuguu

SEQ ID NO: 134755 - RNA, 18 nt, Artificial Sequence
  Description of Artificial Sequence: Synthetic oligonucleotide
gguugugacuucacagac

SEQ ID NO: 134756 - RNA, 18 nt, Artificial Sequence
  Description of Artificial Sequence: Synthetic oligonucleotide
gggcugguugugacuuca

SEQ ID NO: 134757 - RNA, 18 nt, Artificial Sequence
  Description of Artificial Sequence: Synthetic oligonucleotide
ucacaucuguaaacuggg

SEQ ID NO: 134758 - RNA, 18 nt, Artificial Sequence
  Description of Artificial Sequence: Synthetic oligonucleotide
aguuucacaucuguaaac

SEQ ID NO: 134759 - RNA, 18 nt, Artificial Sequence
  Description of Artificial Sequence: Synthetic oligonucleotide
gcuucaguuucacaucug

SEQ ID NO: 134760 - RNA, 18 nt, Artificial Sequence
  Description of Artificial Sequence: Synthetic oligonucleotide
uuggagcuucaguuucac

SEQ ID NO: 134761 - RNA, 18 nt, Artificial Sequence
  Description of Artificial Sequence: Synthetic oligonucleotide
acuuuuuggagcuucagu

SEQ ID NO: 134762 - RNA, 18 nt, Artificial Sequence
  Description of Artificial Sequence: Synthetic oligonucleotide
uccugacuuuuuggagcu

SEQ ID NO: 134763 - RNA, 18 nt, Artificial Sequence
  Description of Artificial Sequence: Synthetic oligonucleotide
ugaccuccugacuuuuug

SEQ ID NO: 134764 - RNA, 18 nt, Artificial Sequence
  Description of Artificial Sequence: Synthetic oligonucleotide
cucagugaccuccugacu

SEQ ID NO: 134765 - RNA, 18 nt, Artificial Sequence
  Description of Artificial Sequence: Synthetic oligonucleotide
ccccacucagugaccucc

SEQ ID NO: 134766 - RNA, 18 nt, Artificial Sequence
  Description of Artificial Sequence: Synthetic oligonucleotide
caccuccccacucaguga

SEQ ID NO: 134767 - RNA, 18 nt, Artificial Sequence
  Description of Artificial Sequence: Synthetic oligonucleotide
uccaucaccuccccacuc

SEQ ID NO: 134768 - RNA, 18 nt, Artificial Sequence
  Description of Artificial Sequence: Synthetic oligonucleotide
cccacuccaucaccuccc

SEQ ID NO: 134769 - RNA, 18 nt, Artificial Sequence
  Description of Artificial Sequence: Synthetic oligonucleotide
cuguucccacuccaucac

SEQ ID NO: 134770 - RNA, 18 nt, Artificial Sequence
  Description of Artificial Sequence: Synthetic oligonucleotide
gccucagccagaucuggg

SEQ ID NO: 134771 - RNA, 18 nt, Artificial Sequence
  Description of Artificial Sequence: Synthetic oligonucleotide
cuucggccucagccagau

SEQ ID NO: 134772 - RNA, 18 nt, Artificial Sequence
  Description of Artificial Sequence: Synthetic oligonucleotide
cagggcuucggccucagc

SEQ ID NO: 134773 - RNA, 18 nt, Artificial Sequence
  Description of Artificial Sequence: Synthetic oligonucleotide
cucuccagggcuucggcc

SEQ ID NO: 134774 - RNA, 18 nt, Artificial Sequence
  Description of Artificial Sequence: Synthetic oligonucleotide
gggaucucuccagggcuu

SEQ ID NO: 134775 - RNA, 18 nt, Artificial Sequence
  Description of Artificial Sequence: Synthetic oligonucleotide
cuaagggagccuugcggg

SEQ ID NO: 134776 - RNA, 18 nt, Artificial Sequence
  Description of Artificial Sequence: Synthetic oligonucleotide
caucuaagggagccuugc

SEQ ID NO: 134777 - RNA, 18 nt, Artificial Sequence
  Description of Artificial Sequence: Synthetic oligonucleotide
ucaggcaucuaagggagc

SEQ ID NO: 134778 - RNA, 18 nt, Artificial Sequence
  Description of Artificial Sequence: Synthetic oligonucleotide
gaaugucaggcaucuaag

SEQ ID NO: 134779 - RNA, 18 nt, Artificial Sequence
  Description of Artificial Sequence: Synthetic oligonucleotide
gaacagaaugucaggcau

SEQ ID NO: 134780 - RNA, 18 nt, Artificial Sequence
  Description of Artificial Sequence: Synthetic oligonucleotide
aggaagaacagaauguca

SEQ ID NO: 134781 - RNA, 18 nt, Artificial Sequence
  Description of Artificial Sequence: Synthetic oligonucleotide
gcuucaggaagaacagaa

SEQ ID NO: 134782 - RNA, 18 nt, Artificial Sequence
  Description of Artificial Sequence: Synthetic oligonucleotide
gugaggcuucaggaagaa

SEQ ID NO: 134783 - RNA, 18 nt, Artificial Sequence
  Description of Artificial Sequence: Synthetic oligonucleotide
agggagugaggcuucagg

SEQ ID NO: 134784 - RNA, 18 nt, Artificial Sequence
  Description of Artificial Sequence: Synthetic oligonucleotide
gagguuggugccuucuga

SEQ ID NO: 134785 - RNA, 18 nt, Artificial Sequence
  Description of Artificial Sequence: Synthetic oligonucleotide
gcguugagguuggugccu

SEQ ID NO: 134786 - RNA, 18 nt, Artificial Sequence
  Description of Artificial Sequence: Synthetic oligonucleotide
ugggcgcguugagguugg

SEQ ID NO: 134787 - RNA, 18 nt, Artificial Sequence
  Description of Artificial Sequence: Synthetic oligonucleotide
gcuguugggcgcguugag

SEQ ID NO: 134788 - RNA, 18 nt, Artificial Sequence
  Description of Artificial Sequence: Synthetic oligonucleotide
cccaggcuguugggcgcg

SEQ ID NO: 134789 - RNA, 18 nt, Artificial Sequence
  Description of Artificial Sequence: Synthetic oligonucleotide
ugacacccaggcuguugg

SEQ ID NO: 134790 - RNA, 18 nt, Artificial Sequence
  Description of Artificial Sequence: Synthetic oligonucleotide
ggcgcugacacccaggcu

SEQ ID NO: 134791 - RNA, 18 nt, Artificial Sequence
  Description of Artificial Sequence: Synthetic oligonucleotide
cacagggcgcugacaccc

SEQ ID NO: 134792 - RNA, 18 nt, Artificial Sequence
  Description of Artificial Sequence: Synthetic oligonucleotide
uggcacacagggcgcuga

SEQ ID NO: 134793 - RNA, 18 nt, Artificial Sequence
  Description of Artificial Sequence: Synthetic oligonucleotide
gcagauggcacacagggc

SEQ ID NO: 134794 - RNA, 18 nt, Artificial Sequence
  Description of Artificial Sequence: Synthetic oligonucleotide
uccccgcagauggcacac

SEQ ID NO: 134795 - RNA, 18 nt, Artificial Sequence
  Description of Artificial Sequence: Synthetic oligonucleotide
cccgguccccgcagaugg

SEQ ID NO: 134796 - RNA, 18 nt, Artificial Sequence
  Description of Artificial Sequence: Synthetic oligonucleotide
cguggcccgguccccgca

SEQ ID NO: 134797 - RNA, 18 nt, Artificial Sequence
  Description of Artificial Sequence: Synthetic oligonucleotide
uugcccguggcccggucc

SEQ ID NO: 134798 - RNA, 18 nt, Artificial Sequence
  Description of Artificial Sequence: Synthetic oligonucleotide
aguguuugcccguggccc

SEQ ID NO: 134799 - RNA, 18 nt, Artificial Sequence
  Description of Artificial Sequence: Synthetic oligonucleotide
accguaguguuugcccgu

SEQ ID NO: 134800 - RNA, 18 nt, Artificial Sequence
  Description of Artificial Sequence: Synthetic oligonucleotide
gaggcaccguaguguuug

SEQ ID NO: 134801 - RNA, 18 nt, Artificial Sequence
  Description of Artificial Sequence: Synthetic oligonucleotide
agcucgaggcaccguagu

SEQ ID NO: 134802 - RNA, 18 nt, Artificial Sequence
  Description of Artificial Sequence: Synthetic oligonucleotide
gucacagcucgaggcacc

SEQ ID NO: 134803 - RNA, 18 nt, Artificial Sequence
  Description of Artificial Sequence: Synthetic oligonucleotide
cagccgucacagcucgag

SEQ ID NO: 134804 - RNA, 18 nt, Artificial Sequence
  Description of Artificial Sequence: Synthetic oligonucleotide
ccuugcagccgucacagc

SEQ ID NO: 134805 - RNA, 18 nt, Artificial Sequence
  Description of Artificial Sequence: Synthetic oligonucleotide
gaagcccuugcagccguc

SEQ ID NO: 134806 - RNA, 18 nt, Artificial Sequence
  Description of Artificial Sequence: Synthetic oligonucleotide
cggaagaagcccuugcag

SEQ ID NO: 134807 - RNA, 18 nt, Artificial Sequence
  Description of Artificial Sequence: Synthetic oligonucleotide
uccuccggaagaagcccu

SEQ ID NO: 134808 - RNA, 18 nt, Artificial Sequence
  Description of Artificial Sequence: Synthetic oligonucleotide
cacgcuccuccggaagaa

SEQ ID NO: 134809 - RNA, 18 nt, Artificial Sequence
  Description of Artificial Sequence: Synthetic oligonucleotide
uuccgcacgcuccuccgg

SEQ ID NO: 134810 - RNA, 18 nt, Artificial Sequence
  Description of Artificial Sequence: Synthetic oligonucleotide
gguucuuccgcacgcucc

SEQ ID NO: 134811 - RNA, 18 nt, Artificial Sequence
  Description of Artificial Sequence: Synthetic oligonucleotide
caugugguucuuccgcac

SEQ ID NO: 134812 - RNA, 18 nt, Artificial Sequence
  Description of Artificial Sequence: Synthetic oligonucleotide
gaguacaugugguucuuc

SEQ ID NO: 134813 - RNA, 18 nt, Artificial Sequence
  Description of Artificial Sequence: Synthetic oligonucleotide
ugcaggaguacauguggu

SEQ ID NO: 134814 - RNA, 18 nt, Artificial Sequence
  Description of Artificial Sequence: Synthetic oligonucleotide
uuggugccuucugauggg

SEQ ID NO: 134815 - RNA, 18 nt, Artificial Sequence
  Description of Artificial Sequence: Synthetic oligonucleotide
gguuggugccuucugaug

SEQ ID NO: 134816 - RNA, 18 nt, Artificial Sequence
  Description of Artificial Sequence: Synthetic oligonucleotide
guugagguuggugccuuc

SEQ ID NO: 134817 - RNA, 18 nt, Artificial Sequence
  Description of Artificial Sequence: Synthetic oligonucleotide
ggcgcguugagguuggug

SEQ ID NO: 134818 - RNA, 18 nt, Artificial Sequence
  Description of Artificial Sequence: Synthetic oligonucleotide
uguugggcgcguugaggu

SEQ ID NO: 134819 - RNA, 18 nt, Artificial Sequence
  Description of Artificial Sequence: Synthetic oligonucleotide
caggcuguugggcgcguu

SEQ ID NO: 134820 - RNA, 18 nt, Artificial Sequence
  Description of Artificial Sequence: Synthetic oligonucleotide
acacccaggcuguugggc

SEQ ID NO: 134821 - RNA, 18 nt, Artificial Sequence
  Description of Artificial Sequence: Synthetic oligonucleotide
cgcugacacccaggcugu

SEQ ID NO: 134822 - RNA, 18 nt, Artificial Sequence
  Description of Artificial Sequence: Synthetic oligonucleotide
cagggcgcugacacccag

SEQ ID NO: 134823 - RNA, 18 nt, Artificial Sequence
  Description of Artificial Sequence: Synthetic oligonucleotide
gcacacagggcgcugaca

SEQ ID NO: 134824 - RNA, 18 nt, Artificial Sequence
  Description of Artificial Sequence: Synthetic oligonucleotide
agauggcacacagggcgc

SEQ ID NO: 134825 - RNA, 18 nt, Artificial Sequence
  Description of Artificial Sequence: Synthetic oligonucleotide
cccgcagauggcacacag

SEQ ID NO: 134826 - RNA, 18 nt, Artificial Sequence
  Description of Artificial Sequence: Synthetic oligonucleotide
cgguccccgcagauggca

SEQ ID NO: 134827 - RNA, 18 nt, Artificial Sequence
  Description of Artificial Sequence: Synthetic oligonucleotide
uggcccgguccccgcaga

SEQ ID NO: 134828 - RNA, 18 nt, Artificial Sequence
  Description of Artificial Sequence: Synthetic oligonucleotide
gcccguggcccggucccc

SEQ ID NO: 134829 - RNA, 18 nt, Artificial Sequence
  Description of Artificial Sequence: Synthetic oligonucleotide
uguuugcccguggcccgg

SEQ ID NO: 134830 - RNA, 18 nt, Artificial Sequence
  Description of Artificial Sequence: Synthetic oligonucleotide
cguaguguuugcccgugg

SEQ ID NO: 134831 - RNA, 18 nt, Artificial Sequence
  Description of Artificial Sequence: Synthetic oligonucleotide
ggcaccguaguguuugcc

SEQ ID NO: 134832 - RNA, 18 nt, Artificial Sequence
  Description of Artificial Sequence: Synthetic oligonucleotide
cucgaggcaccguagugu

SEQ ID NO: 134833 - RNA, 18 nt, Artificial Sequence
  Description of Artificial Sequence: Synthetic oligonucleotide
cacagcucgaggcaccgu

SEQ ID NO: 134834 - RNA, 18 nt, Artificial Sequence
  Description of Artificial Sequence: Synthetic oligonucleotide
gccgucacagcucgaggc

SEQ ID NO: 134835 - RNA, 18 nt, Artificial Sequence
  Description of Artificial Sequence: Synthetic oligonucleotide
uugcagccgucacagcuc

SEQ ID NO: 134836 - RNA, 18 nt, Artificial Sequence
  Description of Artificial Sequence: Synthetic oligonucleotide
agcccuugcagccgucac

SEQ ID NO: 134837 - RNA, 18 nt, Artificial Sequence
  Description of Artificial Sequence: Synthetic oligonucleotide
gaagaagcccuugcagcc

SEQ ID NO: 134838 - RNA, 18 nt, Artificial Sequence
  Description of Artificial Sequence: Synthetic oligonucleotide
cuccggaagaagcccuug

SEQ ID NO: 134839 - RNA, 18 nt, Artificial Sequence
  Description of Artificial Sequence: Synthetic oligonucleotide
cgcuccuccggaagaagc

SEQ ID NO: 134840 - RNA, 18 nt, Artificial Sequence
  Description of Artificial Sequence: Synthetic oligonucleotide
ccgcacgcuccuccggaa

SEQ ID NO: 134841 - RNA, 18 nt, Artificial Sequence
  Description of Artificial Sequence: Synthetic oligonucleotide
uucuuccgcacgcuccuc

SEQ ID NO: 134842 - RNA, 18 nt, Artificial Sequence
  Description of Artificial Sequence: Synthetic oligonucleotide
ugugguucuuccgcacgc

SEQ ID NO: 134843 - RNA, 18 nt, Artificial Sequence
  Description of Artificial Sequence: Synthetic oligonucleotide
guacaugugguucuuccg

SEQ ID NO: 134844 - RNA, 18 nt, Artificial Sequence
  Description of Artificial Sequence: Synthetic oligonucleotide
caggaguacaugugguuc

SEQ ID NO: 134845 - RNA, 18 nt, Artificial Sequence
  Description of Artificial Sequence: Synthetic oligonucleotide
cugaagaaauugaggcuc

SEQ ID NO: 134846 - RNA, 18 nt, Artificial Sequence
  Description of Artificial Sequence: Synthetic oligonucleotide
cccagcugaagaaauuga

SEQ ID NO: 134847 - RNA, 18 nt, Artificial Sequence
  Description of Artificial Sequence: Synthetic oligonucleotide
cauuucccagcugaagaa

SEQ ID NO: 134848 - RNA, 18 nt, Artificial Sequence
  Description of Artificial Sequence: Synthetic oligonucleotide
gugcccauuucccagcug

SEQ ID NO: 134849 - RNA, 18 nt, Artificial Sequence
  Description of Artificial Sequence: Synthetic oligonucleotide
caagugugcccauuuccc

SEQ ID NO: 134850 - RNA, 18 nt, Artificial Sequence
  Description of Artificial Sequence: Synthetic oligonucleotide
gagcccaagugugcccau

SEQ ID NO: 134851 - RNA, 18 nt, Artificial Sequence
  Description of Artificial Sequence: Synthetic oligonucleotide
gccaugagcccaagugug

SEQ ID NO: 134852 - RNA, 18 nt, Artificial Sequence
  Description of Artificial Sequence: Synthetic oligonucleotide
gggccaugagcccaagug

SEQ ID NO: 134853 - RNA, 18 nt, Artificial Sequence
  Description of Artificial Sequence: Synthetic oligonucleotide
gagaagacagaccuuggg

SEQ ID NO: 134854 - RNA, 18 nt, Artificial Sequence
  Description of Artificial Sequence: Synthetic oligonucleotide
ucagggagaagacagacc

SEQ ID NO: 134855 - RNA, 18 nt, Artificial Sequence
  Description of Artificial Sequence: Synthetic oligonucleotide
cccacucagggagaagac

SEQ ID NO: 134856 - RNA, 18 nt, Artificial Sequence
  Description of Artificial Sequence: Synthetic oligonucleotide
accuacccacucagggag

SEQ ID NO: 134857 - RNA, 18 nt, Artificial Sequence
  Description of Artificial Sequence: Synthetic oligonucleotide
cugggaccuacccacuca

SEQ ID NO: 134858 - RNA, 18 nt, Artificial Sequence
  Description of Artificial Sequence: Synthetic oligonucleotide
ugucucugggaccuaccc

SEQ ID NO: 134859 - RNA, 18 nt, Artificial Sequence
  Description of Artificial Sequence: Synthetic oligonucleotide
gcagcugucucugggacc

SEQ ID NO: 134860 - RNA, 18 nt, Artificial Sequence
  Description of Artificial Sequence: Synthetic oligonucleotide
gaagggcagcugucucug

SEQ ID NO: 134861 - RNA, 18 nt, Artificial Sequence
  Description of Artificial Sequence: Synthetic oligonucleotide
gcccugaagggcagcugu

SEQ ID NO: 134862 - RNA, 18 nt, Artificial Sequence
  Description of Artificial Sequence: Synthetic oligonucleotide
ugaaggcccugaagggca

SEQ ID NO: 134863 - RNA, 18 nt, Artificial Sequence
  Description of Artificial Sequence: Synthetic oligonucleotide
agccuugaaggcccugaa

SEQ ID NO: 134864 - RNA, 18 nt, Artificial Sequence
  Description of Artificial Sequence: Synthetic oligonucleotide
agaagagccuugaaggcc

SEQ ID NO: 134865 - RNA, 18 nt, Artificial Sequence
  Description of Artificial Sequence: Synthetic oligonucleotide
aaaccagaagagccuuga

SEQ ID NO: 134866 - RNA, 18 nt, Artificial Sequence
  Description of Artificial Sequence: Synthetic oligonucleotide
uuacaaaaccagaagagc

SEQ ID NO: 134867 - RNA, 18 nt, Artificial Sequence
  Description of Artificial Sequence: Synthetic oligonucleotide
gucuuuuacaaaaccaga

SEQ ID NO: 134868 - RNA, 18 nt, Artificial Sequence
  Description of Artificial Sequence: Synthetic oligonucleotide
acaaagucuuuuacaaaa

SEQ ID NO: 134869 - RNA, 18 nt, Artificial Sequence
  Description of Artificial Sequence: Synthetic oligonucleotide
gauucacaaagucuuuua

SEQ ID NO: 134870 - RNA, 18 nt, Artificial Sequence
  Description of Artificial Sequence: Synthetic oligonucleotide
ucuuggauucacaaaguc

SEQ ID NO: 134871 - RNA, 18 nt, Artificial Sequence
  Description of Artificial Sequence: Synthetic oligonucleotide
gcucuucuuggauucaca

SEQ ID NO: 134872 - RNA, 18 nt, Artificial Sequence
  Description of Artificial Sequence: Synthetic oligonucleotide
uagaugcucuucuuggau

SEQ ID NO: 134873 - RNA, 18 nt, Artificial Sequence
  Description of Artificial Sequence: Synthetic oligonucleotide
uagaauagaugcucuucu

SEQ ID NO: 134874 - RNA, 18 nt, Artificial Sequence
  Description of Artificial Sequence: Synthetic oligonucleotide
guuccuagaauagaugcu

SEQ ID NO: 134875 - RNA, 18 nt, Artificial Sequence
  Description of Artificial Sequence: Synthetic oligonucleotide
augugguuccuagaauag

SEQ ID NO: 134876 - RNA, 18 nt, Artificial Sequence
  Description of Artificial Sequence: Synthetic oligonucleotide
aguaaaugugguuccuag

SEQ ID NO: 134877 - RNA, 18 nt, Artificial Sequence
  Description of Artificial Sequence: Synthetic oligonucleotide
ugaucaguaaaugugguu

SEQ ID NO: 134878 - RNA, 18 nt, Artificial Sequence
  Description of Artificial Sequence: Synthetic oligonucleotide
cuugaugaucaguaaaug

SEQ ID NO: 134879 - RNA, 18 nt, Artificial Sequence
  Description of Artificial Sequence: Synthetic oligonucleotide
aguagcuugaugaucagu

SEQ ID NO: 134880 - RNA, 18 nt, Artificial Sequence
  Description of Artificial Sequence: Synthetic oligonucleotide
cagccaguagcuugauga

SEQ ID NO: 134881 - RNA, 18 nt, Artificial Sequence
  Description of Artificial Sequence: Synthetic oligonucleotide
aacggcagccaguagcuu

SEQ ID NO: 134882 - RNA, 18 nt, Artificial Sequence
  Description of Artificial Sequence: Synthetic oligonucleotide
caauaaacggcagccagu

SEQ ID NO: 134883 - RNA, 18 nt, Artificial Sequence
  Description of Artificial Sequence: Synthetic oligonucleotide
gagcucaauaaacggcag

SEQ ID NO: 134884 - RNA, 18 nt, Artificial Sequence
  Description of Artificial Sequence: Synthetic oligonucleotide
gauaagagcucaauaaac

SEQ ID NO: 134885 - RNA, 18 nt, Artificial Sequence
  Description of Artificial Sequence: Synthetic oligonucleotide
cauaugauaagagcucaa

SEQ ID NO: 134886 - RNA, 18 nt, Artificial Sequence
  Description of Artificial Sequence: Synthetic oligonucleotide
ccuggcauaugauaagag

SEQ ID NO: 134887 - RNA, 18 nt, Artificial Sequence
  Description of Artificial Sequence: Synthetic oligonucleotide
uugugccuggcauaugau

SEQ ID NO: 134888 - RNA, 18 nt, Artificial Sequence
  Description of Artificial Sequence: Synthetic oligonucleotide
uaguauugugccuggcau

SEQ ID NO: 134889 - RNA, 18 nt, Artificial Sequence
  Description of Artificial Sequence: Synthetic oligonucleotide
agacuuaguauugugccu

SEQ ID NO: 134890 - RNA, 18 nt, Artificial Sequence
  Description of Artificial Sequence: Synthetic oligonucleotide
cacaaagacuuaguauug

SEQ ID NO: 134891 - RNA, 18 nt, Artificial Sequence
  Description of Artificial Sequence: Synthetic oligonucleotide
auacacacaaagacuuag

SEQ ID NO: 134892 - RNA, 18 nt, Artificial Sequence
  Description of Artificial Sequence: Synthetic oligonucleotide
gguaaauacacacaaaga

SEQ ID NO: 134893 - RNA, 18 nt, Artificial Sequence
  Description of Artificial Sequence: Synthetic oligonucleotide
ggauggguaaauacacac

SEQ ID NO: 134894 - RNA, 18 nt, Artificial Sequence
  Description of Artificial Sequence: Synthetic oligonucleotide
gggauggguaaauacaca

SEQ ID NO: 134895 - RNA, 18 nt, Artificial Sequence
  Description of Artificial Sequence: Synthetic oligonucleotide
caacaaugggcucaaggg

SEQ ID NO: 134896 - RNA, 18 nt, Artificial Sequence
  Description of Artificial Sequence: Synthetic oligonucleotide
aaaaacaacaaugggcuc

SEQ ID NO: 134897 - RNA, 18 nt, Artificial Sequence
  Description of Artificial Sequence: Synthetic oligonucleotide
augggaaaaacaacaaug

SEQ ID NO: 134898 - RNA, 18 nt, Artificial Sequence
  Description of Artificial Sequence: Synthetic oligonucleotide
auggaaugggaaaaacaa

SEQ ID NO: 134899 - RNA, 18 nt, Artificial Sequence
  Description of Artificial Sequence: Synthetic oligonucleotide
gccccauggaaugggaaa

SEQ ID NO: 134900 - RNA, 18 nt, Artificial Sequence
  Description of Artificial Sequence: Synthetic oligonucleotide
gagaggccccauggaaug

SEQ ID NO: 134901 - RNA, 18 nt, Artificial Sequence
  Description of Artificial Sequence: Synthetic oligonucleotide
uucaggagaggccccaug

SEQ ID NO: 134902 - RNA, 18 nt, Artificial Sequence
  Description of Artificial Sequence: Synthetic oligonucleotide
gaggcuucaggagaggcc

SEQ ID NO: 134903 - RNA, 18 nt, Artificial Sequence
  Description of Artificial Sequence: Synthetic oligonucleotide
cuacugaggcuucaggag

SEQ ID NO: 134904 - RNA, 18 nt, Artificial Sequence
  Description of Artificial Sequence: Synthetic oligonucleotide
cucaucuacugaggcuuc

SEQ ID NO: 134905 - RNA, 18 nt, Artificial Sequence
  Description of Artificial Sequence: Synthetic oligonucleotide
acgggcucaucuacugag

SEQ ID NO: 134906 - RNA, 18 nt, Artificial Sequence
  Description of Artificial Sequence: Synthetic oligonucleotide
ggaagacgggcucaucua

SEQ ID NO: 134907 - RNA, 18 nt, Artificial Sequence
  Description of Artificial Sequence: Synthetic oligonucleotide
agacuggaagacgggcuc

SEQ ID NO: 134908 - RNA, 18 nt, Artificial Sequence
  Description of Artificial Sequence: Synthetic oligonucleotide
gcaccagacuggaagacg

SEQ ID NO: 134909 - RNA, 18 nt, Artificial Sequence
  Description of Artificial Sequence: Synthetic oligonucleotide
aaacagcaccagacugga

SEQ ID NO: 134910 - RNA, 18 nt, Artificial Sequence
  Description of Artificial Sequence: Synthetic oligonucleotide
cccaaaaacagcaccaga

SEQ ID NO: 134911 - RNA, 18 nt, Artificial Sequence
  Description of Artificial Sequence: Synthetic oligonucleotide
uuugucccaaaaacagca

SEQ ID NO: 134912 - RNA, 18 nt, Artificial Sequence
  Description of Artificial Sequence: Synthetic oligonucleotide
uccuauuugucccaaaaa

SEQ ID NO: 134913 - RNA, 18 nt, Artificial Sequence
  Description of Artificial Sequence: Synthetic oligonucleotide
caaucuccuauuuguccc

SEQ ID NO: 134914 - RNA, 18 nt, Artificial Sequence
  Description of Artificial Sequence: Synthetic oligonucleotide
gggucaaucuccuauuug

SEQ ID NO: 134915 - RNA, 18 nt, Artificial Sequence
  Description of Artificial Sequence: Synthetic oligonucleotide
uagguggaacggccuggg

SEQ ID NO: 134916 - RNA, 18 nt, Artificial Sequence
  Description of Artificial Sequence: Synthetic oligonucleotide
ggguagguggaacggccu

SEQ ID NO: 134917 - RNA, 18 nt, Artificial Sequence
  Description of Artificial Sequence: Synthetic oligonucleotide
uugguggaagccccuggg

SEQ ID NO: 134918 - RNA, 18 nt, Artificial Sequence
  Description of Artificial Sequence: Synthetic oligonucleotide
ggguugguggaagccccu

SEQ ID NO: 134919 - RNA, 18 nt, Artificial Sequence
  Description of Artificial Sequence: Synthetic oligonucleotide
ccuugggaagacuuuggg

SEQ ID NO: 134920 - RNA, 18 nt, Artificial Sequence
  Description of Artificial Sequence: Synthetic oligonucleotide
caaggccuugggaagacu

SEQ ID NO: 134921 - RNA, 18 nt, Artificial Sequence
  Description of Artificial Sequence: Synthetic oligonucleotide
cucuccaaggccuuggga

SEQ ID NO: 134922 - RNA, 18 nt, Artificial Sequence
  Description of Artificial Sequence: Synthetic oligonucleotide
gagggcucuccaaggccu

SEQ ID NO: 134923 - RNA, 18 nt, Artificial Sequence
  Description of Artificial Sequence: Synthetic oligonucleotide
cgaaagagggcucuccaa

SEQ ID NO: 134924 - RNA, 18 nt, Artificial Sequence
  Description of Artificial Sequence: Synthetic oligonucleotide
gcuuucgaaagagggcuc

SEQ ID NO: 134925 - RNA, 18 nt, Artificial Sequence
  Description of Artificial Sequence: Synthetic oligonucleotide
gagaugcuuucgaaagag

SEQ ID NO: 134926 - RNA, 18 nt, Artificial Sequence
  Description of Artificial Sequence: Synthetic oligonucleotide
aacaggagaugcuuucga

SEQ ID NO: 134927 - RNA, 18 nt, Artificial Sequence
  Description of Artificial Sequence: Synthetic oligonucleotide
cccagaacaggagaugcu

SEQ ID NO: 134928 - RNA, 18 nt, Artificial Sequence
  Description of Artificial Sequence: Synthetic oligonucleotide
cauuacccagaacaggag

SEQ ID NO: 134929 - RNA, 18 nt, Artificial Sequence
  Description of Artificial Sequence: Synthetic oligonucleotide
auugucauuacccagaac

SEQ ID NO: 134930 - RNA, 18 nt, Artificial Sequence
  Description of Artificial Sequence: Synthetic oligonucleotide
uuauuauugucauuaccc

SEQ ID NO: 134931 - RNA, 18 nt, Artificial Sequence
  Description of Artificial Sequence: Synthetic oligonucleotide
ugauuuuauuauugucau

SEQ ID NO: 134932 - RNA, 18 nt, Artificial Sequence
  Description of Artificial Sequence: Synthetic oligonucleotide
ugcuaugauuuuauuauu

SEQ ID NO: 134933 - RNA, 18 nt, Artificial Sequence
  Description of Artificial Sequence: Synthetic oligonucleotide
acagcugcuaugauuuua

SEQ ID NO: 134934 - RNA, 18 nt, Artificial Sequence
  Description of Artificial Sequence: Synthetic oligonucleotide
aauugacagcugcuauga

SEQ ID NO: 134935 - RNA, 18 nt, Artificial Sequence
  Description of Artificial Sequence: Synthetic oligonucleotide
cucgcaauugacagcugc

SEQ ID NO: 134936 - RNA, 18 nt, Artificial Sequence
  Description of Artificial Sequence: Synthetic oligonucleotide
caaaugccuagcccucca

SEQ ID NO: 134937 - RNA, 18 nt, Artificial Sequence
  Description of Artificial Sequence: Synthetic oligonucleotide
uugggcaaaugccuagcc

SEQ ID NO: 134938 - RNA, 18 nt, Artificial Sequence
  Description of Artificial Sequence: Synthetic oligonucleotide
ugaccuugggcaaaugcc

SEQ ID NO: 134939 - RNA, 18 nt, Artificial Sequence
  Description of Artificial Sequence: Synthetic oligonucleotide
cugguugaccuugggcaa

SEQ ID NO: 134940 - RNA, 18 nt, Artificial Sequence
  Description of Artificial Sequence: Synthetic oligonucleotide
ucaagcugguugaccuug

SEQ ID NO: 134941 - RNA, 18 nt, Artificial Sequence
  Description of Artificial Sequence: Synthetic oligonucleotide
gugauucaagcugguuga

SEQ ID NO: 134942 - RNA, 18 nt, Artificial Sequence
  Description of Artificial Sequence: Synthetic oligonucleotide
ugccagugauucaagcug

SEQ ID NO: 134943 - RNA, 18 nt, Artificial Sequence
  Description of Artificial Sequence: Synthetic oligonucleotide
ggcucugccagugauuca

SEQ ID NO: 134944 - RNA, 18 nt, Artificial Sequence
  Description of Artificial Sequence: Synthetic oligonucleotide
acccuggcucugccagug

SEQ ID NO: 134945 - RNA, 18 nt, Artificial Sequence
  Description of Artificial Sequence: Synthetic oligonucleotide
uguuaacccuggcucugc

SEQ ID NO: 134946 - RNA, 18 nt, Artificial Sequence
  Description of Artificial Sequence: Synthetic oligonucleotide
cugaauguuaacccuggc

SEQ ID NO: 134947 - RNA, 18 nt, Artificial Sequence
  Description of Artificial Sequence: Synthetic oligonucleotide
gggcccugaauguuaacc

SEQ ID NO: 134948 - RNA, 18 nt, Artificial Sequence
  Description of Artificial Sequence: Synthetic oligonucleotide
accguggugauggguggg

SEQ ID NO: 134949 - RNA, 18 nt, Artificial Sequence
  Description of Artificial Sequence: Synthetic oligonucleotide
caccguggugaugggugg

SEQ ID NO: 134950 - RNA, 18 nt, Artificial Sequence
  Description of Artificial Sequence: Synthetic oligonucleotide
ugccacaccguggugaug

SEQ ID NO: 134951 - RNA, 18 nt, Artificial Sequence
  Description of Artificial Sequence: Synthetic oligonucleotide
ggcagugccacaccgugg

SEQ ID NO: 134952 - RNA, 18 nt, Artificial Sequence
  Description of Artificial Sequence: Synthetic oligonucleotide
guagaggcagugccacac

SEQ ID NO: 134953 - RNA, 18 nt, Artificial Sequence
  Description of Artificial Sequence: Synthetic oligonucleotide
aggaaguagaggcagugc

SEQ ID NO: 134954 - RNA, 18 nt, Artificial Sequence
  Description of Artificial Sequence: Synthetic oligonucleotide
gggauaggaaguagaggc

SEQ ID NO: 134955 - RNA, 18 nt, Artificial Sequence
  Description of Artificial Sequence: Synthetic oligonucleotide
aagccucucucuggaggg

SEQ ID NO: 134956 - RNA, 18 nt, Artificial Sequence
  Description of Artificial Sequence: Synthetic oligonucleotide
cauaagccucucucugga

SEQ ID NO: 134957 - RNA, 18 nt, Artificial Sequence
  Description of Artificial Sequence: Synthetic oligonucleotide
guucacauaagccucucu

SEQ ID NO: 134958 - RNA, 18 nt, Artificial Sequence
  Description of Artificial Sequence: Synthetic oligonucleotide
acucgguucacauaagcc

SEQ ID NO: 134959 - RNA, 18 nt, Artificial Sequence
  Description of Artificial Sequence: Synthetic oligonucleotide
uuaauacucgguucacau

SEQ ID NO: 134960 - RNA, 18 nt, Artificial Sequence
  Description of Artificial Sequence: Synthetic oligonucleotide
cagaguuaauacucgguu

SEQ ID NO: 134961 - RNA, 18 nt, Artificial Sequence
  Description of Artificial Sequence: Synthetic oligonucleotide
uggcucagaguuaauacu

SEQ ID NO: 134962 - RNA, 18 nt, Artificial Sequence
  Description of Artificial Sequence: Synthetic oligonucleotide
gguuauggcucagaguua

SEQ ID NO: 134963 - RNA, 18 nt, Artificial Sequence
  Description of Artificial Sequence: Synthetic oligonucleotide
cuccugguuauggcucag

SEQ ID NO: 134964 - RNA, 18 nt, Artificial Sequence
  Description of Artificial Sequence: Synthetic oligonucleotide
gcaggcuccugguuaugg

SEQ ID NO: 134965 - RNA, 18 nt, Artificial Sequence
  Description of Artificial Sequence: Synthetic oligonucleotide
ccauagcaggcuccuggu

SEQ ID NO: 134966 - RNA, 18 nt, Artificial Sequence
  Description of Artificial Sequence: Synthetic oligonucleotide
agaacccauagcaggcuc

SEQ ID NO: 134967 - RNA, 18 nt, Artificial Sequence
  Description of Artificial Sequence: Synthetic oligonucleotide
agcucagaacccauagca

SEQ ID NO: 134968 - RNA, 18 nt, Artificial Sequence
  Description of Artificial Sequence: Synthetic oligonucleotide
auaaaagcucagaaccca

SEQ ID NO: 134969 - RNA, 18 nt, Artificial Sequence
  Description of Artificial Sequence: Synthetic oligonucleotide
auccuauaaaagcucaga

SEQ ID NO: 134970 - RNA, 18 nt, Artificial Sequence
  Description of Artificial Sequence: Synthetic oligonucleotide
accacauccuauaaaagc

SEQ ID NO: 134971 - RNA, 18 nt, Artificial Sequence
  Description of Artificial Sequence: Synthetic oligonucleotide
uuuccaccacauccuaua

SEQ ID NO: 134972 - RNA, 18 nt, Artificial Sequence
  Description of Artificial Sequence: Synthetic oligonucleotide
ugcuauuuccaccacauc

SEQ ID NO: 134973 - RNA, 18 nt, Artificial Sequence
  Description of Artificial Sequence: Synthetic oligonucleotide
agcccugcuauuuccacc

SEQ ID NO: 134974 - RNA, 18 nt, Artificial Sequence
  Description of Artificial Sequence: Synthetic oligonucleotide
accagagcccugcuauuu

SEQ ID NO: 134975 - RNA, 18 nt, Artificial Sequence
  Description of Artificial Sequence: Synthetic oligonucleotide
ggaguaccagagcccugc

SEQ ID NO: 134976 - RNA, 18 nt, Artificial Sequence
  Description of Artificial Sequence: Synthetic oligonucleotide
ccucuggaguaccagagc

SEQ ID NO: 134977 - RNA, 18 nt, Artificial Sequence
  Description of Artificial Sequence: Synthetic oligonucleotide
cuugaccucuggaguacc

SEQ ID NO: 134978 - RNA, 18 nt, Artificial Sequence
  Description of Artificial Sequence: Synthetic oligonucleotide
ggaaccuugaccucugga

SEQ ID NO: 134979 - RNA, 18 nt, Artificial Sequence
  Description of Artificial Sequence: Synthetic oligonucleotide
aguugggaaccuugaccu

SEQ ID NO: 134980 - RNA, 18 nt, Artificial Sequence
  Description of Artificial Sequence: Synthetic oligonucleotide
agcugaguugggaaccuu

SEQ ID NO: 134981 - RNA, 18 nt, Artificial Sequence
  Description of Artificial Sequence: Synthetic oligonucleotide
guuagagcugaguuggga

SEQ ID NO: 134982 - RNA, 18 nt, Artificial Sequence
  Description of Artificial Sequence: Synthetic oligonucleotide
uugguguuagagcugagu

SEQ ID NO: 134983 - RNA, 18 nt, Artificial Sequence
  Description of Artificial Sequence: Synthetic oligonucleotide
gcugguugguguuagagc

SEQ ID NO: 134984 - RNA, 18 nt, Artificial Sequence
  Description of Artificial Sequence: Synthetic oligonucleotide
gcucugcugguugguguu

SEQ ID NO: 134985 - RNA, 18 nt, Artificial Sequence
  Description of Artificial Sequence: Synthetic oligonucleotide
gggucgcucugcugguug

SEQ ID NO: 134986 - RNA, 18 nt, Artificial Sequence
  Description of Artificial Sequence: Synthetic oligonucleotide
guccugggucgcucugcu

SEQ ID NO: 134987 - RNA, 18 nt, Artificial Sequence
  Description of Artificial Sequence: Synthetic oligonucleotide
augugguccugggucgcu

SEQ ID NO: 134988 - RNA, 18 nt, Artificial Sequence
  Description of Artificial Sequence: Synthetic oligonucleotide
gcaacaugugguccuggg

SEQ ID NO: 134989 - RNA, 18 nt, Artificial Sequence
  Description of Artificial Sequence: Synthetic oligonucleotide
gagaggcaacaugugguc

SEQ ID NO: 134990 - RNA, 18 nt, Artificial Sequence
  Description of Artificial Sequence: Synthetic oligonucleotide
gcucagagaggcaacaug

SEQ ID NO: 134991 - RNA, 18 nt, Artificial Sequence
  Description of Artificial Sequence: Synthetic oligonucleotide
cugaggcucagagaggca

SEQ ID NO: 134992 - RNA, 18 nt, Artificial Sequence
  Description of Artificial Sequence: Synthetic oligonucleotide
gaaaacugaggcucagag

SEQ ID NO: 134993 - RNA, 18 nt, Artificial Sequence
  Description of Artificial Sequence: Synthetic oligonucleotide
caugggaaaacugaggcu

SEQ ID NO: 134994 - RNA, 18 nt, Artificial Sequence
  Description of Artificial Sequence: Synthetic oligonucleotide
cuaaacaugggaaaacug

SEQ ID NO: 134995 - RNA, 18 nt, Artificial Sequence
  Description of Artificial Sequence: Synthetic oligonucleotide
uccugcuaaacaugggaa

SEQ ID NO: 134996 - RNA, 18 nt, Artificial Sequence
  Description of Artificial Sequence: Synthetic oligonucleotide
uccuguccugcuaaacau

SEQ ID NO: 134997 - RNA, 18 nt, Artificial Sequence
  Description of Artificial Sequence: Synthetic oligonucleotide
cccaguccuguccugcua

SEQ ID NO: 134998 - RNA, 18 nt, Artificial Sequence
  Description of Artificial Sequence: Synthetic oligonucleotide
aagagcccaguccugucc

SEQ ID NO: 134999 - RNA, 18 nt, Artificial Sequence
  Description of Artificial Sequence: Synthetic oligonucleotide
ucucuaagagcccagucc

SEQ ID NO: 135000 - RNA, 18 nt, Artificial Sequence
  Description of Artificial Sequence: Synthetic oligonucleotide
ugaacucucuaagagccc

SEQ ID NO: 135001 - RNA, 18 nt, Artificial Sequence
  Description of Artificial Sequence: Synthetic oligonucleotide
ugcuaugaacucucuaag

SEQ ID NO: 135002 - RNA, 18 nt, Artificial Sequence
  Description of Artificial Sequence: Synthetic oligonucleotide
aaaggugcuaugaacucu

SEQ ID NO: 135003 - RNA, 18 nt, Artificial Sequence
  Description of Artificial Sequence: Synthetic oligonucleotide
gcuggaaaggugcuauga

SEQ ID NO: 135004 - RNA, 18 nt, Artificial Sequence
  Description of Artificial Sequence: Synthetic oligonucleotide
caggagcuggaaaggugc

SEQ ID NO: 135005 - RNA, 18 nt, Artificial Sequence
  Description of Artificial Sequence: Synthetic oligonucleotide
cccaccaggagcuggaaa

SEQ ID NO: 135006 - RNA, 18 nt, Artificial Sequence
  Description of Artificial Sequence: Synthetic oligonucleotide
uugaacccaccaggagcu

SEQ ID NO: 135007 - RNA, 18 nt, Artificial Sequence
  Description of Artificial Sequence: Synthetic oligonucleotide
cucucuugaacccaccag

SEQ ID NO: 135008 - RNA, 18 nt, Artificial Sequence
  Description of Artificial Sequence: Synthetic oligonucleotide
gaguucucucuugaaccc

SEQ ID NO: 135009 - RNA, 18 nt, Artificial Sequence
  Description of Artificial Sequence: Synthetic oligonucleotide
cccgggaguucucucuug

SEQ ID NO: 135010 - RNA, 18 nt, Artificial Sequence
  Description of Artificial Sequence: Synthetic oligonucleotide
uucaucccgggaguucuc

SEQ ID NO: 135011 - RNA, 18 nt, Artificial Sequence
  Description of Artificial Sequence: Synthetic oligonucleotide
aucucuucaucccgggag

SEQ ID NO: 135012 - RNA, 18 nt, Artificial Sequence
  Description of Artificial Sequence: Synthetic oligonucleotide
cucucaucucuucauccc

SEQ ID NO: 135013 - RNA, 18 nt, Artificial Sequence
  Description of Artificial Sequence: Synthetic oligonucleotide
cagugcucucaucucuuc

SEQ ID NO: 135014 - RNA, 18 nt, Artificial Sequence
  Description of Artificial Sequence: Synthetic oligonucleotide
aaccucagugcucucauc

SEQ ID NO: 135015 - RNA, 18 nt, Artificial Sequence
  Description of Artificial Sequence: Synthetic oligonucleotide
cccccaaccucagugcuc

SEQ ID NO: 135016 - RNA, 18 nt, Artificial Sequence
  Description of Artificial Sequence: Synthetic oligonucleotide
uugaccccccaaccucag

SEQ ID NO: 135017 - RNA, 18 nt, Artificial Sequence
  Description of Artificial Sequence: Synthetic oligonucleotide
uccaguugaccccccaac

SEQ ID NO: 135018 - RNA, 18 nt, Artificial Sequence
  Description of Artificial Sequence: Synthetic oligonucleotide
ggcuauccaguugacccc

SEQ ID NO: 135019 - RNA, 18 nt, Artificial Sequence
  Description of Artificial Sequence: Synthetic oligonucleotide
gcccuggcuauccaguug

SEQ ID NO: 135020 - RNA, 18 nt, Artificial Sequence
  Description of Artificial Sequence: Synthetic oligonucleotide
cuagggcccuggcuaucc

SEQ ID NO: 135021 - RNA, 18 nt, Artificial Sequence
  Description of Artificial Sequence: Synthetic oligonucleotide
cagaacuagggcccuggc

SEQ ID NO: 135022 - RNA, 18 nt, Artificial Sequence
  Description of Artificial Sequence: Synthetic oligonucleotide
uaggacagaacuagggcc

SEQ ID NO: 135023 - RNA, 18 nt, Artificial Sequence
  Description of Artificial Sequence: Synthetic oligonucleotide
ccucuuaggacagaacua

SEQ ID NO: 135024 - RNA, 18 nt, Artificial Sequence
  Description of Artificial Sequence: Synthetic oligonucleotide
uuccuccucuuaggacag

SEQ ID NO: 135025 - RNA, 18 nt, Artificial Sequence
  Description of Artificial Sequence: Synthetic oligonucleotide
acaacuuccuccucuuag

SEQ ID NO: 135026 - RNA, 18 nt, Artificial Sequence
  Description of Artificial Sequence: Synthetic oligonucleotide
aagacacaacuuccuccu

SEQ ID NO: 135027 - RNA, 18 nt, Artificial Sequence
  Description of Artificial Sequence: Synthetic oligonucleotide
uggagaagacacaacuuc

SEQ ID NO: 135028 - RNA, 18 nt, Artificial Sequence
  Description of Artificial Sequence: Synthetic oligonucleotide
uuggauggagaagacaca

SEQ ID NO: 135029 - RNA, 18 nt, Artificial Sequence
  Description of Artificial Sequence: Synthetic oligonucleotide
gaugguuggauggagaag

SEQ ID NO: 135030 - RNA, 18 nt, Artificial Sequence
  Description of Artificial Sequence: Synthetic oligonucleotide
cacgcacugccggcuaaa

SEQ ID NO: 135031 - RNA, 18 nt, Artificial Sequence
  Description of Artificial Sequence: Synthetic oligonucleotide
uccaccacgcacugccgg

SEQ ID NO: 135032 - RNA, 18 nt, Artificial Sequence
  Description of Artificial Sequence: Synthetic oligonucleotide
cuuuguccaccacgcacu

SEQ ID NO: 135033 - RNA, 18 nt, Artificial Sequence
  Description of Artificial Sequence: Synthetic oligonucleotide
cuugucuuuguccaccac

SEQ ID NO: 135034 - RNA, 18 nt, Artificial Sequence
  Description of Artificial Sequence: Synthetic oligonucleotide
uuccucuugucuuugucc

SEQ ID NO: 135035 - RNA, 18 nt, Artificial Sequence
  Description of Artificial Sequence: Synthetic oligonucleotide
acugguuccucuugucuu

SEQ ID NO: 135036 - RNA, 18 nt, Artificial Sequence
  Description of Artificial Sequence: Synthetic oligonucleotide
gcggcacugguuccucuu

SEQ ID NO: 135037 - RNA, 18 nt, Artificial Sequence
  Description of Artificial Sequence: Synthetic oligonucleotide
caguagcggcacugguuc

SEQ ID NO: 135038 - RNA, 18 nt, Artificial Sequence
  Description of Artificial Sequence: Synthetic oligonucleotide
gccugcaguagcggcacu

SEQ ID NO: 135039 - RNA, 18 nt, Artificial Sequence
  Description of Artificial Sequence: Synthetic oligonucleotide
cuugagccugcaguagcg

SEQ ID NO: 135040 - RNA, 18 nt, Artificial Sequence
  Description of Artificial Sequence: Synthetic oligonucleotide
cauuucuugagccugcag

SEQ ID NO: 135041 - RNA, 18 nt, Artificial Sequence
  Description of Artificial Sequence: Synthetic oligonucleotide
ggaagcauuucuugagcc

SEQ ID NO: 135042 - RNA, 18 nt, Artificial Sequence
  Description of Artificial Sequence: Synthetic oligonucleotide
agcccggaagcauuucuu

SEQ ID NO: 135043 - RNA, 18 nt, Artificial Sequence
  Description of Artificial Sequence: Synthetic oligonucleotide
augccagcccggaagcau

SEQ ID NO: 135044 - RNA, 18 nt, Artificial Sequence
  Description of Artificial Sequence: Synthetic oligonucleotide
ucuucaugccagcccgga

SEQ ID NO: 135045 - RNA, 18 nt, Artificial Sequence
  Description of Artificial Sequence: Synthetic oligonucleotide
uuccuucuucaugccagc

SEQ ID NO: 135046 - RNA, 18 nt, Artificial Sequence
  Description of Artificial Sequence: Synthetic oligonucleotide
caccacgcacugccggcu

SEQ ID NO: 135047 - RNA, 18 nt, Artificial Sequence
  Description of Artificial Sequence: Synthetic oligonucleotide
uuguccaccacgcacugc

SEQ ID NO: 135048 - RNA, 18 nt, Artificial Sequence
  Description of Artificial Sequence: Synthetic oligonucleotide
ugucuuuguccaccacgc

SEQ ID NO: 135049 - RNA, 18 nt, Artificial Sequence
  Description of Artificial Sequence: Synthetic oligonucleotide
ccucuugucuuuguccac

SEQ ID NO: 135050 - RNA, 18 nt, Artificial Sequence
  Description of Artificial Sequence: Synthetic oligonucleotide
ugguuccucuugucuuug

SEQ ID NO: 135051 - RNA, 18 nt, Artificial Sequence
  Description of Artificial Sequence: Synthetic oligonucleotide
ggcacugguuccucuugu

SEQ ID NO: 135052 - RNA, 18 nt, Artificial Sequence
  Description of Artificial Sequence: Synthetic oligonucleotide
guagcggcacugguuccu

SEQ ID NO: 135053 - RNA, 18 nt, Artificial Sequence
  Description of Artificial Sequence: Synthetic oligonucleotide
cugcaguagcggcacugg

SEQ ID NO: 135054 - RNA, 18 nt, Artificial Sequence
  Description of Artificial Sequence: Synthetic oligonucleotide
ugagccugcaguagcggc

SEQ ID NO: 135055 - RNA, 18 nt, Artificial Sequence
  Description of Artificial Sequence: Synthetic oligonucleotide
uuucuugagccugcagua

SEQ ID NO: 135056 - RNA, 18 nt, Artificial Sequence
  Description of Artificial Sequence: Synthetic oligonucleotide
aagcauuucuugagccug

SEQ ID NO: 135057 - RNA, 18 nt, Artificial Sequence
  Description of Artificial Sequence: Synthetic oligonucleotide
cccggaagcauuucuuga

SEQ ID NO: 135058 - RNA, 18 nt, Artificial Sequence
  Description of Artificial Sequence: Synthetic oligonucleotide
gccagcccggaagcauuu

SEQ ID NO: 135059 - RNA, 18 nt, Artificial Sequence
  Description of Artificial Sequence: Synthetic oligonucleotide
uucaugccagcccggaag

SEQ ID NO: 135060 - RNA, 18 nt, Artificial Sequence
  Description of Artificial Sequence: Synthetic oligonucleotide
ccuucuucaugccagccc

SEQ ID NO: 135061 - RNA, 18 nt, Artificial Sequence
  Description of Artificial Sequence: Synthetic oligonucleotide
gcugugggugcagguggg

SEQ ID NO: 135062 - RNA, 18 nt, Artificial Sequence
  Description of Artificial Sequence: Synthetic oligonucleotide
gggagcugugggugcagg

SEQ ID NO: 135063 - RNA, 18 nt, Artificial Sequence
  Description of Artificial Sequence: Synthetic oligonucleotide
uuguaaaugacugucggg

SEQ ID NO: 135064 - RNA, 18 nt, Artificial Sequence
  Description of Artificial Sequence: Synthetic oligonucleotide
uacaguuguaaaugacug

SEQ ID NO: 135065 - RNA, 18 nt, Artificial Sequence
  Description of Artificial Sequence: Synthetic oligonucleotide
guggcuacaguuguaaau

SEQ ID NO: 135066 - RNA, 18 nt, Artificial Sequence
  Description of Artificial Sequence: Synthetic oligonucleotide
aaaguguggcuacaguug

SEQ ID NO: 135067 - RNA, 18 nt, Artificial Sequence
  Description of Artificial Sequence: Synthetic oligonucleotide
gucauaaaguguggcuac

SEQ ID NO: 135068 - RNA, 18 nt, Artificial Sequence
  Description of Artificial Sequence: Synthetic oligonucleotide
acugagucauaaagugug

SEQ ID NO: 135069 - RNA, 18 nt, Artificial Sequence
  Description of Artificial Sequence: Synthetic oligonucleotide
cugccacugagucauaaa

SEQ ID NO: 135070 - RNA, 18 nt, Artificial Sequence
  Description of Artificial Sequence: Synthetic oligonucleotide
gggccugccacugaguca

SEQ ID NO: 135071 - RNA, 18 nt, Artificial Sequence
  Description of Artificial Sequence: Synthetic oligonucleotide
uuagccagucacccuggg

SEQ ID NO: 135072 - RNA, 18 nt, Artificial Sequence
  Description of Artificial Sequence: Synthetic oligonucleotide
agccauuagccagucacc

SEQ ID NO: 135073 - RNA, 18 nt, Artificial Sequence
  Description of Artificial Sequence: Synthetic oligonucleotide
uucucagccauuagccag

SEQ ID NO: 135074 - RNA, 18 nt, Artificial Sequence
  Description of Artificial Sequence: Synthetic oligonucleotide
cccucuucucagccauua

SEQ ID NO: 135075 - RNA, 18 nt, Artificial Sequence
  Description of Artificial Sequence: Synthetic oligonucleotide
gcccucccucuucucagc

SEQ ID NO: 135076 - RNA, 18 nt, Artificial Sequence
  Description of Artificial Sequence: Synthetic oligonucleotide
uccaggcccucccucuuc

SEQ ID NO: 135077 - RNA, 18 nt, Artificial Sequence
  Description of Artificial Sequence: Synthetic oligonucleotide
agauuuccaggcccuccc

SEQ ID NO: 135078 - RNA, 18 nt, Artificial Sequence
  Description of Artificial Sequence: Synthetic oligonucleotide
uggucagauuuccaggcc

SEQ ID NO: 135079 - RNA, 18 nt, Artificial Sequence
  Description of Artificial Sequence: Synthetic oligonucleotide
cccuauggucagauuucc

SEQ ID NO: 135080 - RNA, 18 nt, Artificial Sequence
  Description of Artificial Sequence: Synthetic oligonucleotide
ccgcucccuauggucaga

SEQ ID NO: 135081 - RNA, 18 nt, Artificial Sequence
  Description of Artificial Sequence: Synthetic oligonucleotide
cccagccgcucccuaugg

SEQ ID NO: 135082 - RNA, 18 nt, Artificial Sequence
  Description of Artificial Sequence: Synthetic oligonucleotide
ccaagcccagccgcuccc

SEQ ID NO: 135083 - RNA, 18 nt, Artificial Sequence
  Description of Artificial Sequence: Synthetic oligonucleotide
caagaccaagcccagccg

SEQ ID NO: 135084 - RNA, 18 nt, Artificial Sequence
  Description of Artificial Sequence: Synthetic oligonucleotide
uuucucaagaccaagccc

SEQ ID NO: 135085 - RNA, 18 nt, Artificial Sequence
  Description of Artificial Sequence: Synthetic oligonucleotide
gaaucuuucucaagacca

SEQ ID NO: 135086 - RNA, 18 nt, Artificial Sequence
  Description of Artificial Sequence: Synthetic oligonucleotide
ucucugaaucuuucucaa

SEQ ID NO: 135087 - RNA, 18 nt, Artificial Sequence
  Description of Artificial Sequence: Synthetic oligonucleotide
uuaucucucugaaucuuu

SEQ ID NO: 135088 - RNA, 18 nt, Artificial Sequence
  Description of Artificial Sequence: Synthetic oligonucleotide
ggagcuuaucucucugaa

SEQ ID NO: 135089 - RNA, 18 nt, Artificial Sequence
  Description of Artificial Sequence: Synthetic oligonucleotide
gagugggagcuuaucucu

SEQ ID NO: 135090 - RNA, 18 nt, Artificial Sequence
  Description of Artificial Sequence: Synthetic oligonucleotide
gccaagagugggagcuua

SEQ ID NO: 135091 - RNA, 18 nt, Artificial Sequence
  Description of Artificial Sequence: Synthetic oligonucleotide
gaggagccaagaguggga

SEQ ID NO: 135092 - RNA, 18 nt, Artificial Sequence
  Description of Artificial Sequence: Synthetic oligonucleotide
agccugaggagccaagag

SEQ ID NO: 135093 - RNA, 18 nt, Artificial Sequence
  Description of Artificial Sequence: Synthetic oligonucleotide
cugggagccugaggagcc

SEQ ID NO: 135094 - RNA, 18 nt, Artificial Sequence
  Description of Artificial Sequence: Synthetic oligonucleotide
gguugcugggagccugag

SEQ ID NO: 135095 - RNA, 18 nt, Artificial Sequence
  Description of Artificial Sequence: Synthetic oligonucleotide
guggugguugcugggagc

SEQ ID NO: 135096 - RNA, 18 nt, Artificial Sequence
  Description of Artificial Sequence: Synthetic oligonucleotide
ggguggugguugcuggga

SEQ ID NO: 135097 - RNA, 18 nt, Artificial Sequence
  Description of Artificial Sequence: Synthetic oligonucleotide
gcagacaggcaggcaggg

SEQ ID NO: 135098 - RNA, 18 nt, Artificial Sequence
  Description of Artificial Sequence: Synthetic oligonucleotide
guggcgcagacaggcagg

SEQ ID NO: 135099 - RNA, 18 nt, Artificial Sequence
  Description of Artificial Sequence: Synthetic oligonucleotide
uugugguggcgcagacag

SEQ ID NO: 135100 - RNA, 18 nt, Artificial Sequence
  Description of Artificial Sequence: Synthetic oligonucleotide
cugcuuugugguggcgca

SEQ ID NO: 135101 - RNA, 18 nt, Artificial Sequence
  Description of Artificial Sequence: Synthetic oligonucleotide
cguggcugcuuuguggug

SEQ ID NO: 135102 - RNA, 18 nt, Artificial Sequence
  Description of Artificial Sequence: Synthetic oligonucleotide
cacaacguggcugcuuug

SEQ ID NO: 135103 - RNA, 18 nt, Artificial Sequence
  Description of Artificial Sequence: Synthetic oligonucleotide
acacacacaacguggcug

SEQ ID NO: 135104 - RNA, 18 nt, Artificial Sequence
  Description of Artificial Sequence: Synthetic oligonucleotide
cacacacacacacaacgu

SEQ ID NO: 135105 - RNA, 18 nt, Artificial Sequence
  Description of Artificial Sequence: Synthetic oligonucleotide
acacacacacacacacac

SEQ ID NO: 135106 - RNA, 18 nt, Artificial Sequence
  Description of Artificial Sequence: Synthetic oligonucleotide
cacacacacacacacaca

SEQ ID NO: 135107 - RNA, 18 nt, Artificial Sequence
  Description of Artificial Sequence: Synthetic oligonucleotide
acacacacacacacacac

SEQ ID NO: 135108 - RNA, 18 nt, Artificial Sequence
  Description of Artificial Sequence: Synthetic oligonucleotide
cacacacacacacacaca

SEQ ID NO: 135109 - RNA, 18 nt, Artificial Sequence
  Description of Artificial Sequence: Synthetic oligonucleotide
uuaaacacacacacacac

SEQ ID NO: 135110 - RNA, 18 nt, Artificial Sequence
  Description of Artificial Sequence: Synthetic oligonucleotide
uuauauuaaacacacaca

SEQ ID NO: 135111 - RNA, 18 nt, Artificial Sequence
  Description of Artificial Sequence: Synthetic oligonucleotide
aaauauuauauuaaacac

SEQ ID NO: 135112 - RNA, 18 nt, Artificial Sequence
  Description of Artificial Sequence: Synthetic oligonucleotide
guucgaaauauuauauua

SEQ ID NO: 135113 - RNA, 18 nt, Artificial Sequence
  Description of Artificial Sequence: Synthetic oligonucleotide
cuaacguucgaaauauua

SEQ ID NO: 135114 - RNA, 18 nt, Artificial Sequence
  Description of Artificial Sequence: Synthetic oligonucleotide
uuguccuaacguucgaaa

SEQ ID NO: 135115 - RNA, 18 nt, Artificial Sequence
  Description of Artificial Sequence: Synthetic oligonucleotide
uaugcuuguccuaacguu

SEQ ID NO: 135116 - RNA, 18 nt, Artificial Sequence
  Description of Artificial Sequence: Synthetic oligonucleotide
uucucuaugcuuguccua

SEQ ID NO: 135117 - RNA, 18 nt, Artificial Sequence
  Description of Artificial Sequence: Synthetic oligonucleotide
uaucauucucuaugcuug

SEQ ID NO: 135118 - RNA, 18 nt, Artificial Sequence
  Description of Artificial Sequence: Synthetic oligonucleotide
ugcaauaucauucucuau

SEQ ID NO: 135119 - RNA, 18 nt, Artificial Sequence
  Description of Artificial Sequence: Synthetic oligonucleotide
auguuugcaauaucauuc

SEQ ID NO: 135120 - RNA, 18 nt, Artificial Sequence
  Description of Artificial Sequence: Synthetic oligonucleotide
cucagauguuugcaauau

SEQ ID NO: 135121 - RNA, 18 nt, Artificial Sequence
  Description of Artificial Sequence: Synthetic oligonucleotide
gaguacucagauguuugc

SEQ ID NO: 135122 - RNA, 18 nt, Artificial Sequence
  Description of Artificial Sequence: Synthetic oligonucleotide
auagugaguacucagaug

SEQ ID NO: 135123 - RNA, 18 nt, Artificial Sequence
  Description of Artificial Sequence: Synthetic oligonucleotide
uugggauagugaguacuc

SEQ ID NO: 135124 - RNA, 18 nt, Artificial Sequence
  Description of Artificial Sequence: Synthetic oligonucleotide
uaaaguugggauagugag

SEQ ID NO: 135125 - RNA, 18 nt, Artificial Sequence
  Description of Artificial Sequence: Synthetic oligonucleotide
uuuuguaaaguugggaua

SEQ ID NO: 135126 - RNA, 18 nt, Artificial Sequence
  Description of Artificial Sequence: Synthetic oligonucleotide
gucccuuuuguaaaguug

SEQ ID NO: 135127 - RNA, 18 nt, Artificial Sequence
  Description of Artificial Sequence: Synthetic oligonucleotide
uggcugucccuuuuguaa

SEQ ID NO: 135128 - RNA, 18 nt, Artificial Sequence
  Description of Artificial Sequence: Synthetic oligonucleotide
uccucuggcugucccuuu

SEQ ID NO: 135129 - RNA, 18 nt, Artificial Sequence
  Description of Artificial Sequence: Synthetic oligonucleotide
cgggcuccucuggcuguc

SEQ ID NO: 135130 - RNA, 18 nt, Artificial Sequence
  Description of Artificial Sequence: Synthetic oligonucleotide
ggcaucgggcuccucugg

SEQ ID NO: 135131 - RNA, 18 nt, Artificial Sequence
  Description of Artificial Sequence: Synthetic oligonucleotide
gcucaggcaucgggcucc

SEQ ID NO: 135132 - RNA, 18 nt, Artificial Sequence
  Description of Artificial Sequence: Synthetic oligonucleotide
cggaagcucaggcaucgg

SEQ ID NO: 135133 - RNA, 18 nt, Artificial Sequence
  Description of Artificial Sequence: Synthetic oligonucleotide
gggaccggaagcucaggc

SEQ ID NO: 135134 - RNA, 18 nt, Artificial Sequence
  Description of Artificial Sequence: Synthetic oligonucleotide
ucccugggaccggaagcu

SEQ ID NO: 135135 - RNA, 18 nt, Artificial Sequence
  Description of Artificial Sequence: Synthetic oligonucleotide
auuugucccugggaccgg

SEQ ID NO: 135136 - RNA, 18 nt, Artificial Sequence
  Description of Artificial Sequence: Synthetic oligonucleotide
gggcauuugucccuggga

SEQ ID NO: 135137 - RNA, 18 nt, Artificial Sequence
  Description of Artificial Sequence: Synthetic oligonucleotide
aauacuaagggaacuggg

SEQ ID NO: 135138 - RNA, 18 nt, Artificial Sequence
  Description of Artificial Sequence: Synthetic oligonucleotide
gaaugaauacuaagggaa

SEQ ID NO: 135139 - RNA, 18 nt, Artificial Sequence
  Description of Artificial Sequence: Synthetic oligonucleotide
cccacgaaugaauacuaa

SEQ ID NO: 135140 - RNA, 18 nt, Artificial Sequence
  Description of Artificial Sequence: Synthetic oligonucleotide
ugauacccacgaaugaau

SEQ ID NO: 135141 - RNA, 18 nt, Artificial Sequence
  Description of Artificial Sequence: Synthetic oligonucleotide
ucacgugauacccacgaa

SEQ ID NO: 135142 - RNA, 18 nt, Artificial Sequence
  Description of Artificial Sequence: Synthetic oligonucleotide
ggagaucacgugauaccc

SEQ ID NO: 135143 - RNA, 18 nt, Artificial Sequence
  Description of Artificial Sequence: Synthetic oligonucleotide
acuuuggagaucacguga

SEQ ID NO: 135144 - RNA, 18 nt, Artificial Sequence
  Description of Artificial Sequence: Synthetic oligonucleotide
ugaagacuuuggagauca

SEQ ID NO: 135145 - RNA, 18 nt, Artificial Sequence
  Description of Artificial Sequence: Synthetic oligonucleotide
gaaugugaagacuuugga

SEQ ID NO: 135146 - RNA, 18 nt, Artificial Sequence
  Description of Artificial Sequence: Synthetic oligonucleotide
uucuagaaugugaagacu

SEQ ID NO: 135147 - RNA, 18 nt, Artificial Sequence
  Description of Artificial Sequence: Synthetic oligonucleotide
acuaaccucagcaucagc

SEQ ID NO: 135148 - RNA, 18 nt, Artificial Sequence
  Description of Artificial Sequence: Synthetic oligonucleotide
uccagacuaaccucagca

SEQ ID NO: 135149 - RNA, 18 nt, Artificial Sequence
  Description of Artificial Sequence: Synthetic oligonucleotide
uguacuccagacuaaccu

SEQ ID NO: 135150 - RNA, 18 nt, Artificial Sequence
  Description of Artificial Sequence: Synthetic oligonucleotide
cugcauguacuccagacu

SEQ ID NO: 135151 - RNA, 18 nt, Artificial Sequence
  Description of Artificial Sequence: Synthetic oligonucleotide
aggagcugcauguacucc

SEQ ID NO: 135152 - RNA, 18 nt, Artificial Sequence
  Description of Artificial Sequence: Synthetic oligonucleotide
ucagcaggagcugcaugu

SEQ ID NO: 135153 - RNA, 18 nt, Artificial Sequence
  Description of Artificial Sequence: Synthetic oligonucleotide
guccaucagcaggagcug

SEQ ID NO: 135154 - RNA, 18 nt, Artificial Sequence
  Description of Artificial Sequence: Synthetic oligonucleotide
guuuuguccaucagcagg

SEQ ID NO: 135155 - RNA, 18 nt, Artificial Sequence
  Description of Artificial Sequence: Synthetic oligonucleotide
ugaugguuuuguccauca

SEQ ID NO: 135156 - RNA, 18 nt, Artificial Sequence
  Description of Artificial Sequence: Synthetic oligonucleotide
ugccuugaugguuuuguc

SEQ ID NO: 135157 - RNA, 18 nt, Artificial Sequence
  Description of Artificial Sequence: Synthetic oligonucleotide
ccaacugccuugaugguu

SEQ ID NO: 135158 - RNA, 18 nt, Artificial Sequence
  Description of Artificial Sequence: Synthetic oligonucleotide
gggcuccaacugccuuga

SEQ ID NO: 135159 - RNA, 18 nt, Artificial Sequence
  Description of Artificial Sequence: Synthetic oligonucleotide
ugaacaagaggaucuggg

SEQ ID NO: 135160 - RNA, 18 nt, Artificial Sequence
  Description of Artificial Sequence: Synthetic oligonucleotide
uccugaacaagaggaucu

SEQ ID NO: 135161 - RNA, 18 nt, Artificial Sequence
  Description of Artificial Sequence: Synthetic oligonucleotide
gggauuccugaacaagag

SEQ ID NO: 135162 - RNA, 18 nt, Artificial Sequence
  Description of Artificial Sequence: Synthetic oligonucleotide
acaaggagauggccuggg

SEQ ID NO: 135163 - RNA, 18 nt, Artificial Sequence
  Description of Artificial Sequence: Synthetic oligonucleotide
gugacaaggagauggccu

SEQ ID NO: 135164 - RNA, 18 nt, Artificial Sequence
  Description of Artificial Sequence: Synthetic oligonucleotide
ucugggugacaaggagau

SEQ ID NO: 135165 - RNA, 18 nt, Artificial Sequence
  Description of Artificial Sequence: Synthetic oligonucleotide
auuacucugggugacaag

SEQ ID NO: 135166 - RNA, 18 nt, Artificial Sequence
  Description of Artificial Sequence: Synthetic oligonucleotide
aacaaauuacucugggug

SEQ ID NO: 135167 - RNA, 18 nt, Artificial Sequence
  Description of Artificial Sequence: Synthetic oligonucleotide
agcaaaacaaauuacucu

SEQ ID NO: 135168 - RNA, 18 nt, Artificial Sequence
  Description of Artificial Sequence: Synthetic oligonucleotide
aagcaagcaaaacaaauu

SEQ ID NO: 135169 - RNA, 18 nt, Artificial Sequence
  Description of Artificial Sequence: Synthetic oligonucleotide
gaguaaagcaagcaaaac

SEQ ID NO: 135170 - RNA, 18 nt, Artificial Sequence
  Description of Artificial Sequence: Synthetic oligonucleotide
aaagugaguaaagcaagc

SEQ ID NO: 135171 - RNA, 18 nt, Artificial Sequence
  Description of Artificial Sequence: Synthetic oligonucleotide
aaaugaaagugaguaaag

SEQ ID NO: 135172 - RNA, 18 nt, Artificial Sequence
  Description of Artificial Sequence: Synthetic oligonucleotide
uuuccaaaugaaagugag

SEQ ID NO: 135173 - RNA, 18 nt, Artificial Sequence
  Description of Artificial Sequence: Synthetic oligonucleotide
cuuucuuuccaaaugaaa

SEQ ID NO: 135174 - RNA, 18 nt, Artificial Sequence
  Description of Artificial Sequence: Synthetic oligonucleotide
ggucccuuucuuuccaaa

SEQ ID NO: 135175 - RNA, 18 nt, Artificial Sequence
  Description of Artificial Sequence: Synthetic oligonucleotide
aaaagggucccuuucuuu

SEQ ID NO: 135176 - RNA, 18 nt, Artificial Sequence
  Description of Artificial Sequence: Synthetic oligonucleotide
ucuacaaaagggucccuu

SEQ ID NO: 135177 - RNA, 18 nt, Artificial Sequence
  Description of Artificial Sequence: Synthetic oligonucleotide
ucuggucuacaaaagggu

SEQ ID NO: 135178 - RNA, 18 nt, Artificial Sequence
  Description of Artificial Sequence: Synthetic oligonucleotide
caagcucuggucuacaaa

SEQ ID NO: 135179 - RNA, 18 nt, Artificial Sequence
  Description of Artificial Sequence: Synthetic oligonucleotide
auguucaagcucuggucu

SEQ ID NO: 135180 - RNA, 18 nt, Artificial Sequence
  Description of Artificial Sequence: Synthetic oligonucleotide
uaaagauguucaagcucu

SEQ ID NO: 135181 - RNA, 18 nt, Artificial Sequence
  Description of Artificial Sequence: Synthetic oligonucleotide
uagcuuaaagauguucaa

SEQ ID NO: 135182 - RNA, 18 nt, Artificial Sequence
  Description of Artificial Sequence: Synthetic oligonucleotide
cugacuagcuuaaagaug

SEQ ID NO: 135183 - RNA, 18 nt, Artificial Sequence
  Description of Artificial Sequence: Synthetic oligonucleotide
gggaucugacuagcuuaa

SEQ ID NO: 135184 - RNA, 18 nt, Artificial Sequence
  Description of Artificial Sequence: Synthetic oligonucleotide
cuugagcauugaggaggg

SEQ ID NO: 135185 - RNA, 18 nt, Artificial Sequence
  Description of Artificial Sequence: Synthetic oligonucleotide
ucuugagcauugaggagg

SEQ ID NO: 135186 - RNA, 18 nt, Artificial Sequence
  Description of Artificial Sequence: Synthetic oligonucleotide
auuggucuugagcauuga

SEQ ID NO: 135187 - RNA, 18 nt, Artificial Sequence
  Description of Artificial Sequence: Synthetic oligonucleotide
uuaaaauuggucuugagc

SEQ ID NO: 135188 - RNA, 18 nt, Artificial Sequence
  Description of Artificial Sequence: Synthetic oligonucleotide
uggguuuaaaauuggucu

SEQ ID NO: 135189 - RNA, 18 nt, Artificial Sequence
  Description of Artificial Sequence: Synthetic oligonucleotide
ggcuauggguuuaaaauu

SEQ ID NO: 135190 - RNA, 18 nt, Artificial Sequence
  Description of Artificial Sequence: Synthetic oligonucleotide
gacucggcuauggguuua

SEQ ID NO: 135191 - RNA, 18 nt, Artificial Sequence
  Description of Artificial Sequence: Synthetic oligonucleotide
gugaagacucggcuaugg

SEQ ID NO: 135192 - RNA, 18 nt, Artificial Sequence
  Description of Artificial Sequence: Synthetic oligonucleotide
agacagugaagacucggc

SEQ ID NO: 135193 - RNA, 18 nt, Artificial Sequence
  Description of Artificial Sequence: Synthetic oligonucleotide
gcgcaagacagugaagac

SEQ ID NO: 135194 - RNA, 18 nt, Artificial Sequence
  Description of Artificial Sequence: Synthetic oligonucleotide
auccacccaucagcaggg

SEQ ID NO: 135195 - RNA, 18 nt, Artificial Sequence
  Description of Artificial Sequence: Synthetic oligonucleotide
gagugauccacccaucag

SEQ ID NO: 135196 - RNA, 18 nt, Artificial Sequence
  Description of Artificial Sequence: Synthetic oligonucleotide
uauaagagugauccaccc

SEQ ID NO: 135197 - RNA, 18 nt, Artificial Sequence
  Description of Artificial Sequence: Synthetic oligonucleotide
gaggcuauaagagugauc

SEQ ID NO: 135198 - RNA, 18 nt, Artificial Sequence
  Description of Artificial Sequence: Synthetic oligonucleotide
auggagaggcuauaagag

SEQ ID NO: 135199 - RNA, 18 nt, Artificial Sequence
  Description of Artificial Sequence: Synthetic oligonucleotide
acacaauggagaggcuau

SEQ ID NO: 135200 - RNA, 18 nt, Artificial Sequence
  Description of Artificial Sequence: Synthetic oligonucleotide
ccccaacacaauggagag

SEQ ID NO: 135201 - RNA, 18 nt, Artificial Sequence
  Description of Artificial Sequence: Synthetic oligonucleotide
acugcccccaacacaaug

SEQ ID NO: 135202 - RNA, 18 nt, Artificial Sequence
  Description of Artificial Sequence: Synthetic oligonucleotide
ucacaacugcccccaaca

SEQ ID NO: 135203 - RNA, 18 nt, Artificial Sequence
  Description of Artificial Sequence: Synthetic oligonucleotide
acauaucacaacugcccc

SEQ ID NO: 135204 - RNA, 18 nt, Artificial Sequence
  Description of Artificial Sequence: Synthetic oligonucleotide
uuuccacauaucacaacu

SEQ ID NO: 135205 - RNA, 18 nt, Artificial Sequence
  Description of Artificial Sequence: Synthetic oligonucleotide
agaacuuuccacauauca

SEQ ID NO: 135206 - RNA, 18 nt, Artificial Sequence
  Description of Artificial Sequence: Synthetic oligonucleotide
guggaagaacuuuccaca

SEQ ID NO: 135207 - RNA, 18 nt, Artificial Sequence
  Description of Artificial Sequence: Synthetic oligonucleotide
agcugguggaagaacuuu

SEQ ID NO: 135208 - RNA, 18 nt, Artificial Sequence
  Description of Artificial Sequence: Synthetic oligonucleotide
aacucagcugguggaaga

SEQ ID NO: 135209 - RNA, 18 nt, Artificial Sequence
  Description of Artificial Sequence: Synthetic oligonucleotide
ccucuaacucagcuggug

SEQ ID NO: 135210 - RNA, 18 nt, Artificial Sequence
  Description of Artificial Sequence: Synthetic oligonucleotide
gauggccucuaacucagc

SEQ ID NO: 135211 - RNA, 18 nt, Artificial Sequence
  Description of Artificial Sequence: Synthetic oligonucleotide
cagcauguggaaugaggg

SEQ ID NO: 135212 - RNA, 18 nt, Artificial Sequence
  Description of Artificial Sequence: Synthetic oligonucleotide
cacaucagcauguggaau

SEQ ID NO: 135213 - RNA, 18 nt, Artificial Sequence
  Description of Artificial Sequence: Synthetic oligonucleotide
aggcccacaucagcaugu

SEQ ID NO: 135214 - RNA, 18 nt, Artificial Sequence
  Description of Artificial Sequence: Synthetic oligonucleotide
agaacaggcccacaucag

SEQ ID NO: 135215 - RNA, 18 nt, Artificial Sequence
  Description of Artificial Sequence: Synthetic oligonucleotide
uccagagaacaggcccac

SEQ ID NO: 135216 - RNA, 18 nt, Artificial Sequence
  Description of Artificial Sequence: Synthetic oligonucleotide
ggguguccagagaacagg

SEQ ID NO: 135217 - RNA, 18 nt, Artificial Sequence
  Description of Artificial Sequence: Synthetic oligonucleotide
gugggagcaggagguggg

SEQ ID NO: 135218 - RNA, 18 nt, Artificial Sequence
  Description of Artificial Sequence: Synthetic oligonucleotide
gagugggagcaggaggug

SEQ ID NO: 135219 - RNA, 18 nt, Artificial Sequence
  Description of Artificial Sequence: Synthetic oligonucleotide
augaggagugggagcagg

SEQ ID NO: 135220 - RNA, 18 nt, Artificial Sequence
  Description of Artificial Sequence: Synthetic oligonucleotide
gacugaugaggaguggga

SEQ ID NO: 135221 - RNA, 18 nt, Artificial Sequence
  Description of Artificial Sequence: Synthetic oligonucleotide
ucugugacugaugaggag

SEQ ID NO: 135222 - RNA, 18 nt, Artificial Sequence
  Description of Artificial Sequence: Synthetic oligonucleotide
gggugucugugacugaug

SEQ ID NO: 135223 - RNA, 18 nt, Artificial Sequence
  Description of Artificial Sequence: Synthetic oligonucleotide
aacagggauggaguaggg

SEQ ID NO: 135224 - RNA, 18 nt, Artificial Sequence
  Description of Artificial Sequence: Synthetic oligonucleotide
agaacagggauggaguag

SEQ ID NO: 135225 - RNA, 18 nt, Artificial Sequence
  Description of Artificial Sequence: Synthetic oligonucleotide
gagggagaacagggaugg

SEQ ID NO: 135226 - RNA, 18 nt, Artificial Sequence
  Description of Artificial Sequence: Synthetic oligonucleotide
gugaggagggagaacagg

SEQ ID NO: 135227 - RNA, 18 nt, Artificial Sequence
  Description of Artificial Sequence: Synthetic oligonucleotide
gagaggugaggagggaga

SEQ ID NO: 135228 - RNA, 18 nt, Artificial Sequence
  Description of Artificial Sequence: Synthetic oligonucleotide
ucccgcucauucuggacg

SEQ ID NO: 135229 - RNA, 18 nt, Artificial Sequence
  Description of Artificial Sequence: Synthetic oligonucleotide
uccggucccgcucauucu

SEQ ID NO: 135230 - RNA, 18 nt, Artificial Sequence
  Description of Artificial Sequence: Synthetic oligonucleotide
gcugauccggucccgcuc

SEQ ID NO: 135231 - RNA, 18 nt, Artificial Sequence
  Description of Artificial Sequence: Synthetic oligonucleotide
cgagugcugauccggucc

SEQ ID NO: 135232 - RNA, 18 nt, Artificial Sequence
  Description of Artificial Sequence: Synthetic oligonucleotide
accuucgagugcugaucc

SEQ ID NO: 135233 - RNA, 18 nt, Artificial Sequence
  Description of Artificial Sequence: Synthetic oligonucleotide
gcuugaccuucgagugcu

SEQ ID NO: 135234 - RNA, 18 nt, Artificial Sequence
  Description of Artificial Sequence: Synthetic oligonucleotide
ucauagcuugaccuucga

SEQ ID NO: 135235 - RNA, 18 nt, Artificial Sequence
  Description of Artificial Sequence: Synthetic oligonucleotide
uguccucauagcuugacc

SEQ ID NO: 135236 - RNA, 18 nt, Artificial Sequence
  Description of Artificial Sequence: Synthetic oligonucleotide
gcugcuguccucauagcu

SEQ ID NO: 135237 - RNA, 18 nt, Artificial Sequence
  Description of Artificial Sequence: Synthetic oligonucleotide
ggcaggcugcuguccuca

SEQ ID NO: 135238 - RNA, 18 nt, Artificial Sequence
  Description of Artificial Sequence: Synthetic oligonucleotide
uggagggcaggcugcugu

SEQ ID NO: 135239 - RNA, 18 nt, Artificial Sequence
  Description of Artificial Sequence: Synthetic oligonucleotide
auugauggagggcaggcu

SEQ ID NO: 135240 - RNA, 18 nt, Artificial Sequence
  Description of Artificial Sequence: Synthetic oligonucleotide
agcgcauugauggagggc

SEQ ID NO: 135241 - RNA, 18 nt, Artificial Sequence
  Description of Artificial Sequence: Synthetic oligonucleotide
gcaggagcgcauugaugg

SEQ ID NO: 135242 - RNA, 18 nt, Artificial Sequence
  Description of Artificial Sequence: Synthetic oligonucleotide
cgccugcaggagcgcauu

SEQ ID NO: 135243 - RNA, 18 nt, Artificial Sequence
  Description of Artificial Sequence: Synthetic oligonucleotide
accuccgccugcaggagc

SEQ ID NO: 135244 - RNA, 18 nt, Artificial Sequence
  Description of Artificial Sequence: Synthetic oligonucleotide
acaggaccuccgccugca

SEQ ID NO: 135245 - RNA, 18 nt, Artificial Sequence
  Description of Artificial Sequence: Synthetic oligonucleotide
ucgggacaggaccuccgc

SEQ ID NO: 135246 - RNA, 18 nt, Artificial Sequence
  Description of Artificial Sequence: Synthetic oligonucleotide
ucccgcucauucuggacg

SEQ ID NO: 135247 - RNA, 18 nt, Artificial Sequence
  Description of Artificial Sequence: Synthetic oligonucleotide
uccggucccgcucauucu

SEQ ID NO: 135248 - RNA, 18 nt, Artificial Sequence
  Description of Artificial Sequence: Synthetic oligonucleotide
gcugauccggucccgcuc

SEQ ID NO: 135249 - RNA, 18 nt, Artificial Sequence
  Description of Artificial Sequence: Synthetic oligonucleotide
cgagugcugauccggucc

SEQ ID NO: 135250 - RNA, 18 nt, Artificial Sequence
  Description of Artificial Sequence: Synthetic oligonucleotide
accuucgagugcugaucc

SEQ ID NO: 135251 - RNA, 18 nt, Artificial Sequence
  Description of Artificial Sequence: Synthetic oligonucleotide
gcuugaccuucgagugcu

SEQ ID NO: 135252 - RNA, 18 nt, Artificial Sequence
  Description of Artificial Sequence: Synthetic oligonucleotide
ucauagcuugaccuucga

SEQ ID NO: 135253 - RNA, 18 nt, Artificial Sequence
  Description of Artificial Sequence: Synthetic oligonucleotide
uguccucauagcuugacc

SEQ ID NO: 135254 - RNA, 18 nt, Artificial Sequence
  Description of Artificial Sequence: Synthetic oligonucleotide
gcugcuguccucauagcu

SEQ ID NO: 135255 - RNA, 18 nt, Artificial Sequence
  Description of Artificial Sequence: Synthetic oligonucleotide
ggcaggcugcuguccuca

SEQ ID NO: 135256 - RNA, 18 nt, Artificial Sequence
  Description of Artificial Sequence: Synthetic oligonucleotide
uggagggcaggcugcugu

SEQ ID NO: 135257 - RNA, 18 nt, Artificial Sequence
  Description of Artificial Sequence: Synthetic oligonucleotide
auugauggagggcaggcu

SEQ ID NO: 135258 - RNA, 18 nt, Artificial Sequence
  Description of Artificial Sequence: Synthetic oligonucleotide
agcgcauugauggagggc

SEQ ID NO: 135259 - RNA, 18 nt, Artificial Sequence
  Description of Artificial Sequence: Synthetic oligonucleotide
gcaggagcgcauugaugg

SEQ ID NO: 135260 - RNA, 18 nt, Artificial Sequence
  Description of Artificial Sequence: Synthetic oligonucleotide
cgccugcaggagcgcauu

SEQ ID NO: 135261 - RNA, 18 nt, Artificial Sequence
  Description of Artificial Sequence: Synthetic oligonucleotide
accuccgccugcaggagc

SEQ ID NO: 135262 - RNA, 18 nt, Artificial Sequence
  Description of Artificial Sequence: Synthetic oligonucleotide
acaggaccuccgccugca

SEQ ID NO: 135263 - RNA, 18 nt, Artificial Sequence
  Description of Artificial Sequence: Synthetic oligonucleotide
ucgggacaggaccuccgc

SEQ ID NO: 135264 - RNA, 18 nt, Artificial Sequence
  Description of Artificial Sequence: Synthetic oligonucleotide
ggguggcaggaucacccc

SEQ ID NO: 135265 - RNA, 18 nt, Artificial Sequence
  Description of Artificial Sequence: Synthetic oligonucleotide
uggguggguggcaggauc

SEQ ID NO: 135266 - RNA, 18 nt, Artificial Sequence
  Description of Artificial Sequence: Synthetic oligonucleotide
aucccuggguggguggca

SEQ ID NO: 135267 - RNA, 18 nt, Artificial Sequence
  Description of Artificial Sequence: Synthetic oligonucleotide
gggaucccugggugggug

SEQ ID NO: 135268 - RNA, 18 nt, Artificial Sequence
  Description of Artificial Sequence: Synthetic oligonucleotide
gcuccucuguaguguggg

SEQ ID NO: 135269 - RNA, 18 nt, Artificial Sequence
  Description of Artificial Sequence: Synthetic oligonucleotide
ggugagcuccucuguagu

SEQ ID NO: 135270 - RNA, 18 nt, Artificial Sequence
  Description of Artificial Sequence: Synthetic oligonucleotide
gaggaggugagcuccucu

SEQ ID NO: 135271 - RNA, 18 nt, Artificial Sequence
  Description of Artificial Sequence: Synthetic oligonucleotide
agguggaggaggugagcu

SEQ ID NO: 135272 - RNA, 18 nt, Artificial Sequence
  Description of Artificial Sequence: Synthetic oligonucleotide
aauggagguggaggaggu

SEQ ID NO: 135273 - RNA, 18 nt, Artificial Sequence
  Description of Artificial Sequence: Synthetic oligonucleotide
gggagaauggagguggag

SEQ ID NO: 135274 - RNA, 18 nt, Artificial Sequence
  Description of Artificial Sequence: Synthetic oligonucleotide
gcugcuccagggccuggc

SEQ ID NO: 135275 - RNA, 18 nt, Artificial Sequence
  Description of Artificial Sequence: Synthetic oligonucleotide
cgucagcugcuccagggc

SEQ ID NO: 135276 - RNA, 18 nt, Artificial Sequence
  Description of Artificial Sequence: Synthetic oligonucleotide
ccucccgucagcugcucc

SEQ ID NO: 135277 - RNA, 18 nt, Artificial Sequence
  Description of Artificial Sequence: Synthetic oligonucleotide
aggccccucccgucagcu

SEQ ID NO: 135278 - RNA, 18 nt, Artificial Sequence
  Description of Artificial Sequence: Synthetic oligonucleotide
aucugaggccccucccgu

SEQ ID NO: 135279 - RNA, 18 nt, Artificial Sequence
  Description of Artificial Sequence: Synthetic oligonucleotide
guaauaucugaggccccu

SEQ ID NO: 135280 - RNA, 18 nt, Artificial Sequence
  Description of Artificial Sequence: Synthetic oligonucleotide
cuucuguaauaucugagg

SEQ ID NO: 135281 - RNA, 18 nt, Artificial Sequence
  Description of Artificial Sequence: Synthetic oligonucleotide
ugucccuucuguaauauc

SEQ ID NO: 135282 - RNA, 18 nt, Artificial Sequence
  Description of Artificial Sequence: Synthetic oligonucleotide
cucagugucccuucugua

SEQ ID NO: 135283 - RNA, 18 nt, Artificial Sequence
  Description of Artificial Sequence: Synthetic oligonucleotide
ccggacucagugucccuu

SEQ ID NO: 135284 - RNA, 18 nt, Artificial Sequence
  Description of Artificial Sequence: Synthetic oligonucleotide
ugaaaccggacucagugu

SEQ ID NO: 135285 - RNA, 18 nt, Artificial Sequence
  Description of Artificial Sequence: Synthetic oligonucleotide
ccaugugaaaccggacuc

SEQ ID NO: 135286 - RNA, 18 nt, Artificial Sequence
  Description of Artificial Sequence: Synthetic oligonucleotide
cugggccaugugaaaccg

SEQ ID NO: 135287 - RNA, 18 nt, Artificial Sequence
  Description of Artificial Sequence: Synthetic oligonucleotide
gcaaacugggccauguga

SEQ ID NO: 135288 - RNA, 18 nt, Artificial Sequence
  Description of Artificial Sequence: Synthetic oligonucleotide
uugcugcaaacugggcca

SEQ ID NO: 135289 - RNA, 18 nt, Artificial Sequence
  Description of Artificial Sequence: Synthetic oligonucleotide
ugcccuugcugcaaacug

SEQ ID NO: 135290 - RNA, 18 nt, Artificial Sequence
  Description of Artificial Sequence: Synthetic oligonucleotide
auuccugcccuugcugca

SEQ ID NO: 135291 - RNA, 18 nt, Artificial Sequence
  Description of Artificial Sequence: Synthetic oligonucleotide
guucgauuccugcccuug

SEQ ID NO: 135292 - RNA, 18 nt, Artificial Sequence
  Description of Artificial Sequence: Synthetic oligonucleotide
gccagguucgauuccugc

SEQ ID NO: 135293 - RNA, 18 nt, Artificial Sequence
  Description of Artificial Sequence: Synthetic oligonucleotide
agggcgccagguucgauu

SEQ ID NO: 135294 - RNA, 18 nt, Artificial Sequence
  Description of Artificial Sequence: Synthetic oligonucleotide
gccccagggcgccagguu

SEQ ID NO: 135295 - RNA, 18 nt, Artificial Sequence
  Description of Artificial Sequence: Synthetic oligonucleotide
aaagugccccagggcgcc

SEQ ID NO: 135296 - RNA, 18 nt, Artificial Sequence
  Description of Artificial Sequence: Synthetic oligonucleotide
auuagaaagugccccagg

SEQ ID NO: 135297 - RNA, 18 nt, Artificial Sequence
  Description of Artificial Sequence: Synthetic oligonucleotide
gaugaauuagaaagugcc

SEQ ID NO: 135298 - RNA, 18 nt, Artificial Sequence
  Description of Artificial Sequence: Synthetic oligonucleotide
aguaggaugaauuagaaa

SEQ ID NO: 135299 - RNA, 18 nt, Artificial Sequence
  Description of Artificial Sequence: Synthetic oligonucleotide
caggcaguaggaugaauu

SEQ ID NO: 135300 - RNA, 18 nt, Artificial Sequence
  Description of Artificial Sequence: Synthetic oligonucleotide
ggaugcaggcaguaggau

SEQ ID NO: 135301 - RNA, 18 nt, Artificial Sequence
  Description of Artificial Sequence: Synthetic oligonucleotide
cugugggaugcaggcagu

SEQ ID NO: 135302 - RNA, 18 nt, Artificial Sequence
  Description of Artificial Sequence: Synthetic oligonucleotide
uuggccugugggaugcag

SEQ ID NO: 135303 - RNA, 18 nt, Artificial Sequence
  Description of Artificial Sequence: Synthetic oligonucleotide
ucugcuuggccuguggga

SEQ ID NO: 135304 - RNA, 18 nt, Artificial Sequence
  Description of Artificial Sequence: Synthetic oligonucleotide
aagacucugcuuggccug

SEQ ID NO: 135305 - RNA, 18 nt, Artificial Sequence
  Description of Artificial Sequence: Synthetic oligonucleotide
aggugaagacucugcuug

SEQ ID NO: 135306 - RNA, 18 nt, Artificial Sequence
  Description of Artificial Sequence: Synthetic oligonucleotide
agugaaggugaagacucu

SEQ ID NO: 135307 - RNA, 18 nt, Artificial Sequence
  Description of Artificial Sequence: Synthetic oligonucleotide
cccucagugaaggugaag

SEQ ID NO: 135308 - RNA, 18 nt, Artificial Sequence
  Description of Artificial Sequence: Synthetic oligonucleotide
gcaggcccucagugaagg

SEQ ID NO: 135309 - RNA, 18 nt, Artificial Sequence
  Description of Artificial Sequence: Synthetic oligonucleotide
ugaucgcaggcccucagu

SEQ ID NO: 135310 - RNA, 18 nt, Artificial Sequence
  Description of Artificial Sequence: Synthetic oligonucleotide
ugagcugaucgcaggccc

SEQ ID NO: 135311 - RNA, 18 nt, Artificial Sequence
  Description of Artificial Sequence: Synthetic oligonucleotide
ggagcugagcugaucgca

SEQ ID NO: 135312 - RNA, 18 nt, Artificial Sequence
  Description of Artificial Sequence: Synthetic oligonucleotide
cucucggagcugagcuga

SEQ ID NO: 135313 - RNA, 18 nt, Artificial Sequence
  Description of Artificial Sequence: Synthetic oligonucleotide
cuguucucucggagcuga

SEQ ID NO: 135314 - RNA, 18 nt, Artificial Sequence
  Description of Artificial Sequence: Synthetic oligonucleotide
cugcucuguucucucgga

SEQ ID NO: 135315 - RNA, 18 nt, Artificial Sequence
  Description of Artificial Sequence: Synthetic oligonucleotide
agccacugcucuguucuc

SEQ ID NO: 135316 - RNA, 18 nt, Artificial Sequence
  Description of Artificial Sequence: Synthetic oligonucleotide
cacugagccacugcucug

SEQ ID NO: 135317 - RNA, 18 nt, Artificial Sequence
  Description of Artificial Sequence: Synthetic oligonucleotide
cucuccacugagccacug

SEQ ID NO: 135318 - RNA, 18 nt, Artificial Sequence
  Description of Artificial Sequence: Synthetic oligonucleotide
caccucucuccacugagc

SEQ ID NO: 135319 - RNA, 18 nt, Artificial Sequence
  Description of Artificial Sequence: Synthetic oligonucleotide
uuugccaccucucuccac

SEQ ID NO: 135320 - RNA, 18 nt, Artificial Sequence
  Description of Artificial Sequence: Synthetic oligonucleotide
cccacuuugccaccucuc

SEQ ID NO: 135321 - RNA, 18 nt, Artificial Sequence
  Description of Artificial Sequence: Synthetic oligonucleotide
ugggccccacuuugccac

SEQ ID NO: 135322 - RNA, 18 nt, Artificial Sequence
  Description of Artificial Sequence: Synthetic oligonucleotide
agggcugggccccacuuu

SEQ ID NO: 135323 - RNA, 18 nt, Artificial Sequence
  Description of Artificial Sequence: Synthetic oligonucleotide
agggaagggcugggcccc

SEQ ID NO: 135324 - RNA, 18 nt, Artificial Sequence
  Description of Artificial Sequence: Synthetic oligonucleotide
cagcaagggaagggcugg

SEQ ID NO: 135325 - RNA, 18 nt, Artificial Sequence
  Description of Artificial Sequence: Synthetic oligonucleotide
ucacucagcaagggaagg

SEQ ID NO: 135326 - RNA, 18 nt, Artificial Sequence
  Description of Artificial Sequence: Synthetic oligonucleotide
caaggucacucagcaagg

SEQ ID NO: 135327 - RNA, 18 nt, Artificial Sequence
  Description of Artificial Sequence: Synthetic oligonucleotide
uugcccaaggucacucag

SEQ ID NO: 135328 - RNA, 18 nt, Artificial Sequence
  Description of Artificial Sequence: Synthetic oligonucleotide
gugacuugcccaagguca

SEQ ID NO: 135329 - RNA, 18 nt, Artificial Sequence
  Description of Artificial Sequence: Synthetic oligonucleotide
gugcugugacuugcccaa

SEQ ID NO: 135330 - RNA, 18 nt, Artificial Sequence
  Description of Artificial Sequence: Synthetic oligonucleotide
gagaggugcugugacuug

SEQ ID NO: 135331 - RNA, 18 nt, Artificial Sequence
  Description of Artificial Sequence: Synthetic oligonucleotide
gcucagagaggugcugug

SEQ ID NO: 135332 - RNA, 18 nt, Artificial Sequence
  Description of Artificial Sequence: Synthetic oligonucleotide
gaagggcugggccccacu

SEQ ID NO: 135333 - RNA, 18 nt, Artificial Sequence
  Description of Artificial Sequence: Synthetic oligonucleotide
caagggaagggcugggcc

SEQ ID NO: 135334 - RNA, 18 nt, Artificial Sequence
  Description of Artificial Sequence: Synthetic oligonucleotide
cucagcaagggaagggcu

SEQ ID NO: 135335 - RNA, 18 nt, Artificial Sequence
  Description of Artificial Sequence: Synthetic oligonucleotide
ggucacucagcaagggaa

SEQ ID NO: 135336 - RNA, 18 nt, Artificial Sequence
  Description of Artificial Sequence: Synthetic oligonucleotide
cccaaggucacucagcaa

SEQ ID NO: 135337 - RNA, 18 nt, Artificial Sequence
  Description of Artificial Sequence: Synthetic oligonucleotide
acuugcccaaggucacuc

SEQ ID NO: 135338 - RNA, 18 nt, Artificial Sequence
  Description of Artificial Sequence: Synthetic oligonucleotide
cugugacuugcccaaggu

SEQ ID NO: 135339 - RNA, 18 nt, Artificial Sequence
  Description of Artificial Sequence: Synthetic oligonucleotide
aggugcugugacuugccc

SEQ ID NO: 135340 - RNA, 18 nt, Artificial Sequence
  Description of Artificial Sequence: Synthetic oligonucleotide
cagagaggugcugugacu

SEQ ID NO: 135341 - RNA, 18 nt, Artificial Sequence
  Description of Artificial Sequence: Synthetic oligonucleotide
uggcucagagaggugcug

SEQ ID NO: 135342 - RNA, 18 nt, Artificial Sequence
  Description of Artificial Sequence: Synthetic oligonucleotide
aaccauggcucagagagg

SEQ ID NO: 135343 - RNA, 18 nt, Artificial Sequence
  Description of Artificial Sequence: Synthetic oligonucleotide
gaggcaaccauggcucag

SEQ ID NO: 135344 - RNA, 18 nt, Artificial Sequence
  Description of Artificial Sequence: Synthetic oligonucleotide
acaaugaggcaaccaugg

SEQ ID NO: 135345 - RNA, 18 nt, Artificial Sequence
  Description of Artificial Sequence: Synthetic oligonucleotide
uucugacaaugaggcaac

SEQ ID NO: 135346 - RNA, 18 nt, Artificial Sequence
  Description of Artificial Sequence: Synthetic oligonucleotide
uccuuuucugacaaugag

SEQ ID NO: 135347 - RNA, 18 nt, Artificial Sequence
  Description of Artificial Sequence: Synthetic oligonucleotide
caucauccuuuucugaca

SEQ ID NO: 135348 - RNA, 18 nt, Artificial Sequence
  Description of Artificial Sequence: Synthetic oligonucleotide
aaaaucaucauccuuuuc

SEQ ID NO: 135349 - RNA, 18 nt, Artificial Sequence
  Description of Artificial Sequence: Synthetic oligonucleotide
ggcaaaaaaucaucaucc

SEQ ID NO: 135350 - RNA, 18 nt, Artificial Sequence
  Description of Artificial Sequence: Synthetic oligonucleotide
agcagggcaaaaaaucau

SEQ ID NO: 135351 - RNA, 18 nt, Artificial Sequence
  Description of Artificial Sequence: Synthetic oligonucleotide
ggagaagcagggcaaaaa

SEQ ID NO: 135352 - RNA, 18 nt, Artificial Sequence
  Description of Artificial Sequence: Synthetic oligonucleotide
uuagaggagaagcagggc

SEQ ID NO: 135353 - RNA, 18 nt, Artificial Sequence
  Description of Artificial Sequence: Synthetic oligonucleotide
cagccuuagaggagaagc

SEQ ID NO: 135354 - RNA, 18 nt, Artificial Sequence
  Description of Artificial Sequence: Synthetic oligonucleotide
ucugucagccuuagagga

SEQ ID NO: 135355 - RNA, 18 nt, Artificial Sequence
  Description of Artificial Sequence: Synthetic oligonucleotide
aggagucugucagccuua

SEQ ID NO: 135356 - RNA, 18 nt, Artificial Sequence
  Description of Artificial Sequence: Synthetic oligonucleotide
ccccaaggagucugucag

SEQ ID NO: 135357 - RNA, 18 nt, Artificial Sequence
  Description of Artificial Sequence: Synthetic oligonucleotide
uagagccccaaggagucu

SEQ ID NO: 135358 - RNA, 18 nt, Artificial Sequence
  Description of Artificial Sequence: Synthetic oligonucleotide
agcuuuagagccccaagg

SEQ ID NO: 135359 - RNA, 18 nt, Artificial Sequence
  Description of Artificial Sequence: Synthetic oligonucleotide
cugucagcuuuagagccc

SEQ ID NO: 135360 - RNA, 18 nt, Artificial Sequence
  Description of Artificial Sequence: Synthetic oligonucleotide
cuccucugucagcuuuag

SEQ ID NO: 135361 - RNA, 18 nt, Artificial Sequence
  Description of Artificial Sequence: Synthetic oligonucleotide
gcccccuccucugucagc

SEQ ID NO: 135362 - RNA, 18 nt, Artificial Sequence
  Description of Artificial Sequence: Synthetic oligonucleotide
ccccugcccccuccucug

SEQ ID NO: 135363 - RNA, 18 nt, Artificial Sequence
  Description of Artificial Sequence: Synthetic oligonucleotide
ccugcccccugcccccuc

SEQ ID NO: 135364 - RNA, 18 nt, Artificial Sequence
  Description of Artificial Sequence: Synthetic oligonucleotide
uguuaccugcccccugcc

SEQ ID NO: 135365 - RNA, 18 nt, Artificial Sequence
  Description of Artificial Sequence: Synthetic oligonucleotide
ucaccuguuaccugcccc

SEQ ID NO: 135366 - RNA, 18 nt, Artificial Sequence
  Description of Artificial Sequence: Synthetic oligonucleotide
ugccuucaccuguuaccu

SEQ ID NO: 135367 - RNA, 18 nt, Artificial Sequence
  Description of Artificial Sequence: Synthetic oligonucleotide
cucugugccuucaccugu

SEQ ID NO: 135368 - RNA, 18 nt, Artificial Sequence
  Description of Artificial Sequence: Synthetic oligonucleotide
gcucccucugugccuuca

SEQ ID NO: 135369 - RNA, 18 nt, Artificial Sequence
  Description of Artificial Sequence: Synthetic oligonucleotide
gaagggcucccucugugc

SEQ ID NO: 135370 - RNA, 18 nt, Artificial Sequence
  Description of Artificial Sequence: Synthetic oligonucleotide
agggagaagggcucccuc

SEQ ID NO: 135371 - RNA, 18 nt, Artificial Sequence
  Description of Artificial Sequence: Synthetic oligonucleotide
ggaugagggagaagggcu

SEQ ID NO: 135372 - RNA, 18 nt, Artificial Sequence
  Description of Artificial Sequence: Synthetic oligonucleotide
ggcagggaugagggagaa

SEQ ID NO: 135373 - RNA, 18 nt, Artificial Sequence
  Description of Artificial Sequence: Synthetic oligonucleotide
gaggaggcagggaugagg

SEQ ID NO: 135374 - RNA, 18 nt, Artificial Sequence
  Description of Artificial Sequence: Synthetic oligonucleotide
ggagggaggaggcaggga

SEQ ID NO: 135375 - RNA, 18 nt, Artificial Sequence
  Description of Artificial Sequence: Synthetic oligonucleotide
cggagggagggaggaggc

SEQ ID NO: 135376 - RNA, 18 nt, Artificial Sequence
  Description of Artificial Sequence: Synthetic oligonucleotide
aaaaacggagggagggag

SEQ ID NO: 135377 - RNA, 18 nt, Artificial Sequence
  Description of Artificial Sequence: Synthetic oligonucleotide
aggguaaaaacggaggga

SEQ ID NO: 135378 - RNA, 18 nt, Artificial Sequence
  Description of Artificial Sequence: Synthetic oligonucleotide
agcucaggguaaaaacgg

SEQ ID NO: 135379 - RNA, 18 nt, Artificial Sequence
  Description of Artificial Sequence: Synthetic oligonucleotide
aaggaagcucaggguaaa

SEQ ID NO: 135380 - RNA, 18 nt, Artificial Sequence
  Description of Artificial Sequence: Synthetic oligonucleotide
cucugaaggaagcucagg

SEQ ID NO: 135381 - RNA, 18 nt, Artificial Sequence
  Description of Artificial Sequence: Synthetic oligonucleotide
uccagcucugaaggaagc

SEQ ID NO: 135382 - RNA, 18 nt, Artificial Sequence
  Description of Artificial Sequence: Synthetic oligonucleotide
ugcccuccagcucugaag

SEQ ID NO: 135383 - RNA, 18 nt, Artificial Sequence
  Description of Artificial Sequence: Synthetic oligonucleotide
gugggugcccuccagcuc

SEQ ID NO: 135384 - RNA, 18 nt, Artificial Sequence
  Description of Artificial Sequence: Synthetic oligonucleotide
ggauagugggugcccucc

SEQ ID NO: 135385 - RNA, 18 nt, Artificial Sequence
  Description of Artificial Sequence: Synthetic oligonucleotide
gggcuggauagugggugc

SEQ ID NO: 135386 - RNA, 18 nt, Artificial Sequence
  Description of Artificial Sequence: Synthetic oligonucleotide
ccuggaaucagauguggg

SEQ ID NO: 135387 - RNA, 18 nt, Artificial Sequence
  Description of Artificial Sequence: Synthetic oligonucleotide
ccucccuggaaucagaug

SEQ ID NO: 135388 - RNA, 18 nt, Artificial Sequence
  Description of Artificial Sequence: Synthetic oligonucleotide
agcccccucccuggaauc

SEQ ID NO: 135389 - RNA, 18 nt, Artificial Sequence
  Description of Artificial Sequence: Synthetic oligonucleotide
cacagagcccccucccug

SEQ ID NO: 135390 - RNA, 18 nt, Artificial Sequence
  Description of Artificial Sequence: Synthetic oligonucleotide
cccugcacagagcccccu

SEQ ID NO: 135391 - RNA, 18 nt, Artificial Sequence
  Description of Artificial Sequence: Synthetic oligonucleotide
cuguccccugcacagagc

SEQ ID NO: 135392 - RNA, 18 nt, Artificial Sequence
  Description of Artificial Sequence: Synthetic oligonucleotide
acucucuguccccugcac

SEQ ID NO: 135393 - RNA, 18 nt, Artificial Sequence
  Description of Artificial Sequence: Synthetic oligonucleotide
cccgcacucucugucccc

SEQ ID NO: 135394 - RNA, 18 nt, Artificial Sequence
  Description of Artificial Sequence: Synthetic oligonucleotide
gcccucccgcacucucug

SEQ ID NO: 135395 - RNA, 18 nt, Artificial Sequence
  Description of Artificial Sequence: Synthetic oligonucleotide
uccgggcccucccgcacu

SEQ ID NO: 135396 - RNA, 18 nt, Artificial Sequence
  Description of Artificial Sequence: Synthetic oligonucleotide
agauguccgggcccuccc

SEQ ID NO: 135397 - RNA, 18 nt, Artificial Sequence
  Description of Artificial Sequence: Synthetic oligonucleotide
gcuggagauguccgggcc

SEQ ID NO: 135398 - RNA, 18 nt, Artificial Sequence
  Description of Artificial Sequence: Synthetic oligonucleotide
aaaaugcuggagaugucc

SEQ ID NO: 135399 - RNA, 18 nt, Artificial Sequence
  Description of Artificial Sequence: Synthetic oligonucleotide
ggaagaaaaugcuggaga

SEQ ID NO: 135400 - RNA, 18 nt, Artificial Sequence
  Description of Artificial Sequence: Synthetic oligonucleotide
ccguugaucccggagacg

SEQ ID NO: 135401 - RNA, 18 nt, Artificial Sequence
  Description of Artificial Sequence: Synthetic oligonucleotide
ugucgccguugaucccgg

SEQ ID NO: 135402 - RNA, 18 nt, Artificial Sequence
  Description of Artificial Sequence: Synthetic oligonucleotide
ccgaaugucgccguugau

SEQ ID NO: 135403 - RNA, 18 nt, Artificial Sequence
  Description of Artificial Sequence: Synthetic oligonucleotide
uucgcccgaaugucgccg

SEQ ID NO: 135404 - RNA, 18 nt, Artificial Sequence
  Description of Artificial Sequence: Synthetic oligonucleotide
ucuucuucgcccgaaugu

SEQ ID NO: 135405 - RNA, 18 nt, Artificial Sequence
  Description of Artificial Sequence: Synthetic oligonucleotide
ggcaaucuucuucgcccg

SEQ ID NO: 135406 - RNA, 18 nt, Artificial Sequence
  Description of Artificial Sequence: Synthetic oligonucleotide
augcuggcaaucuucuuc

SEQ ID NO: 135407 - RNA, 18 nt, Artificial Sequence
  Description of Artificial Sequence: Synthetic oligonucleotide
cugcgaugcuggcaaucu

SEQ ID NO: 135408 - RNA, 18 nt, Artificial Sequence
  Description of Artificial Sequence: Synthetic oligonucleotide
cacaucugcgaugcuggc

SEQ ID NO: 135409 - RNA, 18 nt, Artificial Sequence
  Description of Artificial Sequence: Synthetic oligonucleotide
ucacacacaucugcgaug

SEQ ID NO: 135410 - RNA, 18 nt, Artificial Sequence
  Description of Artificial Sequence: Synthetic oligonucleotide
uggacucacacacaucug

SEQ ID NO: 135411 - RNA, 18 nt, Artificial Sequence
  Description of Artificial Sequence: Synthetic oligonucleotide
cuucauggacucacacac

SEQ ID NO: 135412 - RNA, 18 nt, Artificial Sequence
  Description of Artificial Sequence: Synthetic oligonucleotide
ugcuccuucauggacuca

SEQ ID NO: 135413 - RNA, 18 nt, Artificial Sequence
  Description of Artificial Sequence: Synthetic oligonucleotide
gcagcugcuccuucaugg

SEQ ID NO: 135414 - RNA, 18 nt, Artificial Sequence
  Description of Artificial Sequence: Synthetic oligonucleotide
aaccagcagcugcuccuu

SEQ ID NO: 135415 - RNA, 18 nt, Artificial Sequence
  Description of Artificial Sequence: Synthetic oligonucleotide
acgagaaccagcagcugc

SEQ ID NO: 135416 - RNA, 18 nt, Artificial Sequence
  Description of Artificial Sequence: Synthetic oligonucleotide
acucaacgagaaccagca

SEQ ID NO: 135417 - RNA, 18 nt, Artificial Sequence
  Description of Artificial Sequence: Synthetic oligonucleotide
ggcccacucaacgagaac

SEQ ID NO: 135418 - RNA, 18 nt, Artificial Sequence
  Description of Artificial Sequence: Synthetic oligonucleotide
uacuuggcccacucaacg

SEQ ID NO: 135419 - RNA, 18 nt, Artificial Sequence
  Description of Artificial Sequence: Synthetic oligonucleotide
ggauguacuuggcccacu

SEQ ID NO: 135420 - RNA, 18 nt, Artificial Sequence
  Description of Artificial Sequence: Synthetic oligonucleotide
agcugggauguacuuggc

SEQ ID NO: 135421 - RNA, 18 nt, Artificial Sequence
  Description of Artificial Sequence: Synthetic oligonucleotide
cagaaagcugggauguac

SEQ ID NO: 135422 - RNA, 18 nt, Artificial Sequence
  Description of Artificial Sequence: Synthetic oligonucleotide
gcucgcagaaagcuggga

SEQ ID NO: 135423 - RNA, 18 nt, Artificial Sequence
  Description of Artificial Sequence: Synthetic oligonucleotide
gggagcucgcagaaagcu

SEQ ID NO: 135424 - RNA, 18 nt, Artificial Sequence
  Description of Artificial Sequence: Synthetic oligonucleotide
guugaucccggagacggg

SEQ ID NO: 135425 - RNA, 18 nt, Artificial Sequence
  Description of Artificial Sequence: Synthetic oligonucleotide
cguugaucccggagacgg

SEQ ID NO: 135426 - RNA, 18 nt, Artificial Sequence
  Description of Artificial Sequence: Synthetic oligonucleotide
gucgccguugaucccgga

SEQ ID NO: 135427 - RNA, 18 nt, Artificial Sequence
  Description of Artificial Sequence: Synthetic oligonucleotide
cgaaugucgccguugauc

SEQ ID NO: 135428 - RNA, 18 nt, Artificial Sequence
  Description of Artificial Sequence: Synthetic oligonucleotide
ucgcccgaaugucgccgu

SEQ ID NO: 135429 - RNA, 18 nt, Artificial Sequence
  Description of Artificial Sequence: Synthetic oligonucleotide
cuucuucgcccgaauguc

SEQ ID NO: 135430 - RNA, 18 nt, Artificial Sequence
  Description of Artificial Sequence: Synthetic oligonucleotide
gcaaucuucuucgcccga

SEQ ID NO: 135431 - RNA, 18 nt, Artificial Sequence
  Description of Artificial Sequence: Synthetic oligonucleotide
ugcuggcaaucuucuucg

SEQ ID NO: 135432 - RNA, 18 nt, Artificial Sequence
  Description of Artificial Sequence: Synthetic oligonucleotide
ugcgaugcuggcaaucuu

SEQ ID NO: 135433 - RNA, 18 nt, Artificial Sequence
  Description of Artificial Sequence: Synthetic oligonucleotide
acaucugcgaugcuggca

SEQ ID NO: 135434 - RNA, 18 nt, Artificial Sequence
  Description of Artificial Sequence: Synthetic oligonucleotide
cacacacaucugcgaugc

SEQ ID NO: 135435 - RNA, 18 nt, Artificial Sequence
  Description of Artificial Sequence: Synthetic oligonucleotide
ggacucacacacaucugc

SEQ ID NO: 135436 - RNA, 18 nt, Artificial Sequence
  Description of Artificial Sequence: Synthetic oligonucleotide
uucauggacucacacaca

SEQ ID NO: 135437 - RNA, 18 nt, Artificial Sequence
  Description of Artificial Sequence: Synthetic oligonucleotide
gcuccuucauggacucac

SEQ ID NO: 135438 - RNA, 18 nt, Artificial Sequence
  Description of Artificial Sequence: Synthetic oligonucleotide
cagcugcuccuucaugga

SEQ ID NO: 135439 - RNA, 18 nt, Artificial Sequence
  Description of Artificial Sequence: Synthetic oligonucleotide
accagcagcugcuccuuc

SEQ ID NO: 135440 - RNA, 18 nt, Artificial Sequence
  Description of Artificial Sequence: Synthetic oligonucleotide
cgagaaccagcagcugcu

SEQ ID NO: 135441 - RNA, 18 nt, Artificial Sequence
  Description of Artificial Sequence: Synthetic oligonucleotide
cucaacgagaaccagcag

SEQ ID NO: 135442 - RNA, 18 nt, Artificial Sequence
  Description of Artificial Sequence: Synthetic oligonucleotide
gcccacucaacgagaacc

SEQ ID NO: 135443 - RNA, 18 nt, Artificial Sequence
  Description of Artificial Sequence: Synthetic oligonucleotide
acuuggcccacucaacga

SEQ ID NO: 135444 - RNA, 18 nt, Artificial Sequence
  Description of Artificial Sequence: Synthetic oligonucleotide
gauguacuuggcccacuc

SEQ ID NO: 135445 - RNA, 18 nt, Artificial Sequence
  Description of Artificial Sequence: Synthetic oligonucleotide
gcugggauguacuuggcc

SEQ ID NO: 135446 - RNA, 18 nt, Artificial Sequence
  Description of Artificial Sequence: Synthetic oligonucleotide
agaaagcugggauguacu

SEQ ID NO: 135447 - RNA, 18 nt, Artificial Sequence
  Description of Artificial Sequence: Synthetic oligonucleotide
cucgcagaaagcugggau

SEQ ID NO: 135448 - RNA, 18 nt, Artificial Sequence
  Description of Artificial Sequence: Synthetic oligonucleotide
gggagcucgcagaaagcu

SEQ ID NO: 135449 - RNA, 18 nt, Artificial Sequence
  Description of Artificial Sequence: Synthetic oligonucleotide
ccaccauccacgcccauc

SEQ ID NO: 135450 - RNA, 18 nt, Artificial Sequence
  Description of Artificial Sequence: Synthetic oligonucleotide
acugcccaccauccacgc

SEQ ID NO: 135451 - RNA, 18 nt, Artificial Sequence
  Description of Artificial Sequence: Synthetic oligonucleotide
ccacuacugcccaccauc

SEQ ID NO: 135452 - RNA, 18 nt, Artificial Sequence
  Description of Artificial Sequence: Synthetic oligonucleotide
acugcccacuacugccca

SEQ ID NO: 135453 - RNA, 18 nt, Artificial Sequence
  Description of Artificial Sequence: Synthetic oligonucleotide
cgcccacugcccacuacu

SEQ ID NO: 135454 - RNA, 18 nt, Artificial Sequence
  Description of Artificial Sequence: Synthetic oligonucleotide
ugccccgcccacugccca

SEQ ID NO: 135455 - RNA, 18 nt, Artificial Sequence
  Description of Artificial Sequence: Synthetic oligonucleotide
cuggcugccccgcccacu

SEQ ID NO: 135456 - RNA, 18 nt, Artificial Sequence
  Description of Artificial Sequence: Synthetic oligonucleotide
gcccccuggcugccccgc

SEQ ID NO: 135457 - RNA, 18 nt, Artificial Sequence
  Description of Artificial Sequence: Synthetic oligonucleotide
cagcagcccccuggcugc

SEQ ID NO: 135458 - RNA, 18 nt, Artificial Sequence
  Description of Artificial Sequence: Synthetic oligonucleotide
ugggccagcagcccccug

SEQ ID NO: 135459 - RNA, 18 nt, Artificial Sequence
  Description of Artificial Sequence: Synthetic oligonucleotide
ccaggugggccagcagcc

SEQ ID NO: 135460 - RNA, 18 nt, Artificial Sequence
  Description of Artificial Sequence: Synthetic oligonucleotide
auaucccaggugggccag

SEQ ID NO: 135461 - RNA, 18 nt, Artificial Sequence
  Description of Artificial Sequence: Synthetic oligonucleotide
cggcuauaucccaggugg

SEQ ID NO: 135462 - RNA, 18 nt, Artificial Sequence
  Description of Artificial Sequence: Synthetic oligonucleotide
guccacggcuauauccca

SEQ ID NO: 135463 - RNA, 18 nt, Artificial Sequence
  Description of Artificial Sequence: Synthetic oligonucleotide
agccaguccacggcuaua

SEQ ID NO: 135464 - RNA, 18 nt, Artificial Sequence
  Description of Artificial Sequence: Synthetic oligonucleotide
aaucaagccaguccacgg

SEQ ID NO: 135465 - RNA, 18 nt, Artificial Sequence
  Description of Artificial Sequence: Synthetic oligonucleotide
aauaaaaucaagccaguc

SEQ ID NO: 135466 - RNA, 18 nt, Artificial Sequence
  Description of Artificial Sequence: Synthetic oligonucleotide
aauaaaauaaaaucaagc

SEQ ID NO: 135467 - RNA, 18 nt, Artificial Sequence
  Description of Artificial Sequence: Synthetic oligonucleotide
uguuaaauaaaauaaaau

SEQ ID NO: 135468 - RNA, 18 nt, Artificial Sequence
  Description of Artificial Sequence: Synthetic oligonucleotide
uauuuuguuaaauaaaau

SEQ ID NO: 135469 - RNA, 18 nt, Artificial Sequence
  Description of Artificial Sequence: Synthetic oligonucleotide
cuacauauuuuguuaaau

SEQ ID NO: 135470 - RNA, 18 nt, Artificial Sequence
  Description of Artificial Sequence: Synthetic oligonucleotide
gugcacuacauauuuugu

SEQ ID NO: 135471 - RNA, 18 nt, Artificial Sequence
  Description of Artificial Sequence: Synthetic oligonucleotide
cgugugugcacuacauau

SEQ ID NO: 135472 - RNA, 18 nt, Artificial Sequence
  Description of Artificial Sequence: Synthetic oligonucleotide
agacacgugugugcacua

SEQ ID NO: 135473 - RNA, 18 nt, Artificial Sequence
  Description of Artificial Sequence: Synthetic oligonucleotide
guuucagacacgugugug

SEQ ID NO: 135474 - RNA, 18 nt, Artificial Sequence
  Description of Artificial Sequence: Synthetic oligonucleotide
uuaaaguuucagacacgu

SEQ ID NO: 135475 - RNA, 18 nt, Artificial Sequence
  Description of Artificial Sequence: Synthetic oligonucleotide
gugauuuaaaguuucaga

SEQ ID NO: 135476 - RNA, 18 nt, Artificial Sequence
  Description of Artificial Sequence: Synthetic oligonucleotide
guaaggugauuuaaaguu

SEQ ID NO: 135477 - RNA, 18 nt, Artificial Sequence
  Description of Artificial Sequence: Synthetic oligonucleotide
uauuuguaaggugauuua

SEQ ID NO: 135478 - RNA, 18 nt, Artificial Sequence
  Description of Artificial Sequence: Synthetic oligonucleotide
guuaauauuuguaaggug

SEQ ID NO: 135479 - RNA, 18 nt, Artificial Sequence
  Description of Artificial Sequence: Synthetic oligonucleotide
acugaguuaauauuugua

SEQ ID NO: 135480 - RNA, 18 nt, Artificial Sequence
  Description of Artificial Sequence: Synthetic oligonucleotide
agcuaacugaguuaauau

SEQ ID NO: 135481 - RNA, 18 nt, Artificial Sequence
  Description of Artificial Sequence: Synthetic oligonucleotide
ggaggagcuaacugaguu

SEQ ID NO: 135482 - RNA, 18 nt, Artificial Sequence
  Description of Artificial Sequence: Synthetic oligonucleotide
uuguuggaggagcuaacu

SEQ ID NO: 135483 - RNA, 18 nt, Artificial Sequence
  Description of Artificial Sequence: Synthetic oligonucleotide
uagaguuguuggaggagc

SEQ ID NO: 135484 - RNA, 18 nt, Artificial Sequence
  Description of Artificial Sequence: Synthetic oligonucleotide
ccucauagaguuguugga

SEQ ID NO: 135485 - RNA, 18 nt, Artificial Sequence
  Description of Artificial Sequence: Synthetic oligonucleotide
accuaccucauagaguug

SEQ ID NO: 135486 - RNA, 18 nt, Artificial Sequence
  Description of Artificial Sequence: Synthetic oligonucleotide
uuaguaccuaccucauag

SEQ ID NO: 135487 - RNA, 18 nt, Artificial Sequence
  Description of Artificial Sequence: Synthetic oligonucleotide
guaccuuaguaccuaccu

SEQ ID NO: 135488 - RNA, 18 nt, Artificial Sequence
  Description of Artificial Sequence: Synthetic oligonucleotide
uaauaguaccuuaguacc

SEQ ID NO: 135489 - RNA, 18 nt, Artificial Sequence
  Description of Artificial Sequence: Synthetic oligonucleotide
aguaauaauaguaccuua

SEQ ID NO: 135490 - RNA, 18 nt, Artificial Sequence
  Description of Artificial Sequence: Synthetic oligonucleotide
auggcaguaauaauagua

SEQ ID NO: 135491 - RNA, 18 nt, Artificial Sequence
  Description of Artificial Sequence: Synthetic oligonucleotide
augagauggcaguaauaa

SEQ ID NO: 135492 - RNA, 18 nt, Artificial Sequence
  Description of Artificial Sequence: Synthetic oligonucleotide
caccuaugagauggcagu

SEQ ID NO: 135493 - RNA, 18 nt, Artificial Sequence
  Description of Artificial Sequence: Synthetic oligonucleotide
cuccucaccuaugagaug

SEQ ID NO: 135494 - RNA, 18 nt, Artificial Sequence
  Description of Artificial Sequence: Synthetic oligonucleotide
ccaaucuccucaccuaug

SEQ ID NO: 135495 - RNA, 18 nt, Artificial Sequence
  Description of Artificial Sequence: Synthetic oligonucleotide
gugccccaaucuccucac

SEQ ID NO: 135496 - RNA, 18 nt, Artificial Sequence
  Description of Artificial Sequence: Synthetic oligonucleotide
ucucugugccccaaucuc

SEQ ID NO: 135497 - RNA, 18 nt, Artificial Sequence
  Description of Artificial Sequence: Synthetic oligonucleotide
uaaccucucugugcccca

SEQ ID NO: 135498 - RNA, 18 nt, Artificial Sequence
  Description of Artificial Sequence: Synthetic oligonucleotide
uuacuuaaccucucugug

SEQ ID NO: 135499 - RNA, 18 nt, Artificial Sequence
  Description of Artificial Sequence: Synthetic oligonucleotide
gcagguuacuuaaccucu

SEQ ID NO: 135500 - RNA, 18 nt, Artificial Sequence
  Description of Artificial Sequence: Synthetic oligonucleotide
cuugagcagguuacuuaa

SEQ ID NO: 135501 - RNA, 18 nt, Artificial Sequence
  Description of Artificial Sequence: Synthetic oligonucleotide
gugaccuugagcagguua

SEQ ID NO: 135502 - RNA, 18 nt, Artificial Sequence
  Description of Artificial Sequence: Synthetic oligonucleotide
gcuaugugaccuugagca

SEQ ID NO: 135503 - RNA, 18 nt, Artificial Sequence
  Description of Artificial Sequence: Synthetic oligonucleotide
uaguagcuaugugaccuu

SEQ ID NO: 135504 - RNA, 18 nt, Artificial Sequence
  Description of Artificial Sequence: Synthetic oligonucleotide
cuggauaguagcuaugug

SEQ ID NO: 135505 - RNA, 18 nt, Artificial Sequence
  Description of Artificial Sequence: Synthetic oligonucleotide
cuaugcuggauaguagcu

SEQ ID NO: 135506 - RNA, 18 nt, Artificial Sequence
  Description of Artificial Sequence: Synthetic oligonucleotide
cccagcuaugcuggauag

SEQ ID NO: 135507 - RNA, 18 nt, Artificial Sequence
  Description of Artificial Sequence: Synthetic oligonucleotide
cuaaucccagcuaugcug

SEQ ID NO: 135508 - RNA, 18 nt, Artificial Sequence
  Description of Artificial Sequence: Synthetic oligonucleotide
agguucuaaucccagcua

SEQ ID NO: 135509 - RNA, 18 nt, Artificial Sequence
  Description of Artificial Sequence: Synthetic oligonucleotide
cugccagguucuaauccc

SEQ ID NO: 135510 - RNA, 18 nt, Artificial Sequence
  Description of Artificial Sequence: Synthetic oligonucleotide
gcuuccugccagguucua

SEQ ID NO: 135511 - RNA, 18 nt, Artificial Sequence
  Description of Artificial Sequence: Synthetic oligonucleotide
uuggagcuuccugccagg

SEQ ID NO: 135512 - RNA, 18 nt, Artificial Sequence
  Description of Artificial Sequence: Synthetic oligonucleotide
ggacuuuggagcuuccug

SEQ ID NO: 135513 - RNA, 18 nt, Artificial Sequence
  Description of Artificial Sequence: Synthetic oligonucleotide
agcuuggacuuuggagcu

SEQ ID NO: 135514 - RNA, 18 nt, Artificial Sequence
  Description of Artificial Sequence: Synthetic oligonucleotide
ucaggagcuuggacuuug

SEQ ID NO: 135515 - RNA, 18 nt, Artificial Sequence
  Description of Artificial Sequence: Synthetic oligonucleotide
aauggucaggagcuugga

SEQ ID NO: 135516 - RNA, 18 nt, Artificial Sequence
  Description of Artificial Sequence: Synthetic oligonucleotide
gguacaauggucaggagc

SEQ ID NO: 135517 - RNA, 18 nt, Artificial Sequence
  Description of Artificial Sequence: Synthetic oligonucleotide
ccucagguacaaugguca

SEQ ID NO: 135518 - RNA, 18 nt, Artificial Sequence
  Description of Artificial Sequence: Synthetic oligonucleotide
gagagccucagguacaau

SEQ ID NO: 135519 - RNA, 18 nt, Artificial Sequence
  Description of Artificial Sequence: Synthetic oligonucleotide
ccugggagagccucaggu

SEQ ID NO: 135520 - RNA, 18 nt, Artificial Sequence
  Description of Artificial Sequence: Synthetic oligonucleotide
aucccccugggagagccu

SEQ ID NO: 135521 - RNA, 18 nt, Artificial Sequence
  Description of Artificial Sequence: Synthetic oligonucleotide
ucaacaucccccugggag

SEQ ID NO: 135522 - RNA, 18 nt, Artificial Sequence
  Description of Artificial Sequence: Synthetic oligonucleotide
cccugucaacaucccccu

SEQ ID NO: 135523 - RNA, 18 nt, Artificial Sequence
  Description of Artificial Sequence: Synthetic oligonucleotide
agggucccugucaacauc

SEQ ID NO: 135524 - RNA, 18 nt, Artificial Sequence
  Description of Artificial Sequence: Synthetic oligonucleotide
guccuagggucccuguca

SEQ ID NO: 135525 - RNA, 18 nt, Artificial Sequence
  Description of Artificial Sequence: Synthetic oligonucleotide
ucccuguccuaggguccc

SEQ ID NO: 135526 - RNA, 18 nt, Artificial Sequence
  Description of Artificial Sequence: Synthetic oligonucleotide
ccugaucccuguccuagg

SEQ ID NO: 135527 - RNA, 18 nt, Artificial Sequence
  Description of Artificial Sequence: Synthetic oligonucleotide
aaucuccugaucccuguc

SEQ ID NO: 135528 - RNA, 18 nt, Artificial Sequence
  Description of Artificial Sequence: Synthetic oligonucleotide
gccaaaaucuccugaucc

SEQ ID NO: 135529 - RNA, 18 nt, Artificial Sequence
  Description of Artificial Sequence: Synthetic oligonucleotide
cuuaagccaaaaucuccu

SEQ ID NO: 135530 - RNA, 18 nt, Artificial Sequence
  Description of Artificial Sequence: Synthetic oligonucleotide
cauagcuuaagccaaaau

SEQ ID NO: 135531 - RNA, 18 nt, Artificial Sequence
  Description of Artificial Sequence: Synthetic oligonucleotide
agagccauagcuuaagcc

SEQ ID NO: 135532 - RNA, 18 nt, Artificial Sequence
  Description of Artificial Sequence: Synthetic oligonucleotide
gucuuagagccauagcuu

SEQ ID NO: 135533 - RNA, 18 nt, Artificial Sequence
  Description of Artificial Sequence: Synthetic oligonucleotide
aaccagucuuagagccau

SEQ ID NO: 135534 - RNA, 18 nt, Artificial Sequence
  Description of Artificial Sequence: Synthetic oligonucleotide
cagacaaccagucuuaga

SEQ ID NO: 135535 - RNA, 18 nt, Artificial Sequence
  Description of Artificial Sequence: Synthetic oligonucleotide
uuaggcagacaaccaguc

SEQ ID NO: 135536 - RNA, 18 nt, Artificial Sequence
  Description of Artificial Sequence: Synthetic oligonucleotide
caggauuaggcagacaac

SEQ ID NO: 135537 - RNA, 18 nt, Artificial Sequence
  Description of Artificial Sequence: Synthetic oligonucleotide
uugcccaggauuaggcag

SEQ ID NO: 135538 - RNA, 18 nt, Artificial Sequence
  Description of Artificial Sequence: Synthetic oligonucleotide
cucauuugcccaggauua

SEQ ID NO: 135539 - RNA, 18 nt, Artificial Sequence
  Description of Artificial Sequence: Synthetic oligonucleotide
aggaacucauuugcccag

SEQ ID NO: 135540 - RNA, 18 nt, Artificial Sequence
  Description of Artificial Sequence: Synthetic oligonucleotide
gagagaggaacucauuug

SEQ ID NO: 135541 - RNA, 18 nt, Artificial Sequence
  Description of Artificial Sequence: Synthetic oligonucleotide
gcucagagagaggaacuc

SEQ ID NO: 135542 - RNA, 18 nt, Artificial Sequence
  Description of Artificial Sequence: Synthetic oligonucleotide
cugaggcucagagagagg

SEQ ID NO: 135543 - RNA, 18 nt, Artificial Sequence
  Description of Artificial Sequence: Synthetic oligonucleotide
gaacacugaggcucagag

SEQ ID NO: 135544 - RNA, 18 nt, Artificial Sequence
  Description of Artificial Sequence: Synthetic oligonucleotide
uaagagaacacugaggcu

SEQ ID NO: 135545 - RNA, 18 nt, Artificial Sequence
  Description of Artificial Sequence: Synthetic oligonucleotide
acagauaagagaacacug

SEQ ID NO: 135546 - RNA, 18 nt, Artificial Sequence
  Description of Artificial Sequence: Synthetic oligonucleotide
acuuuacagauaagagaa

SEQ ID NO: 135547 - RNA, 18 nt, Artificial Sequence
  Description of Artificial Sequence: Synthetic oligonucleotide
uuuccacuuuacagauaa

SEQ ID NO: 135548 - RNA, 18 nt, Artificial Sequence
  Description of Artificial Sequence: Synthetic oligonucleotide
augaucucggcucacugc

SEQ ID NO: 135549 - RNA, 18 nt, Artificial Sequence
  Description of Artificial Sequence: Synthetic oligonucleotide
guggcaugaucucggcuc

SEQ ID NO: 135550 - RNA, 18 nt, Artificial Sequence
  Description of Artificial Sequence: Synthetic oligonucleotide
gugcaguggcaugaucuc

SEQ ID NO: 135551 - RNA, 18 nt, Artificial Sequence
  Description of Artificial Sequence: Synthetic oligonucleotide
cuggagugcaguggcaug

SEQ ID NO: 135552 - RNA, 18 nt, Artificial Sequence
  Description of Artificial Sequence: Synthetic oligonucleotide
ccaggcuggagugcagug

SEQ ID NO: 135553 - RNA, 18 nt, Artificial Sequence
  Description of Artificial Sequence: Synthetic oligonucleotide
gucacccaggcuggagug

SEQ ID NO: 135554 - RNA, 18 nt, Artificial Sequence
  Description of Artificial Sequence: Synthetic oligonucleotide
acucugucacccaggcug

SEQ ID NO: 135555 - RNA, 18 nt, Artificial Sequence
  Description of Artificial Sequence: Synthetic oligonucleotide
gucucacucugucaccca

SEQ ID NO: 135556 - RNA, 18 nt, Artificial Sequence
  Description of Artificial Sequence: Synthetic oligonucleotide
acagagucucacucuguc

SEQ ID NO: 135557 - RNA, 18 nt, Artificial Sequence
  Description of Artificial Sequence: Synthetic oligonucleotide
uugagacagagucucacu

SEQ ID NO: 135558 - RNA, 18 nt, Artificial Sequence
  Description of Artificial Sequence: Synthetic oligonucleotide
uuuuuuugagacagaguc

SEQ ID NO: 135559 - RNA, 18 nt, Artificial Sequence
  Description of Artificial Sequence: Synthetic oligonucleotide
uuuuuuuuuuuugagaca

SEQ ID NO: 135560 - RNA, 18 nt, Artificial Sequence
  Description of Artificial Sequence: Synthetic oligonucleotide
uuuuuuuuuuuuuuuuug

SEQ ID NO: 135561 - RNA, 18 nt, Artificial Sequence
  Description of Artificial Sequence: Synthetic oligonucleotide
uucuauuuuuuuuuuuuu

SEQ ID NO: 135562 - RNA, 18 nt, Artificial Sequence
  Description of Artificial Sequence: Synthetic oligonucleotide
acagauucuauuuuuuuu

SEQ ID NO: 135563 - RNA, 18 nt, Artificial Sequence
  Description of Artificial Sequence: Synthetic oligonucleotide
aaaauacagauucuauuu

SEQ ID NO: 135564 - RNA, 18 nt, Artificial Sequence
  Description of Artificial Sequence: Synthetic oligonucleotide
uuguaaaaauacagauuc

SEQ ID NO: 135565 - RNA, 18 nt, Artificial Sequence
  Description of Artificial Sequence: Synthetic oligonucleotide
gugcuuuguaaaaauaca

SEQ ID NO: 135566 - RNA, 18 nt, Artificial Sequence
  Description of Artificial Sequence: Synthetic oligonucleotide
gaagggugcuuuguaaaa

SEQ ID NO: 135567 - RNA, 18 nt, Artificial Sequence
  Description of Artificial Sequence: Synthetic oligonucleotide
auuaugaagggugcuuug

SEQ ID NO: 135568 - RNA, 18 nt, Artificial Sequence
  Description of Artificial Sequence: Synthetic oligonucleotide
ggagaauuaugaagggug

SEQ ID NO: 135569 - RNA, 18 nt, Artificial Sequence
  Description of Artificial Sequence: Synthetic oligonucleotide
gcuauggagaauuaugaa

SEQ ID NO: 135570 - RNA, 18 nt, Artificial Sequence
  Description of Artificial Sequence: Synthetic oligonucleotide
gaccagcuauggagaauu

SEQ ID NO: 135571 - RNA, 18 nt, Artificial Sequence
  Description of Artificial Sequence: Synthetic oligonucleotide
ccauggaccagcuaugga

SEQ ID NO: 135572 - RNA, 18 nt, Artificial Sequence
  Description of Artificial Sequence: Synthetic oligonucleotide
cccacccauggaccagcu

SEQ ID NO: 135573 - RNA, 18 nt, Artificial Sequence
  Description of Artificial Sequence: Synthetic oligonucleotide
aaauucccacccauggac

SEQ ID NO: 135574 - RNA, 18 nt, Artificial Sequence
  Description of Artificial Sequence: Synthetic oligonucleotide
gucccaaauucccaccca

SEQ ID NO: 135575 - RNA, 18 nt, Artificial Sequence
  Description of Artificial Sequence: Synthetic oligonucleotide
ugugggucccaaauuccc

SEQ ID NO: 135576 - RNA, 18 nt, Artificial Sequence
  Description of Artificial Sequence: Synthetic oligonucleotide
aaaacugugggucccaaa

SEQ ID NO: 135577 - RNA, 18 nt, Artificial Sequence
  Description of Artificial Sequence: Synthetic oligonucleotide
guuccaaaacuguggguc

SEQ ID NO: 135578 - RNA, 18 nt, Artificial Sequence
  Description of Artificial Sequence: Synthetic oligonucleotide
aaaaaguuccaaaacugu

SEQ ID NO: 135579 - RNA, 18 nt, Artificial Sequence
  Description of Artificial Sequence: Synthetic oligonucleotide
aucccaaaaaguuccaaa

SEQ ID NO: 135580 - RNA, 18 nt, Artificial Sequence
  Description of Artificial Sequence: Synthetic oligonucleotide
cuaugaucccaaaaaguu

SEQ ID NO: 135581 - RNA, 18 nt, Artificial Sequence
  Description of Artificial Sequence: Synthetic oligonucleotide
aaggucuaugaucccaaa

SEQ ID NO: 135582 - RNA, 18 nt, Artificial Sequence
  Description of Artificial Sequence: Synthetic oligonucleotide
ucaaaaaggucuaugauc

SEQ ID NO: 135583 - RNA, 18 nt, Artificial Sequence
  Description of Artificial Sequence: Synthetic oligonucleotide
gauucucaaaaaggucua

SEQ ID NO: 135584 - RNA, 18 nt, Artificial Sequence
  Description of Artificial Sequence: Synthetic oligonucleotide
uuugagauucucaaaaag

SEQ ID NO: 135585 - RNA, 18 nt, Artificial Sequence
  Description of Artificial Sequence: Synthetic oligonucleotide
ucuuuuuugagauucuca

SEQ ID NO: 135586 - RNA, 18 nt, Artificial Sequence
  Description of Artificial Sequence: Synthetic oligonucleotide
uuuuuucuuuuuugagau

SEQ ID NO: 135587 - RNA, 18 nt, Artificial Sequence
  Description of Artificial Sequence: Synthetic oligonucleotide
gcuuuuuuuuucuuuuuu

SEQ ID NO: 135588 - RNA, 18 nt, Artificial Sequence
  Description of Artificial Sequence: Synthetic oligonucleotide
ugugugcuuuuuuuuucu

SEQ ID NO: 135589 - RNA, 18 nt, Artificial Sequence
  Description of Artificial Sequence: Synthetic oligonucleotide
cauucugugugcuuuuuu

SEQ ID NO: 135590 - RNA, 18 nt, Artificial Sequence
  Description of Artificial Sequence: Synthetic oligonucleotide
agcaacauucugugugcu

SEQ ID NO: 135591 - RNA, 18 nt, Artificial Sequence
  Description of Artificial Sequence: Synthetic oligonucleotide
cuguaagcaacauucugu

SEQ ID NO: 135592 - RNA, 18 nt, Artificial Sequence
  Description of Artificial Sequence: Synthetic oligonucleotide
ugaaacuguaagcaacau

SEQ ID NO: 135593 - RNA, 18 nt, Artificial Sequence
  Description of Artificial Sequence: Synthetic oligonucleotide
ccugaugaaacuguaagc

SEQ ID NO: 135594 - RNA, 18 nt, Artificial Sequence
  Description of Artificial Sequence: Synthetic oligonucleotide
gugugccugaugaaacug

SEQ ID NO: 135595 - RNA, 18 nt, Artificial Sequence
  Description of Artificial Sequence: Synthetic oligonucleotide
cuucugugugccugauga

SEQ ID NO: 135596 - RNA, 18 nt, Artificial Sequence
  Description of Artificial Sequence: Synthetic oligonucleotide
ggccucuucugugugccu

SEQ ID NO: 135597 - RNA, 18 nt, Artificial Sequence
  Description of Artificial Sequence: Synthetic oligonucleotide
ugcugggccucuucugug

SEQ ID NO: 135598 - RNA, 18 nt, Artificial Sequence
  Description of Artificial Sequence: Synthetic oligonucleotide
cuucgugcugggccucuu

SEQ ID NO: 135599 - RNA, 18 nt, Artificial Sequence
  Description of Artificial Sequence: Synthetic oligonucleotide
aacugcuucgugcugggc

SEQ ID NO: 135600 - RNA, 18 nt, Artificial Sequence
  Description of Artificial Sequence: Synthetic oligonucleotide
caagaaacugcuucgugc

SEQ ID NO: 135601 - RNA, 18 nt, Artificial Sequence
  Description of Artificial Sequence: Synthetic oligonucleotide
uugggcaagaaacugcuu

SEQ ID NO: 135602 - RNA, 18 nt, Artificial Sequence
  Description of Artificial Sequence: Synthetic oligonucleotide
uguccuugggcaagaaac

SEQ ID NO: 135603 - RNA, 18 nt, Artificial Sequence
  Description of Artificial Sequence: Synthetic oligonucleotide
ugcuguguccuugggcaa

SEQ ID NO: 135604 - RNA, 18 nt, Artificial Sequence
  Description of Artificial Sequence: Synthetic oligonucleotide
ugaacugcuguguccuug

SEQ ID NO: 135605 - RNA, 18 nt, Artificial Sequence
  Description of Artificial Sequence: Synthetic oligonucleotide
guccuugaacugcugugu

SEQ ID NO: 135606 - RNA, 18 nt, Artificial Sequence
  Description of Artificial Sequence: Synthetic oligonucleotide
acucuguccuugaacugc

SEQ ID NO: 135607 - RNA, 18 nt, Artificial Sequence
  Description of Artificial Sequence: Synthetic oligonucleotide
cgcugacucuguccuuga

SEQ ID NO: 135608 - RNA, 18 nt, Artificial Sequence
  Description of Artificial Sequence: Synthetic oligonucleotide
ccucgcgcugacucuguc

SEQ ID NO: 135609 - RNA, 18 nt, Artificial Sequence
  Description of Artificial Sequence: Synthetic oligonucleotide
agagaccucgcgcugacu

SEQ ID NO: 135610 - RNA, 18 nt, Artificial Sequence
  Description of Artificial Sequence: Synthetic oligonucleotide
agcugagagaccucgcgc

SEQ ID NO: 135611 - RNA, 18 nt, Artificial Sequence
  Description of Artificial Sequence: Synthetic oligonucleotide
cucagagcugagagaccu

SEQ ID NO: 135612 - RNA, 18 nt, Artificial Sequence
  Description of Artificial Sequence: Synthetic oligonucleotide
augugcucagagcugaga

SEQ ID NO: 135613 - RNA, 18 nt, Artificial Sequence
  Description of Artificial Sequence: Synthetic oligonucleotide
agaacaugugcucagagc

SEQ ID NO: 135614 - RNA, 18 nt, Artificial Sequence
  Description of Artificial Sequence: Synthetic oligonucleotide
gggaaagaacaugugcuc

SEQ ID NO: 135615 - RNA, 18 nt, Artificial Sequence
  Description of Artificial Sequence: Synthetic oligonucleotide
acuagaaaccuggaaggg

SEQ ID NO: 135616 - RNA, 18 nt, Artificial Sequence
  Description of Artificial Sequence: Synthetic oligonucleotide
aaaacuagaaaccuggaa

SEQ ID NO: 135617 - RNA, 18 nt, Artificial Sequence
  Description of Artificial Sequence: Synthetic oligonucleotide
cccauaaaacuagaaacc

SEQ ID NO: 135618 - RNA, 18 nt, Artificial Sequence
  Description of Artificial Sequence: Synthetic oligonucleotide
uacuacccauaaaacuag

SEQ ID NO: 135619 - RNA, 18 nt, Artificial Sequence
  Description of Artificial Sequence: Synthetic oligonucleotide
aaaacuacuacccauaaa

SEQ ID NO: 135620 - RNA, 18 nt, Artificial Sequence
  Description of Artificial Sequence: Synthetic oligonucleotide
aucauaaaacuacuaccc

SEQ ID NO: 135621 - RNA, 18 nt, Artificial Sequence
  Description of Artificial Sequence: Synthetic oligonucleotide
ugggcaucauaaaacuac

SEQ ID NO: 135622 - RNA, 18 nt, Artificial Sequence
  Description of Artificial Sequence: Synthetic oligonucleotide
ugaaaugggcaucauaaa

SEQ ID NO: 135623 - RNA, 18 nt, Artificial Sequence
  Description of Artificial Sequence: Synthetic oligonucleotide
aacugugaaaugggcauc

SEQ ID NO: 135624 - RNA, 18 nt, Artificial Sequence
  Description of Artificial Sequence: Synthetic oligonucleotide
gccugaacugugaaaugg

SEQ ID NO: 135625 - RNA, 18 nt, Artificial Sequence
  Description of Artificial Sequence: Synthetic oligonucleotide
uaccugccugaacuguga

SEQ ID NO: 135626 - RNA, 18 nt, Artificial Sequence
  Description of Artificial Sequence: Synthetic oligonucleotide
gccucuaccugccugaac

SEQ ID NO: 135627 - RNA, 18 nt, Artificial Sequence
  Description of Artificial Sequence: Synthetic oligonucleotide
ccucugccucuaccugcc

SEQ ID NO: 135628 - RNA, 18 nt, Artificial Sequence
  Description of Artificial Sequence: Synthetic oligonucleotide
gcuccccucugccucuac

SEQ ID NO: 135629 - RNA, 18 nt, Artificial Sequence
  Description of Artificial Sequence: Synthetic oligonucleotide
uuaaugcuccccucugcc

SEQ ID NO: 135630 - RNA, 18 nt, Artificial Sequence
  Description of Artificial Sequence: Synthetic oligonucleotide
ucagcuuaaugcuccccu

SEQ ID NO: 135631 - RNA, 18 nt, Artificial Sequence
  Description of Artificial Sequence: Synthetic oligonucleotide
gcaagucagcuuaaugcu

SEQ ID NO: 135632 - RNA, 18 nt, Artificial Sequence
  Description of Artificial Sequence: Synthetic oligonucleotide
gcugggcaagucagcuua

SEQ ID NO: 135633 - RNA, 18 nt, Artificial Sequence
  Description of Artificial Sequence: Synthetic oligonucleotide
gugacgcugggcaaguca

SEQ ID NO: 135634 - RNA, 18 nt, Artificial Sequence
  Description of Artificial Sequence: Synthetic oligonucleotide
acucagugacgcugggca

SEQ ID NO: 135635 - RNA, 18 nt, Artificial Sequence
  Description of Artificial Sequence: Synthetic oligonucleotide
agccaacucagugacgcu

SEQ ID NO: 135636 - RNA, 18 nt, Artificial Sequence
  Description of Artificial Sequence: Synthetic oligonucleotide
cccguagccaacucagug

SEQ ID NO: 135637 - RNA, 18 nt, Artificial Sequence
  Description of Artificial Sequence: Synthetic oligonucleotide
ggcugcccguagccaacu

SEQ ID NO: 135638 - RNA, 18 nt, Artificial Sequence
  Description of Artificial Sequence: Synthetic oligonucleotide
gggaaggcugcccguagc

SEQ ID NO: 135639 - RNA, 18 nt, Artificial Sequence
  Description of Artificial Sequence: Synthetic oligonucleotide
cccuugggaaggcugccc

SEQ ID NO: 135640 - RNA, 18 nt, Artificial Sequence
  Description of Artificial Sequence: Synthetic oligonucleotide
cuguacccuugggaaggc

SEQ ID NO: 135641 - RNA, 18 nt, Artificial Sequence
  Description of Artificial Sequence: Synthetic oligonucleotide
gccaucuguacccuuggg

SEQ ID NO: 135642 - RNA, 18 nt, Artificial Sequence
  Description of Artificial Sequence: Synthetic oligonucleotide
uguuugccaucuguaccc

SEQ ID NO: 135643 - RNA, 18 nt, Artificial Sequence
  Description of Artificial Sequence: Synthetic oligonucleotide
aacaguguuugccaucug

SEQ ID NO: 135644 - RNA, 18 nt, Artificial Sequence
  Description of Artificial Sequence: Synthetic oligonucleotide
gggcucugagcagggcca

SEQ ID NO: 135645 - RNA, 18 nt, Artificial Sequence
  Description of Artificial Sequence: Synthetic oligonucleotide
agcaugggcucugagcag

SEQ ID NO: 135646 - RNA, 18 nt, Artificial Sequence
  Description of Artificial Sequence: Synthetic oligonucleotide
ucgccagcaugggcucug

SEQ ID NO: 135647 - RNA, 18 nt, Artificial Sequence
  Description of Artificial Sequence: Synthetic oligonucleotide
ggugcucgccagcauggg

SEQ ID NO: 135648 - RNA, 18 nt, Artificial Sequence
  Description of Artificial Sequence: Synthetic oligonucleotide
cagcaggugcucgccagc

SEQ ID NO: 135649 - RNA, 18 nt, Artificial Sequence
  Description of Artificial Sequence: Synthetic oligonucleotide
ccgagcagcaggugcucg

SEQ ID NO: 135650 - RNA, 18 nt, Artificial Sequence
  Description of Artificial Sequence: Synthetic oligonucleotide
uggcuccgagcagcaggu

SEQ ID NO: 135651 - RNA, 18 nt, Artificial Sequence
  Description of Artificial Sequence: Synthetic oligonucleotide
cuugguggcuccgagcag

SEQ ID NO: 135652 - RNA, 18 nt, Artificial Sequence
  Description of Artificial Sequence: Synthetic oligonucleotide
gaucucuugguggcuccg

SEQ ID NO: 135653 - RNA, 18 nt, Artificial Sequence
  Description of Artificial Sequence: Synthetic oligonucleotide
ccauggaucucuuggugg

SEQ ID NO: 135654 - RNA, 18 nt, Artificial Sequence
  Description of Artificial Sequence: Synthetic oligonucleotide
gaacaccauggaucucuu

SEQ ID NO: 135655 - RNA, 18 nt, Artificial Sequence
  Description of Artificial Sequence: Synthetic oligonucleotide
uccuugaacaccauggau

SEQ ID NO: 135656 - RNA, 18 nt, Artificial Sequence
  Description of Artificial Sequence: Synthetic oligonucleotide
gcacguccuugaacacca

SEQ ID NO: 135657 - RNA, 18 nt, Artificial Sequence
  Description of Artificial Sequence: Synthetic oligonucleotide
gagcagcacguccuugaa

SEQ ID NO: 135658 - RNA, 18 nt, Artificial Sequence
  Description of Artificial Sequence: Synthetic oligonucleotide
ugggcucugagcagggcc

SEQ ID NO: 135659 - RNA, 18 nt, Artificial Sequence
  Description of Artificial Sequence: Synthetic oligonucleotide
cagcaugggcucugagca

SEQ ID NO: 135660 - RNA, 18 nt, Artificial Sequence
  Description of Artificial Sequence: Synthetic oligonucleotide
cucgccagcaugggcucu

SEQ ID NO: 135661 - RNA, 18 nt, Artificial Sequence
  Description of Artificial Sequence: Synthetic oligonucleotide
aggugcucgccagcaugg

SEQ ID NO: 135662 - RNA, 18 nt, Artificial Sequence
  Description of Artificial Sequence: Synthetic oligonucleotide
gcagcaggugcucgccag

SEQ ID NO: 135663 - RNA, 18 nt, Artificial Sequence
  Description of Artificial Sequence: Synthetic oligonucleotide
uccgagcagcaggugcuc

SEQ ID NO: 135664 - RNA, 18 nt, Artificial Sequence
  Description of Artificial Sequence: Synthetic oligonucleotide
guggcuccgagcagcagg

SEQ ID NO: 135665 - RNA, 18 nt, Artificial Sequence
  Description of Artificial Sequence: Synthetic oligonucleotide
ucuugguggcuccgagca

SEQ ID NO: 135666 - RNA, 18 nt, Artificial Sequence
  Description of Artificial Sequence: Synthetic oligonucleotide
ggaucucuugguggcucc

SEQ ID NO: 135667 - RNA, 18 nt, Artificial Sequence
  Description of Artificial Sequence: Synthetic oligonucleotide
accauggaucucuuggug

SEQ ID NO: 135668 - RNA, 18 nt, Artificial Sequence
  Description of Artificial Sequence: Synthetic oligonucleotide
ugaacaccauggaucucu

SEQ ID NO: 135669 - RNA, 18 nt, Artificial Sequence
  Description of Artificial Sequence: Synthetic oligonucleotide
guccuugaacaccaugga

SEQ ID NO: 135670 - RNA, 18 nt, Artificial Sequence
  Description of Artificial Sequence: Synthetic oligonucleotide
agcacguccuugaacacc

SEQ ID NO: 135671 - RNA, 18 nt, Artificial Sequence
  Description of Artificial Sequence: Synthetic oligonucleotide
ggagcagcacguccuuga

SEQ ID NO: 135672 - RNA, 18 nt, Artificial Sequence
  Description of Artificial Sequence: Synthetic oligonucleotide
gccagggcaggcagccgc

SEQ ID NO: 135673 - RNA, 18 nt, Artificial Sequence
  Description of Artificial Sequence: Synthetic oligonucleotide
cccuggccagggcaggca

SEQ ID NO: 135674 - RNA, 18 nt, Artificial Sequence
  Description of Artificial Sequence: Synthetic oligonucleotide
uggagcccuggccagggc

SEQ ID NO: 135675 - RNA, 18 nt, Artificial Sequence
  Description of Artificial Sequence: Synthetic oligonucleotide
cucccuggagcccuggcc

SEQ ID NO: 135676 - RNA, 18 nt, Artificial Sequence
  Description of Artificial Sequence: Synthetic oligonucleotide
auacccucccuggagccc

SEQ ID NO: 135677 - RNA, 18 nt, Artificial Sequence
  Description of Artificial Sequence: Synthetic oligonucleotide
uaggcauacccucccugg

SEQ ID NO: 135678 - RNA, 18 nt, Artificial Sequence
  Description of Artificial Sequence: Synthetic oligonucleotide
caugcuaggcauacccuc

SEQ ID NO: 135679 - RNA, 18 nt, Artificial Sequence
  Description of Artificial Sequence: Synthetic oligonucleotide
agugccaugcuaggcaua

SEQ ID NO: 135680 - RNA, 18 nt, Artificial Sequence
  Description of Artificial Sequence: Synthetic oligonucleotide
gggugagugccaugcuag

SEQ ID NO: 135681 - RNA, 18 nt, Artificial Sequence
  Description of Artificial Sequence: Synthetic oligonucleotide
ugccugggugagugccau

SEQ ID NO: 135682 - RNA, 18 nt, Artificial Sequence
  Description of Artificial Sequence: Synthetic oligonucleotide
cuccuugccugggugagu

SEQ ID NO: 135683 - RNA, 18 nt, Artificial Sequence
  Description of Artificial Sequence: Synthetic oligonucleotide
ugaaucuccuugccuggg

SEQ ID NO: 135684 - RNA, 18 nt, Artificial Sequence
  Description of Artificial Sequence: Synthetic oligonucleotide
ccaugugaaucuccuugc

SEQ ID NO: 135685 - RNA, 18 nt, Artificial Sequence
  Description of Artificial Sequence: Synthetic oligonucleotide
ugccaccaugugaaucuc

SEQ ID NO: 135686 - RNA, 18 nt, Artificial Sequence
  Description of Artificial Sequence: Synthetic oligonucleotide
uugcaugccaccauguga

SEQ ID NO: 135687 - RNA, 18 nt, Artificial Sequence
  Description of Artificial Sequence: Synthetic oligonucleotide
cacccuugcaugccacca

SEQ ID NO: 135688 - RNA, 18 nt, Artificial Sequence
  Description of Artificial Sequence: Synthetic oligonucleotide
ucccucacccuugcaugc

SEQ ID NO: 135689 - RNA, 18 nt, Artificial Sequence
  Description of Artificial Sequence: Synthetic oligonucleotide
uagucucccucacccuug

SEQ ID NO: 135690 - RNA, 18 nt, Artificial Sequence
  Description of Artificial Sequence: Synthetic oligonucleotide
cugacuagucucccucac

SEQ ID NO: 135691 - RNA, 18 nt, Artificial Sequence
  Description of Artificial Sequence: Synthetic oligonucleotide
cacuccugacuagucucc

SEQ ID NO: 135692 - RNA, 18 nt, Artificial Sequence
  Description of Artificial Sequence: Synthetic oligonucleotide
agggccacuccugacuag

SEQ ID NO: 135693 - RNA, 18 nt, Artificial Sequence
  Description of Artificial Sequence: Synthetic oligonucleotide
aggacagggccacuccug

SEQ ID NO: 135694 - RNA, 18 nt, Artificial Sequence
  Description of Artificial Sequence: Synthetic oligonucleotide
gccugaggacagggccac

SEQ ID NO: 135695 - RNA, 18 nt, Artificial Sequence
  Description of Artificial Sequence: Synthetic oligonucleotide
ugcaagccugaggacagg

SEQ ID NO: 135696 - RNA, 18 nt, Artificial Sequence
  Description of Artificial Sequence: Synthetic oligonucleotide
ucuaaugcaagccugagg

SEQ ID NO: 135697 - RNA, 18 nt, Artificial Sequence
  Description of Artificial Sequence: Synthetic oligonucleotide
agcccucuaaugcaagcc

SEQ ID NO: 135698 - RNA, 18 nt, Artificial Sequence
  Description of Artificial Sequence: Synthetic oligonucleotide
ccuggagcccucuaaugc

SEQ ID NO: 135699 - RNA, 18 nt, Artificial Sequence
  Description of Artificial Sequence: Synthetic oligonucleotide
ugaguccuggagcccucu

SEQ ID NO: 135700 - RNA, 18 nt, Artificial Sequence
  Description of Artificial Sequence: Synthetic oligonucleotide
aaaacugaguccuggagc

SEQ ID NO: 135701 - RNA, 18 nt, Artificial Sequence
  Description of Artificial Sequence: Synthetic oligonucleotide
aguugaaaacugaguccu

SEQ ID NO: 135702 - RNA, 18 nt, Artificial Sequence
  Description of Artificial Sequence: Synthetic oligonucleotide
uacccaguugaaaacuga

SEQ ID NO: 135703 - RNA, 18 nt, Artificial Sequence
  Description of Artificial Sequence: Synthetic oligonucleotide
ggguacccaguugaaaac

SEQ ID NO: 135704 - RNA, 18 nt, Artificial Sequence
  Description of Artificial Sequence: Synthetic oligonucleotide
uccuugcaucugaguggg

SEQ ID NO: 135705 - RNA, 18 nt, Artificial Sequence
  Description of Artificial Sequence: Synthetic oligonucleotide
acauuuccuugcaucuga

SEQ ID NO: 135706 - RNA, 18 nt, Artificial Sequence
  Description of Artificial Sequence: Synthetic oligonucleotide
cauccacauuuccuugca

SEQ ID NO: 135707 - RNA, 18 nt, Artificial Sequence
  Description of Artificial Sequence: Synthetic oligonucleotide
acuugcauccacauuucc

SEQ ID NO: 135708 - RNA, 18 nt, Artificial Sequence
  Description of Artificial Sequence: Synthetic oligonucleotide
uggugacuugcauccaca

SEQ ID NO: 135709 - RNA, 18 nt, Artificial Sequence
  Description of Artificial Sequence: Synthetic oligonucleotide
gaauuuggugacuugcau

SEQ ID NO: 135710 - RNA, 18 nt, Artificial Sequence
  Description of Artificial Sequence: Synthetic oligonucleotide
gcugggaauuuggugacu

SEQ ID NO: 135711 - RNA, 18 nt, Artificial Sequence
  Description of Artificial Sequence: Synthetic oligonucleotide
ucaaugcugggaauuugg

SEQ ID NO: 135712 - RNA, 18 nt, Artificial Sequence
  Description of Artificial Sequence: Synthetic oligonucleotide
ugacuucaaugcugggaa

SEQ ID NO: 135713 - RNA, 18 nt, Artificial Sequence
  Description of Artificial Sequence: Synthetic oligonucleotide
ugcucugacuucaaugcu

SEQ ID NO: 135714 - RNA, 18 nt, Artificial Sequence
  Description of Artificial Sequence: Synthetic oligonucleotide
gaucgugcucugacuuca

SEQ ID NO: 135715 - RNA, 18 nt, Artificial Sequence
  Description of Artificial Sequence: Synthetic oligonucleotide
acccugaucgugcucuga

SEQ ID NO: 135716 - RNA, 18 nt, Artificial Sequence
  Description of Artificial Sequence: Synthetic oligonucleotide
ggauaacccugaucgugc

SEQ ID NO: 135717 - RNA, 18 nt, Artificial Sequence
  Description of Artificial Sequence: Synthetic oligonucleotide
uccagggauaacccugau

SEQ ID NO: 135718 - RNA, 18 nt, Artificial Sequence
  Description of Artificial Sequence: Synthetic oligonucleotide
guaauuccagggauaacc

SEQ ID NO: 135719 - RNA, 18 nt, Artificial Sequence
  Description of Artificial Sequence: Synthetic oligonucleotide
cacagguaauuccaggga

SEQ ID NO: 135720 - RNA, 18 nt, Artificial Sequence
  Description of Artificial Sequence: Synthetic oligonucleotide
ggaugcacagguaauucc

SEQ ID NO: 135721 - RNA, 18 nt, Artificial Sequence
  Description of Artificial Sequence: Synthetic oligonucleotide
aaaaaggaugcacaggua

SEQ ID NO: 135722 - RNA, 18 nt, Artificial Sequence
  Description of Artificial Sequence: Synthetic oligonucleotide
aaagaaaaaaggaugcac

SEQ ID NO: 135723 - RNA, 18 nt, Artificial Sequence
  Description of Artificial Sequence: Synthetic oligonucleotide
ugucaaaagaaaaaagga

SEQ ID NO: 135724 - RNA, 18 nt, Artificial Sequence
  Description of Artificial Sequence: Synthetic oligonucleotide
gacucugucaaaagaaaa

SEQ ID NO: 135725 - RNA, 18 nt, Artificial Sequence
  Description of Artificial Sequence: Synthetic oligonucleotide
agcaagacucugucaaaa

SEQ ID NO: 135726 - RNA, 18 nt, Artificial Sequence
  Description of Artificial Sequence: Synthetic oligonucleotide
gacagagcaagacucugu

SEQ ID NO: 135727 - RNA, 18 nt, Artificial Sequence
  Description of Artificial Sequence: Synthetic oligonucleotide
ugagugacagagcaagac

SEQ ID NO: 135728 - RNA, 18 nt, Artificial Sequence
  Description of Artificial Sequence: Synthetic oligonucleotide
cagccugagugacagagc

SEQ ID NO: 135729 - RNA, 18 nt, Artificial Sequence
  Description of Artificial Sequence: Synthetic oligonucleotide
cacuccagccugagugac

SEQ ID NO: 135730 - RNA, 18 nt, Artificial Sequence
  Description of Artificial Sequence: Synthetic oligonucleotide
cauugcacuccagccuga

SEQ ID NO: 135731 - RNA, 18 nt, Artificial Sequence
  Description of Artificial Sequence: Synthetic oligonucleotide
cacaucauugcacuccag

SEQ ID NO: 135732 - RNA, 18 nt, Artificial Sequence
  Description of Artificial Sequence: Synthetic oligonucleotide
gagaucacaucauugcac

SEQ ID NO: 135733 - RNA, 18 nt, Artificial Sequence
  Description of Artificial Sequence: Synthetic oligonucleotide
gagccgagaucacaucau

SEQ ID NO: 135734 - RNA, 18 nt, Artificial Sequence
  Description of Artificial Sequence: Synthetic oligonucleotide
gaagugagccgagaucac

SEQ ID NO: 135735 - RNA, 18 nt, Artificial Sequence
  Description of Artificial Sequence: Synthetic oligonucleotide
aggcugaagugagccgag

SEQ ID NO: 135736 - RNA, 18 nt, Artificial Sequence
  Description of Artificial Sequence: Synthetic oligonucleotide
gguggaggcugaagugag

SEQ ID NO: 135737 - RNA, 18 nt, Artificial Sequence
  Description of Artificial Sequence: Synthetic oligonucleotide
uggcggguggaggcugaa

SEQ ID NO: 135738 - RNA, 18 nt, Artificial Sequence
  Description of Artificial Sequence: Synthetic oligonucleotide
gaacguggcggguggagg

SEQ ID NO: 135739 - RNA, 18 nt, Artificial Sequence
  Description of Artificial Sequence: Synthetic oligonucleotide
ugcuugaacguggcgggu

SEQ ID NO: 135740 - RNA, 18 nt, Artificial Sequence
  Description of Artificial Sequence: Synthetic oligonucleotide
agaauugcuugaacgugg

SEQ ID NO: 135741 - RNA, 18 nt, Artificial Sequence
  Description of Artificial Sequence: Synthetic oligonucleotide
gcaggagaauugcuugaa

SEQ ID NO: 135742 - RNA, 18 nt, Artificial Sequence
  Description of Artificial Sequence: Synthetic oligonucleotide
gugaggcaggagaauugc

SEQ ID NO: 135743 - RNA, 18 nt, Artificial Sequence
  Description of Artificial Sequence: Synthetic oligonucleotide
ggagggugaggcaggaga

SEQ ID NO: 135744 - RNA, 18 nt, Artificial Sequence
  Description of Artificial Sequence: Synthetic oligonucleotide
acucuggagggugaggca

SEQ ID NO: 135745 - RNA, 18 nt, Artificial Sequence
  Description of Artificial Sequence: Synthetic oligonucleotide
cagcaacucuggagggug

SEQ ID NO: 135746 - RNA, 18 nt, Artificial Sequence
  Description of Artificial Sequence: Synthetic oligonucleotide
ggucccagcaacucugga

SEQ ID NO: 135747 - RNA, 18 nt, Artificial Sequence
  Description of Artificial Sequence: Synthetic oligonucleotide
ccuguggucccagcaacu

SEQ ID NO: 135748 - RNA, 18 nt, Artificial Sequence
  Description of Artificial Sequence: Synthetic oligonucleotide
gcacgccuguggucccag

SEQ ID NO: 135749 - RNA, 18 nt, Artificial Sequence
  Description of Artificial Sequence: Synthetic oligonucleotide
guggugcacgccuguggu

SEQ ID NO: 135750 - RNA, 18 nt, Artificial Sequence
  Description of Artificial Sequence: Synthetic oligonucleotide
gugugguggugcacgccu

SEQ ID NO: 135751 - RNA, 18 nt, Artificial Sequence
  Description of Artificial Sequence: Synthetic oligonucleotide
gcugggugugguggugca

SEQ ID NO: 135752 - RNA, 18 nt, Artificial Sequence
  Description of Artificial Sequence: Synthetic oligonucleotide
aauuagcuggguguggug

SEQ ID NO: 135753 - RNA, 18 nt, Artificial Sequence
  Description of Artificial Sequence: Synthetic oligonucleotide
acaaaaauuagcugggug

SEQ ID NO: 135754 - RNA, 18 nt, Artificial Sequence
  Description of Artificial Sequence: Synthetic oligonucleotide
aaaauacaaaaauuagcu

SEQ ID NO: 135755 - RNA, 18 nt, Artificial Sequence
  Description of Artificial Sequence: Synthetic oligonucleotide
uacuaaaaauacaaaaau

SEQ ID NO: 135756 - RNA, 18 nt, Artificial Sequence
  Description of Artificial Sequence: Synthetic oligonucleotide
gucucuacuaaaaauaca

SEQ ID NO: 135757 - RNA, 18 nt, Artificial Sequence
  Description of Artificial Sequence: Synthetic oligonucleotide
acccugucucuacuaaaa

SEQ ID NO: 135758 - RNA, 18 nt, Artificial Sequence
  Description of Artificial Sequence: Synthetic oligonucleotide
gugaaacccugucucuac

SEQ ID NO: 135759 - RNA, 18 nt, Artificial Sequence
  Description of Artificial Sequence: Synthetic oligonucleotide
acauggugaaacccuguc

SEQ ID NO: 135760 - RNA, 18 nt, Artificial Sequence
  Description of Artificial Sequence: Synthetic oligonucleotide
ggucaacauggugaaacc

SEQ ID NO: 135761 - RNA, 18 nt, Artificial Sequence
  Description of Artificial Sequence: Synthetic oligonucleotide
agccuggucaacauggug

SEQ ID NO: 135762 - RNA, 18 nt, Artificial Sequence
  Description of Artificial Sequence: Synthetic oligonucleotide
agaccagccuggucaaca

SEQ ID NO: 135763 - RNA, 18 nt, Artificial Sequence
  Description of Artificial Sequence: Synthetic oligonucleotide
guuugagaccagccuggu

SEQ ID NO: 135764 - RNA, 18 nt, Artificial Sequence
  Description of Artificial Sequence: Synthetic oligonucleotide
caggaguuugagaccagc

SEQ ID NO: 135765 - RNA, 18 nt, Artificial Sequence
  Description of Artificial Sequence: Synthetic oligonucleotide
gaggccaggaguuugaga

SEQ ID NO: 135766 - RNA, 18 nt, Artificial Sequence
  Description of Artificial Sequence: Synthetic oligonucleotide
uauuugaggccaggaguu

SEQ ID NO: 135767 - RNA, 18 nt, Artificial Sequence
  Description of Artificial Sequence: Synthetic oligonucleotide
uggauuauuugaggccag

SEQ ID NO: 135768 - RNA, 18 nt, Artificial Sequence
  Description of Artificial Sequence: Synthetic oligonucleotide
gcggguggauuauuugag

SEQ ID NO: 135769 - RNA, 18 nt, Artificial Sequence
  Description of Artificial Sequence: Synthetic oligonucleotide
cugaggcggguggauuau

SEQ ID NO: 135770 - RNA, 18 nt, Artificial Sequence
  Description of Artificial Sequence: Synthetic oligonucleotide
gagcacagucccuggcac

SEQ ID NO: 135771 - RNA, 18 nt, Artificial Sequence
  Description of Artificial Sequence: Synthetic oligonucleotide
gcagugagcacagucccu

SEQ ID NO: 135772 - RNA, 18 nt, Artificial Sequence
  Description of Artificial Sequence: Synthetic oligonucleotide
gcaaagcagugagcacag

SEQ ID NO: 135773 - RNA, 18 nt, Artificial Sequence
  Description of Artificial Sequence: Synthetic oligonucleotide
uguuugcaaagcagugag

SEQ ID NO: 135774 - RNA, 18 nt, Artificial Sequence
  Description of Artificial Sequence: Synthetic oligonucleotide
gguaguguuugcaaagca

SEQ ID NO: 135775 - RNA, 18 nt, Artificial Sequence
  Description of Artificial Sequence: Synthetic oligonucleotide
aaauagguaguguuugca

SEQ ID NO: 135776 - RNA, 18 nt, Artificial Sequence
  Description of Artificial Sequence: Synthetic oligonucleotide
uauuaaaauagguagugu

SEQ ID NO: 135777 - RNA, 18 nt, Artificial Sequence
  Description of Artificial Sequence: Synthetic oligonucleotide
uguuauauuaaaauaggu

SEQ ID NO: 135778 - RNA, 18 nt, Artificial Sequence
  Description of Artificial Sequence: Synthetic oligonucleotide
agcauuguuauauuaaaa

SEQ ID NO: 135779 - RNA, 18 nt, Artificial Sequence
  Description of Artificial Sequence: Synthetic oligonucleotide
cucauagcauuguuauau

SEQ ID NO: 135780 - RNA, 18 nt, Artificial Sequence
  Description of Artificial Sequence: Synthetic oligonucleotide
cuucccucauagcauugu

SEQ ID NO: 135781 - RNA, 18 nt, Artificial Sequence
  Description of Artificial Sequence: Synthetic oligonucleotide
ucgagcuucccucauagc

SEQ ID NO: 135782 - RNA, 18 nt, Artificial Sequence
  Description of Artificial Sequence: Synthetic oligonucleotide
aauaaucgagcuucccuc

SEQ ID NO: 135783 - RNA, 18 nt, Artificial Sequence
  Description of Artificial Sequence: Synthetic oligonucleotide
ggauaaauaaucgagcuu

SEQ ID NO: 135784 - RNA, 18 nt, Artificial Sequence
  Description of Artificial Sequence: Synthetic oligonucleotide
gaugaggauaaauaaucg

SEQ ID NO: 135785 - RNA, 18 nt, Artificial Sequence
  Description of Artificial Sequence: Synthetic oligonucleotide
uauaagaugaggauaaau

SEQ ID NO: 135786 - RNA, 18 nt, Artificial Sequence
  Description of Artificial Sequence: Synthetic oligonucleotide
uuaucuauaagaugagga

SEQ ID NO: 135787 - RNA, 18 nt, Artificial Sequence
  Description of Artificial Sequence: Synthetic oligonucleotide
uuuucuuaucuauaagau

SEQ ID NO: 135788 - RNA, 18 nt, Artificial Sequence
  Description of Artificial Sequence: Synthetic oligonucleotide
cucaguuuucuuaucuau

SEQ ID NO: 135789 - RNA, 18 nt, Artificial Sequence
  Description of Artificial Sequence: Synthetic oligonucleotide
ugugccucaguuuucuua

SEQ ID NO: 135790 - RNA, 18 nt, Artificial Sequence
  Description of Artificial Sequence: Synthetic oligonucleotide
cucucugugccucaguuu

SEQ ID NO: 135791 - RNA, 18 nt, Artificial Sequence
  Description of Artificial Sequence: Synthetic oligonucleotide
uuaaccucucugugccuc

SEQ ID NO: 135792 - RNA, 18 nt, Artificial Sequence
  Description of Artificial Sequence: Synthetic oligonucleotide
guuacuuaaccucucugu

SEQ ID NO: 135793 - RNA, 18 nt, Artificial Sequence
  Description of Artificial Sequence: Synthetic oligonucleotide
gauaaguuacuuaaccuc

SEQ ID NO: 135794 - RNA, 18 nt, Artificial Sequence
  Description of Artificial Sequence: Synthetic oligonucleotide
aguuggauaaguuacuua

SEQ ID NO: 135795 - RNA, 18 nt, Artificial Sequence
  Description of Artificial Sequence: Synthetic oligonucleotide
guuauaguuggauaaguu

SEQ ID NO: 135796 - RNA, 18 nt, Artificial Sequence
  Description of Artificial Sequence: Synthetic oligonucleotide
agcugguuauaguuggau

SEQ ID NO: 135797 - RNA, 18 nt, Artificial Sequence
  Description of Artificial Sequence: Synthetic oligonucleotide
cugauagcugguuauagu

SEQ ID NO: 135798 - RNA, 18 nt, Artificial Sequence
  Description of Artificial Sequence: Synthetic oligonucleotide
ugccccugauagcugguu

SEQ ID NO: 135799 - RNA, 18 nt, Artificial Sequence
  Description of Artificial Sequence: Synthetic oligonucleotide
ggcucugccccugauagc

SEQ ID NO: 135800 - RNA, 18 nt, Artificial Sequence
  Description of Artificial Sequence: Synthetic oligonucleotide
uaaauggcucugccccug

SEQ ID NO: 135801 - RNA, 18 nt, Artificial Sequence
  Description of Artificial Sequence: Synthetic oligonucleotide
cugcuuaaauggcucugc

SEQ ID NO: 135802 - RNA, 18 nt, Artificial Sequence
  Description of Artificial Sequence: Synthetic oligonucleotide
cugcccugcuuaaauggc

SEQ ID NO: 135803 - RNA, 18 nt, Artificial Sequence
  Description of Artificial Sequence: Synthetic oligonucleotide
cugcacugcccugcuuaa

SEQ ID NO: 135804 - RNA, 18 nt, Artificial Sequence
  Description of Artificial Sequence: Synthetic oligonucleotide
uggaacugcacugcccug

SEQ ID NO: 135805 - RNA, 18 nt, Artificial Sequence
  Description of Artificial Sequence: Synthetic oligonucleotide
gauucuggaacugcacug

SEQ ID NO: 135806 - RNA, 18 nt, Artificial Sequence
  Description of Artificial Sequence: Synthetic oligonucleotide
gaccagauucuggaacug

SEQ ID NO: 135807 - RNA, 18 nt, Artificial Sequence
  Description of Artificial Sequence: Synthetic oligonucleotide
uaaaggaccagauucugg

SEQ ID NO: 135808 - RNA, 18 nt, Artificial Sequence
  Description of Artificial Sequence: Synthetic oligonucleotide
aagguuaaaggaccagau

SEQ ID NO: 135809 - RNA, 18 nt, Artificial Sequence
  Description of Artificial Sequence: Synthetic oligonucleotide
gcaucaagguuaaaggac

SEQ ID NO: 135810 - RNA, 18 nt, Artificial Sequence
  Description of Artificial Sequence: Synthetic oligonucleotide
ccaaagcaucaagguuaa

SEQ ID NO: 135811 - RNA, 18 nt, Artificial Sequence
  Description of Artificial Sequence: Synthetic oligonucleotide
aggcaccaaagcaucaag

SEQ ID NO: 135812 - RNA, 18 nt, Artificial Sequence
  Description of Artificial Sequence: Synthetic oligonucleotide
cugauaggcaccaaagca

SEQ ID NO: 135813 - RNA, 18 nt, Artificial Sequence
  Description of Artificial Sequence: Synthetic oligonucleotide
gucaccugauaggcacca

SEQ ID NO: 135814 - RNA, 18 nt, Artificial Sequence
  Description of Artificial Sequence: Synthetic oligonucleotide
caaaggucaccugauagg

SEQ ID NO: 135815 - RNA, 18 nt, Artificial Sequence
  Description of Artificial Sequence: Synthetic oligonucleotide
acauucaaaggucaccug

SEQ ID NO: 135816 - RNA, 18 nt, Artificial Sequence
  Description of Artificial Sequence: Synthetic oligonucleotide
cgaugacauucaaagguc

SEQ ID NO: 135817 - RNA, 18 nt, Artificial Sequence
  Description of Artificial Sequence: Synthetic oligonucleotide
aagaucgaugacauucaa

SEQ ID NO: 135818 - RNA, 18 nt, Artificial Sequence
  Description of Artificial Sequence: Synthetic oligonucleotide
cucacaagaucgaugaca

SEQ ID NO: 135819 - RNA, 18 nt, Artificial Sequence
  Description of Artificial Sequence: Synthetic oligonucleotide
caugacucacaagaucga

SEQ ID NO: 135820 - RNA, 18 nt, Artificial Sequence
  Description of Artificial Sequence: Synthetic oligonucleotide
accaacaugacucacaag

SEQ ID NO: 135821 - RNA, 18 nt, Artificial Sequence
  Description of Artificial Sequence: Synthetic oligonucleotide
cauuuaccaacaugacuc

SEQ ID NO: 135822 - RNA, 18 nt, Artificial Sequence
  Description of Artificial Sequence: Synthetic oligonucleotide
agcuccauuuaccaacau

SEQ ID NO: 135823 - RNA, 18 nt, Artificial Sequence
  Description of Artificial Sequence: Synthetic oligonucleotide
acccaagcuccauuuacc

SEQ ID NO: 135824 - RNA, 18 nt, Artificial Sequence
  Description of Artificial Sequence: Synthetic oligonucleotide
acaugacccaagcuccau

SEQ ID NO: 135825 - RNA, 18 nt, Artificial Sequence
  Description of Artificial Sequence: Synthetic oligonucleotide
cuuucacaugacccaagc

SEQ ID NO: 135826 - RNA, 18 nt, Artificial Sequence
  Description of Artificial Sequence: Synthetic oligonucleotide
gaccucuuucacaugacc

SEQ ID NO: 135827 - RNA, 18 nt, Artificial Sequence
  Description of Artificial Sequence: Synthetic oligonucleotide
ucuaggaccucuuucaca

SEQ ID NO: 135828 - RNA, 18 nt, Artificial Sequence
  Description of Artificial Sequence: Synthetic oligonucleotide
ggcuuucuaggaccucuu

SEQ ID NO: 135829 - RNA, 18 nt, Artificial Sequence
  Description of Artificial Sequence: Synthetic oligonucleotide
aacuuggcuuucuaggac

SEQ ID NO: 135830 - RNA, 18 nt, Artificial Sequence
  Description of Artificial Sequence: Synthetic oligonucleotide
cuuggaacuuggcuuucu

SEQ ID NO: 135831 - RNA, 18 nt, Artificial Sequence
  Description of Artificial Sequence: Synthetic oligonucleotide
cugagcuuggaacuuggc

SEQ ID NO: 135832 - RNA, 18 nt, Artificial Sequence
  Description of Artificial Sequence: Synthetic oligonucleotide
uccggcugagcuuggaac

SEQ ID NO: 135833 - RNA, 18 nt, Artificial Sequence
  Description of Artificial Sequence: Synthetic oligonucleotide
agucauccggcugagcuu

SEQ ID NO: 135834 - RNA, 18 nt, Artificial Sequence
  Description of Artificial Sequence: Synthetic oligonucleotide
ccuugagucauccggcug

SEQ ID NO: 135835 - RNA, 18 nt, Artificial Sequence
  Description of Artificial Sequence: Synthetic oligonucleotide
agcugccuugagucaucc

SEQ ID NO: 135836 - RNA, 18 nt, Artificial Sequence
  Description of Artificial Sequence: Synthetic oligonucleotide
agauaagcugccuugagu

SEQ ID NO: 135837 - RNA, 18 nt, Artificial Sequence
  Description of Artificial Sequence: Synthetic oligonucleotide
ucagaagauaagcugccu

SEQ ID NO: 135838 - RNA, 18 nt, Artificial Sequence
  Description of Artificial Sequence: Synthetic oligonucleotide
cagauucagaagauaagc

SEQ ID NO: 135839 - RNA, 18 nt, Artificial Sequence
  Description of Artificial Sequence: Synthetic oligonucleotide
aggcccagauucagaaga

SEQ ID NO: 135840 - RNA, 18 nt, Artificial Sequence
  Description of Artificial Sequence: Synthetic oligonucleotide
agcugaggcccagauuca

SEQ ID NO: 135841 - RNA, 18 nt, Artificial Sequence
  Description of Artificial Sequence: Synthetic oligonucleotide
aaggaagcugaggcccag

SEQ ID NO: 135842 - RNA, 18 nt, Artificial Sequence
  Description of Artificial Sequence: Synthetic oligonucleotide
cagguaaggaagcugagg

SEQ ID NO: 135843 - RNA, 18 nt, Artificial Sequence
  Description of Artificial Sequence: Synthetic oligonucleotide
uuucacagguaaggaagc

SEQ ID NO: 135844 - RNA, 18 nt, Artificial Sequence
  Description of Artificial Sequence: Synthetic oligonucleotide
ucccauuucacagguaag

SEQ ID NO: 135845 - RNA, 18 nt, Artificial Sequence
  Description of Artificial Sequence: Synthetic oligonucleotide
gugacucccauuucacag

SEQ ID NO: 135846 - RNA, 18 nt, Artificial Sequence
  Description of Artificial Sequence: Synthetic oligonucleotide
ggauggugacucccauuu

SEQ ID NO: 135847 - RNA, 18 nt, Artificial Sequence
  Description of Artificial Sequence: Synthetic oligonucleotide
ugcagggauggugacucc

SEQ ID NO: 135848 - RNA, 18 nt, Artificial Sequence
  Description of Artificial Sequence: Synthetic oligonucleotide
ggaccugcagggauggug

SEQ ID NO: 135849 - RNA, 18 nt, Artificial Sequence
  Description of Artificial Sequence: Synthetic oligonucleotide
gaggaggaccugcaggga

SEQ ID NO: 135850 - RNA, 18 nt, Artificial Sequence
  Description of Artificial Sequence: Synthetic oligonucleotide
ugugggaggaggaccugc

SEQ ID NO: 135851 - RNA, 18 nt, Artificial Sequence
  Description of Artificial Sequence: Synthetic oligonucleotide
gugccugugggaggagga

SEQ ID NO: 135852 - RNA, 18 nt, Artificial Sequence
  Description of Artificial Sequence: Synthetic oligonucleotide
agcuggugccugugggag

SEQ ID NO: 135853 - RNA, 18 nt, Artificial Sequence
  Description of Artificial Sequence: Synthetic oligonucleotide
aagauagcuggugccugu

SEQ ID NO: 135854 - RNA, 18 nt, Artificial Sequence
  Description of Artificial Sequence: Synthetic oligonucleotide
uuggcaagauagcuggug

SEQ ID NO: 135855 - RNA, 18 nt, Artificial Sequence
  Description of Artificial Sequence: Synthetic oligonucleotide
uuaaguuggcaagauagc

SEQ ID NO: 135856 - RNA, 18 nt, Artificial Sequence
  Description of Artificial Sequence: Synthetic oligonucleotide
ggcuuuuaaguuggcaag

SEQ ID NO: 135857 - RNA, 18 nt, Artificial Sequence
  Description of Artificial Sequence: Synthetic oligonucleotide
guuuuggcuuuuaaguug

SEQ ID NO: 135858 - RNA, 18 nt, Artificial Sequence
  Description of Artificial Sequence: Synthetic oligonucleotide
cucuaguuuuggcuuuua

SEQ ID NO: 135859 - RNA, 18 nt, Artificial Sequence
  Description of Artificial Sequence: Synthetic oligonucleotide
cucuccucuaguuuuggc

SEQ ID NO: 135860 - RNA, 18 nt, Artificial Sequence
  Description of Artificial Sequence: Synthetic oligonucleotide
gaccccucuccucuaguu

SEQ ID NO: 135861 - RNA, 18 nt, Artificial Sequence
  Description of Artificial Sequence: Synthetic oligonucleotide
ggguugaccccucuccuc

SEQ ID NO: 135862 - RNA, 18 nt, Artificial Sequence
  Description of Artificial Sequence: Synthetic oligonucleotide
accuuggguugaccccuc

SEQ ID NO: 135863 - RNA, 18 nt, Artificial Sequence
  Description of Artificial Sequence: Synthetic oligonucleotide
aagucaccuuggguugac

SEQ ID NO: 135864 - RNA, 18 nt, Artificial Sequence
  Description of Artificial Sequence: Synthetic oligonucleotide
augggaagucaccuuggg

SEQ ID NO: 135865 - RNA, 18 nt, Artificial Sequence
  Description of Artificial Sequence: Synthetic oligonucleotide
ggaggaugggaagucacc

SEQ ID NO: 135866 - RNA, 18 nt, Artificial Sequence
  Description of Artificial Sequence: Synthetic oligonucleotide
gggagggaggaugggaag

SEQ ID NO: 135867 - RNA, 18 nt, Artificial Sequence
  Description of Artificial Sequence: Synthetic oligonucleotide
gggacaauguagucauug

SEQ ID NO: 135868 - RNA, 18 nt, Artificial Sequence
  Description of Artificial Sequence: Synthetic oligonucleotide
gccgagggacaauguagu

SEQ ID NO: 135869 - RNA, 18 nt, Artificial Sequence
  Description of Artificial Sequence: Synthetic oligonucleotide
gcagugccgagggacaau

SEQ ID NO: 135870 - RNA, 18 nt, Artificial Sequence
  Description of Artificial Sequence: Synthetic oligonucleotide
uccgggcagugccgaggg

SEQ ID NO: 135871 - RNA, 18 nt, Artificial Sequence
  Description of Artificial Sequence: Synthetic oligonucleotide
ccagcuccgggcagugcc

SEQ ID NO: 135872 - RNA, 18 nt, Artificial Sequence
  Description of Artificial Sequence: Synthetic oligonucleotide
cuccgccagcuccgggca

SEQ ID NO: 135873 - RNA, 18 nt, Artificial Sequence
  Description of Artificial Sequence: Synthetic oligonucleotide
cucaucuccgccagcucc

SEQ ID NO: 135874 - RNA, 18 nt, Artificial Sequence
  Description of Artificial Sequence: Synthetic oligonucleotide
cccggcucaucuccgcca

SEQ ID NO: 135875 - RNA, 18 nt, Artificial Sequence
  Description of Artificial Sequence: Synthetic oligonucleotide
ggacacccggcucaucuc

SEQ ID NO: 135876 - RNA, 18 nt, Artificial Sequence
  Description of Artificial Sequence: Synthetic oligonucleotide
cguauggacacccggcuc

SEQ ID NO: 135877 - RNA, 18 nt, Artificial Sequence
  Description of Artificial Sequence: Synthetic oligonucleotide
ggaugcguauggacaccc

SEQ ID NO: 135878 - RNA, 18 nt, Artificial Sequence
  Description of Artificial Sequence: Synthetic oligonucleotide
gucaaggaugcguaugga

SEQ ID NO: 135879 - RNA, 18 nt, Artificial Sequence
  Description of Artificial Sequence: Synthetic oligonucleotide
agcucgucaaggaugcgu

SEQ ID NO: 135880 - RNA, 18 nt, Artificial Sequence
  Description of Artificial Sequence: Synthetic oligonucleotide
gcaccagcucgucaagga

SEQ ID NO: 135881 - RNA, 18 nt, Artificial Sequence
  Description of Artificial Sequence: Synthetic oligonucleotide
gggcagcaccagcucguc

SEQ ID NO: 135882 - RNA, 18 nt, Artificial Sequence
  Description of Artificial Sequence: Synthetic oligonucleotide
uggaagggcagcaccagc

SEQ ID NO: 135883 - RNA, 18 nt, Artificial Sequence
  Description of Artificial Sequence: Synthetic oligonucleotide
gcuccuggaagggcagca

SEQ ID NO: 135884 - RNA, 18 nt, Artificial Sequence
  Description of Artificial Sequence: Synthetic oligonucleotide
cugcagcuccuggaaggg

SEQ ID NO: 135885 - RNA, 18 nt, Artificial Sequence
  Description of Artificial Sequence: Synthetic oligonucleotide
ucgaucugcagcuccugg

SEQ ID NO: 135886 - RNA, 18 nt, Artificial Sequence
  Description of Artificial Sequence: Synthetic oligonucleotide
ugucaucgaucugcagcu

SEQ ID NO: 135887 - RNA, 18 nt, Artificial Sequence
  Description of Artificial Sequence: Synthetic oligonucleotide
cucauugucaucgaucug

SEQ ID NO: 135888 - RNA, 18 nt, Artificial Sequence
  Description of Artificial Sequence: Synthetic oligonucleotide
gcauacucauugucaucg

SEQ ID NO: 135889 - RNA, 18 nt, Artificial Sequence
  Description of Artificial Sequence: Synthetic oligonucleotide
gguaggcauacucauugu

SEQ ID NO: 135890 - RNA, 18 nt, Artificial Sequence
  Description of Artificial Sequence: Synthetic oligonucleotide
uuugagguaggcauacuc

SEQ ID NO: 135891 - RNA, 18 nt, Artificial Sequence
  Description of Artificial Sequence: Synthetic oligonucleotide
auggcuuugagguaggca

SEQ ID NO: 135892 - RNA, 18 nt, Artificial Sequence
  Description of Artificial Sequence: Synthetic oligonucleotide
agaugauggcuuugaggu

SEQ ID NO: 135893 - RNA, 18 nt, Artificial Sequence
  Description of Artificial Sequence: Synthetic oligonucleotide
aaagaagaugauggcuuu

SEQ ID NO: 135894 - RNA, 18 nt, Artificial Sequence
  Description of Artificial Sequence: Synthetic oligonucleotide
gggucaaagaagaugaug

SEQ ID NO: 135895 - RNA, 18 nt, Artificial Sequence
  Description of Artificial Sequence: Synthetic oligonucleotide
ggacaauguagucauugc

SEQ ID NO: 135896 - RNA, 18 nt, Artificial Sequence
  Description of Artificial Sequence: Synthetic oligonucleotide
ccgagggacaauguaguc

SEQ ID NO: 135897 - RNA, 18 nt, Artificial Sequence
  Description of Artificial Sequence: Synthetic oligonucleotide
cagugccgagggacaaug

SEQ ID NO: 135898 - RNA, 18 nt, Artificial Sequence
  Description of Artificial Sequence: Synthetic oligonucleotide
ccgggcagugccgaggga

SEQ ID NO: 135899 - RNA, 18 nt, Artificial Sequence
  Description of Artificial Sequence: Synthetic oligonucleotide
cagcuccgggcagugccg

SEQ ID NO: 135900 - RNA, 18 nt, Artificial Sequence
  Description of Artificial Sequence: Synthetic oligonucleotide
uccgccagcuccgggcag

SEQ ID NO: 135901 - RNA, 18 nt, Artificial Sequence
  Description of Artificial Sequence: Synthetic oligonucleotide
ucaucuccgccagcuccg

SEQ ID NO: 135902 - RNA, 18 nt, Artificial Sequence
  Description of Artificial Sequence: Synthetic oligonucleotide
ccggcucaucuccgccag

SEQ ID NO: 135903 - RNA, 18 nt, Artificial Sequence
  Description of Artificial Sequence: Synthetic oligonucleotide
gacacccggcucaucucc

SEQ ID NO: 135904 - RNA, 18 nt, Artificial Sequence
  Description of Artificial Sequence: Synthetic oligonucleotide
guauggacacccggcuca

SEQ ID NO: 135905 - RNA, 18 nt, Artificial Sequence
  Description of Artificial Sequence: Synthetic oligonucleotide
gaugcguauggacacccg

SEQ ID NO: 135906 - RNA, 18 nt, Artificial Sequence
  Description of Artificial Sequence: Synthetic oligonucleotide
ucaaggaugcguauggac

SEQ ID NO: 135907 - RNA, 18 nt, Artificial Sequence
  Description of Artificial Sequence: Synthetic oligonucleotide
gcucgucaaggaugcgua

SEQ ID NO: 135908 - RNA, 18 nt, Artificial Sequence
  Description of Artificial Sequence: Synthetic oligonucleotide
caccagcucgucaaggau

SEQ ID NO: 135909 - RNA, 18 nt, Artificial Sequence
  Description of Artificial Sequence: Synthetic oligonucleotide
ggcagcaccagcucguca

SEQ ID NO: 135910 - RNA, 18 nt, Artificial Sequence
  Description of Artificial Sequence: Synthetic oligonucleotide
ggaagggcagcaccagcu

SEQ ID NO: 135911 - RNA, 18 nt, Artificial Sequence
  Description of Artificial Sequence: Synthetic oligonucleotide
cuccuggaagggcagcac

SEQ ID NO: 135912 - RNA, 18 nt, Artificial Sequence
  Description of Artificial Sequence: Synthetic oligonucleotide
ugcagcuccuggaagggc

SEQ ID NO: 135913 - RNA, 18 nt, Artificial Sequence
  Description of Artificial Sequence: Synthetic oligonucleotide
cgaucugcagcuccugga

SEQ ID NO: 135914 - RNA, 18 nt, Artificial Sequence
  Description of Artificial Sequence: Synthetic oligonucleotide
gucaucgaucugcagcuc

SEQ ID NO: 135915 - RNA, 18 nt, Artificial Sequence
  Description of Artificial Sequence: Synthetic oligonucleotide
ucauugucaucgaucugc

SEQ ID NO: 135916 - RNA, 18 nt, Artificial Sequence
  Description of Artificial Sequence: Synthetic oligonucleotide
cauacucauugucaucga

SEQ ID NO: 135917 - RNA, 18 nt, Artificial Sequence
  Description of Artificial Sequence: Synthetic oligonucleotide
guaggcauacucauuguc

SEQ ID NO: 135918 - RNA, 18 nt, Artificial Sequence
  Description of Artificial Sequence: Synthetic oligonucleotide
uugagguaggcauacuca

SEQ ID NO: 135919 - RNA, 18 nt, Artificial Sequence
  Description of Artificial Sequence: Synthetic oligonucleotide
uggcuuugagguaggcau

SEQ ID NO: 135920 - RNA, 18 nt, Artificial Sequence
  Description of Artificial Sequence: Synthetic oligonucleotide
gaugauggcuuugaggua

SEQ ID NO: 135921 - RNA, 18 nt, Artificial Sequence
  Description of Artificial Sequence: Synthetic oligonucleotide
aagaagaugauggcuuug

SEQ ID NO: 135922 - RNA, 18 nt, Artificial Sequence
  Description of Artificial Sequence: Synthetic oligonucleotide
ggucaaagaagaugaugg

SEQ ID NO: 135923 - RNA, 18 nt, Artificial Sequence
  Description of Artificial Sequence: Synthetic oligonucleotide
ggcuuaggaggugugcac

SEQ ID NO: 135924 - RNA, 18 nt, Artificial Sequence
  Description of Artificial Sequence: Synthetic oligonucleotide
gggauggcuuaggaggug

SEQ ID NO: 135925 - RNA, 18 nt, Artificial Sequence
  Description of Artificial Sequence: Synthetic oligonucleotide
agucagggauggcuuagg

SEQ ID NO: 135926 - RNA, 18 nt, Artificial Sequence
  Description of Artificial Sequence: Synthetic oligonucleotide
gagagagucagggauggc

SEQ ID NO: 135927 - RNA, 18 nt, Artificial Sequence
  Description of Artificial Sequence: Synthetic oligonucleotide
cuggagagagagucaggg

SEQ ID NO: 135928 - RNA, 18 nt, Artificial Sequence
  Description of Artificial Sequence: Synthetic oligonucleotide
gcguucuggagagagagu

SEQ ID NO: 135929 - RNA, 18 nt, Artificial Sequence
  Description of Artificial Sequence: Synthetic oligonucleotide
gcagagcguucuggagag

SEQ ID NO: 135930 - RNA, 18 nt, Artificial Sequence
  Description of Artificial Sequence: Synthetic oligonucleotide
gucuggcagagcguucug

SEQ ID NO: 135931 - RNA, 18 nt, Artificial Sequence
  Description of Artificial Sequence: Synthetic oligonucleotide
gagaagucuggcagagcg

SEQ ID NO: 135932 - RNA, 18 nt, Artificial Sequence
  Description of Artificial Sequence: Synthetic oligonucleotide
aauaggagaagucuggca

SEQ ID NO: 135933 - RNA, 18 nt, Artificial Sequence
  Description of Artificial Sequence: Synthetic oligonucleotide
aacccaauaggagaaguc

SEQ ID NO: 135934 - RNA, 18 nt, Artificial Sequence
  Description of Artificial Sequence: Synthetic oligonucleotide
uacagaacccaauaggag

SEQ ID NO: 135935 - RNA, 18 nt, Artificial Sequence
  Description of Artificial Sequence: Synthetic oligonucleotide
caguguacagaacccaau

SEQ ID NO: 135936 - RNA, 18 nt, Artificial Sequence
  Description of Artificial Sequence: Synthetic oligonucleotide
gaacucaguguacagaac

SEQ ID NO: 135937 - RNA, 18 nt, Artificial Sequence
  Description of Artificial Sequence: Synthetic oligonucleotide
gcugugaacucaguguac

SEQ ID NO: 135938 - RNA, 18 nt, Artificial Sequence
  Description of Artificial Sequence: Synthetic oligonucleotide
augaggcugugaacucag

SEQ ID NO: 135939 - RNA, 18 nt, Artificial Sequence
  Description of Artificial Sequence: Synthetic oligonucleotide
augagaugaggcugugaa

SEQ ID NO: 135940 - RNA, 18 nt, Artificial Sequence
  Description of Artificial Sequence: Synthetic oligonucleotide
uuaacaugagaugaggcu

SEQ ID NO: 135941 - RNA, 18 nt, Artificial Sequence
  Description of Artificial Sequence: Synthetic oligonucleotide
ugucguuaacaugagaug

SEQ ID NO: 135942 - RNA, 18 nt, Artificial Sequence
  Description of Artificial Sequence: Synthetic oligonucleotide
cuggcugucguuaacaug

SEQ ID NO: 135943 - RNA, 18 nt, Artificial Sequence
  Description of Artificial Sequence: Synthetic oligonucleotide
cucuccuggcugucguua

SEQ ID NO: 135944 - RNA, 18 nt, Artificial Sequence
  Description of Artificial Sequence: Synthetic oligonucleotide
acggccucuccuggcugu

SEQ ID NO: 135945 - RNA, 18 nt, Artificial Sequence
  Description of Artificial Sequence: Synthetic oligonucleotide
ugaaaacggccucuccug

SEQ ID NO: 135946 - RNA, 18 nt, Artificial Sequence
  Description of Artificial Sequence: Synthetic oligonucleotide
uuaaaugaaaacggccuc

SEQ ID NO: 135947 - RNA, 18 nt, Artificial Sequence
  Description of Artificial Sequence: Synthetic oligonucleotide
aucuguuaaaugaaaacg

SEQ ID NO: 135948 - RNA, 18 nt, Artificial Sequence
  Description of Artificial Sequence: Synthetic oligonucleotide
gccucaucuguuaaauga

SEQ ID NO: 135949 - RNA, 18 nt, Artificial Sequence
  Description of Artificial Sequence: Synthetic oligonucleotide
gacuugccucaucuguua

SEQ ID NO: 135950 - RNA, 18 nt, Artificial Sequence
  Description of Artificial Sequence: Synthetic oligonucleotide
aucuugacuugccucauc

SEQ ID NO: 135951 - RNA, 18 nt, Artificial Sequence
  Description of Artificial Sequence: Synthetic oligonucleotide
uucaaaucuugacuugcc

SEQ ID NO: 135952 - RNA, 18 nt, Artificial Sequence
  Description of Artificial Sequence: Synthetic oligonucleotide
gucucuucaaaucuugac

SEQ ID NO: 135953 - RNA, 18 nt, Artificial Sequence
  Description of Artificial Sequence: Synthetic oligonucleotide
auauugucucuucaaauc

SEQ ID NO: 135954 - RNA, 18 nt, Artificial Sequence
  Description of Artificial Sequence: Synthetic oligonucleotide
cggccauauugucucuuc

SEQ ID NO: 135955 - RNA, 18 nt, Artificial Sequence
  Description of Artificial Sequence: Synthetic oligonucleotide
gcgcccggccauauuguc

SEQ ID NO: 135956 - RNA, 18 nt, Artificial Sequence
  Description of Artificial Sequence: Synthetic oligonucleotide
ccacugcgcccggccaua

SEQ ID NO: 135957 - RNA, 18 nt, Artificial Sequence
  Description of Artificial Sequence: Synthetic oligonucleotide
gugagccacugcgcccgg

SEQ ID NO: 135958 - RNA, 18 nt, Artificial Sequence
  Description of Artificial Sequence: Synthetic oligonucleotide
caggugugagccacugcg

SEQ ID NO: 135959 - RNA, 18 nt, Artificial Sequence
  Description of Artificial Sequence: Synthetic oligonucleotide
gauuacaggugugagcca

SEQ ID NO: 135960 - RNA, 18 nt, Artificial Sequence
  Description of Artificial Sequence: Synthetic oligonucleotide
gcugggauuacaggugug

SEQ ID NO: 135961 - RNA, 18 nt, Artificial Sequence
  Description of Artificial Sequence: Synthetic oligonucleotide
aaagugcugggauuacag

SEQ ID NO: 135962 - RNA, 18 nt, Artificial Sequence
  Description of Artificial Sequence: Synthetic oligonucleotide
cucccaaagugcugggau

SEQ ID NO: 135963 - RNA, 18 nt, Artificial Sequence
  Description of Artificial Sequence: Synthetic oligonucleotide
ucagccucccaaagugcu

SEQ ID NO: 135964 - RNA, 18 nt, Artificial Sequence
  Description of Artificial Sequence: Synthetic oligonucleotide
ccgccucagccucccaaa

SEQ ID NO: 135965 - RNA, 18 nt, Artificial Sequence
  Description of Artificial Sequence: Synthetic oligonucleotide
uccgcccgccucagccuc

SEQ ID NO: 135966 - RNA, 18 nt, Artificial Sequence
  Description of Artificial Sequence: Synthetic oligonucleotide
ggugauccgcccgccuca

SEQ ID NO: 135967 - RNA, 18 nt, Artificial Sequence
  Description of Artificial Sequence: Synthetic oligonucleotide
ccucaggugauccgcccg

SEQ ID NO: 135968 - RNA, 18 nt, Artificial Sequence
  Description of Artificial Sequence: Synthetic oligonucleotide
ccugaccucaggugaucc

SEQ ID NO: 135969 - RNA, 18 nt, Artificial Sequence
  Description of Artificial Sequence: Synthetic oligonucleotide
gaaccccugaccucaggu

SEQ ID NO: 135970 - RNA, 18 nt, Artificial Sequence
  Description of Artificial Sequence: Synthetic oligonucleotide
aucuugaaccccugaccu

SEQ ID NO: 135971 - RNA, 18 nt, Artificial Sequence
  Description of Artificial Sequence: Synthetic oligonucleotide
ggcucaucuugaaccccu

SEQ ID NO: 135972 - RNA, 18 nt, Artificial Sequence
  Description of Artificial Sequence: Synthetic oligonucleotide
agccaggcucaucuugaa

SEQ ID NO: 135973 - RNA, 18 nt, Artificial Sequence
  Description of Artificial Sequence: Synthetic oligonucleotide
auguuagccaggcucauc

SEQ ID NO: 135974 - RNA, 18 nt, Artificial Sequence
  Description of Artificial Sequence: Synthetic oligonucleotide
ucuccauguuagccaggc

SEQ ID NO: 135975 - RNA, 18 nt, Artificial Sequence
  Description of Artificial Sequence: Synthetic oligonucleotide
ggguuucuccauguuagc

SEQ ID NO: 135976 - RNA, 18 nt, Artificial Sequence
  Description of Artificial Sequence: Synthetic oligonucleotide
uuguauuuuuaguagaga

SEQ ID NO: 135977 - RNA, 18 nt, Artificial Sequence
  Description of Artificial Sequence: Synthetic oligonucleotide
aauuuuuguauuuuuagu

SEQ ID NO: 135978 - RNA, 18 nt, Artificial Sequence
  Description of Artificial Sequence: Synthetic oligonucleotide
uggcuaauuuuuguauuu

SEQ ID NO: 135979 - RNA, 18 nt, Artificial Sequence
  Description of Artificial Sequence: Synthetic oligonucleotide
augccuggcuaauuuuug

SEQ ID NO: 135980 - RNA, 18 nt, Artificial Sequence
  Description of Artificial Sequence: Synthetic oligonucleotide
ccaccaugccuggcuaau

SEQ ID NO: 135981 - RNA, 18 nt, Artificial Sequence
  Description of Artificial Sequence: Synthetic oligonucleotide
gugcaccaccaugccugg

SEQ ID NO: 135982 - RNA, 18 nt, Artificial Sequence
  Description of Artificial Sequence: Synthetic oligonucleotide
caggcgugcaccaccaug

SEQ ID NO: 135983 - RNA, 18 nt, Artificial Sequence
  Description of Artificial Sequence: Synthetic oligonucleotide
gauuacaggcgugcacca

SEQ ID NO: 135984 - RNA, 18 nt, Artificial Sequence
  Description of Artificial Sequence: Synthetic oligonucleotide
gcugggauuacaggcgug

SEQ ID NO: 135985 - RNA, 18 nt, Artificial Sequence
  Description of Artificial Sequence: Synthetic oligonucleotide
gaauagcugggauuacag

SEQ ID NO: 135986 - RNA, 18 nt, Artificial Sequence
  Description of Artificial Sequence: Synthetic oligonucleotide
cucccgaauagcugggau

SEQ ID NO: 135987 - RNA, 18 nt, Artificial Sequence
  Description of Artificial Sequence: Synthetic oligonucleotide
ucagccucccgaauagcu

SEQ ID NO: 135988 - RNA, 18 nt, Artificial Sequence
  Description of Artificial Sequence: Synthetic oligonucleotide
cugccucagccucccgaa

SEQ ID NO: 135989 - RNA, 18 nt, Artificial Sequence
  Description of Artificial Sequence: Synthetic oligonucleotide
uucuccugccucagccuc

SEQ ID NO: 135990 - RNA, 18 nt, Artificial Sequence
  Description of Artificial Sequence: Synthetic oligonucleotide
agcaauucuccugccuca

SEQ ID NO: 135991 - RNA, 18 nt, Artificial Sequence
  Description of Artificial Sequence: Synthetic oligonucleotide
guucaagcaauucuccug

SEQ ID NO: 135992 - RNA, 18 nt, Artificial Sequence
  Description of Artificial Sequence: Synthetic oligonucleotide
cccagguucaagcaauuc

SEQ ID NO: 135993 - RNA, 18 nt, Artificial Sequence
  Description of Artificial Sequence: Synthetic oligonucleotide
cgccucccagguucaagc

SEQ ID NO: 135994 - RNA, 18 nt, Artificial Sequence
  Description of Artificial Sequence: Synthetic oligonucleotide
accuccgccucccagguu

SEQ ID NO: 135995 - RNA, 18 nt, Artificial Sequence
  Description of Artificial Sequence: Synthetic oligonucleotide
cugcaaccuccgccuccc

SEQ ID NO: 135996 - RNA, 18 nt, Artificial Sequence
  Description of Artificial Sequence: Synthetic oligonucleotide
gcucacugcaaccuccgc

SEQ ID NO: 135997 - RNA, 18 nt, Artificial Sequence
  Description of Artificial Sequence: Synthetic oligonucleotide
ucuuggcucacugcaacc

SEQ ID NO: 135998 - RNA, 18 nt, Artificial Sequence
  Description of Artificial Sequence: Synthetic oligonucleotide
cgggaucuuggcucacug

SEQ ID NO: 135999 - RNA, 18 nt, Artificial Sequence
  Description of Artificial Sequence: Synthetic oligonucleotide
aguggcgggaucuuggcu

SEQ ID NO: 136000 - RNA, 18 nt, Artificial Sequence
  Description of Artificial Sequence: Synthetic oligonucleotide
aaugcaguggcgggaucu

SEQ ID NO: 136001 - RNA, 18 nt, Artificial Sequence
  Description of Artificial Sequence: Synthetic oligonucleotide
gcuggaaugcaguggcgg

SEQ ID NO: 136002 - RNA, 18 nt, Artificial Sequence
  Description of Artificial Sequence: Synthetic oligonucleotide
cccaggcuggaaugcagu

SEQ ID NO: 136003 - RNA, 18 nt, Artificial Sequence
  Description of Artificial Sequence: Synthetic oligonucleotide
agucacccaggcuggaau

SEQ ID NO: 136004 - RNA, 18 nt, Artificial Sequence
  Description of Artificial Sequence: Synthetic oligonucleotide
gauggagucacccaggcu

SEQ ID NO: 136005 - RNA, 18 nt, Artificial Sequence
  Description of Artificial Sequence: Synthetic oligonucleotide
uuugagauggagucaccc

SEQ ID NO: 136006 - RNA, 18 nt, Artificial Sequence
  Description of Artificial Sequence: Synthetic oligonucleotide
guuuuuuugagauggagu

SEQ ID NO: 136007 - RNA, 18 nt, Artificial Sequence
  Description of Artificial Sequence: Synthetic oligonucleotide
uuuuuguuuuuuugagau

SEQ ID NO: 136008 - RNA, 18 nt, Artificial Sequence
  Description of Artificial Sequence: Synthetic oligonucleotide
cuuuguuuuuguuuuuuu

SEQ ID NO: 136009 - RNA, 18 nt, Artificial Sequence
  Description of Artificial Sequence: Synthetic oligonucleotide
ccucccuuuguuuuuguu

SEQ ID NO: 136010 - RNA, 18 nt, Artificial Sequence
  Description of Artificial Sequence: Synthetic oligonucleotide
cauauccucccuuuguuu

SEQ ID NO: 136011 - RNA, 18 nt, Artificial Sequence
  Description of Artificial Sequence: Synthetic oligonucleotide
caagucauauccucccuu

SEQ ID NO: 136012 - RNA, 18 nt, Artificial Sequence
  Description of Artificial Sequence: Synthetic oligonucleotide
ccugucaagucauauccu

SEQ ID NO: 136013 - RNA, 18 nt, Artificial Sequence
  Description of Artificial Sequence: Synthetic oligonucleotide
ggugcccugucaagucau

SEQ ID NO: 136014 - RNA, 18 nt, Artificial Sequence
  Description of Artificial Sequence: Synthetic oligonucleotide
gucagggugcccugucaa

SEQ ID NO: 136015 - RNA, 18 nt, Artificial Sequence
  Description of Artificial Sequence: Synthetic oligonucleotide
uuggagucagggugcccu

SEQ ID NO: 136016 - RNA, 18 nt, Artificial Sequence
  Description of Artificial Sequence: Synthetic oligonucleotide
ggccuuuggagucagggu

SEQ ID NO: 136017 - RNA, 18 nt, Artificial Sequence
  Description of Artificial Sequence: Synthetic oligonucleotide
gcccaggccuuuggaguc

SEQ ID NO: 136018 - RNA, 18 nt, Artificial Sequence
  Description of Artificial Sequence: Synthetic oligonucleotide
ggaaagcccaggccuuug

SEQ ID NO: 136019 - RNA, 18 nt, Artificial Sequence
  Description of Artificial Sequence: Synthetic oligonucleotide
acucagguuagguuucac

SEQ ID NO: 136020 - RNA, 18 nt, Artificial Sequence
  Description of Artificial Sequence: Synthetic oligonucleotide
uagggacucagguuaggu

SEQ ID NO: 136021 - RNA, 18 nt, Artificial Sequence
  Description of Artificial Sequence: Synthetic oligonucleotide
caccuuagggacucaggu

SEQ ID NO: 136022 - RNA, 18 nt, Artificial Sequence
  Description of Artificial Sequence: Synthetic oligonucleotide
ccuaucaccuuagggacu

SEQ ID NO: 136023 - RNA, 18 nt, Artificial Sequence
  Description of Artificial Sequence: Synthetic oligonucleotide
ugcuuccuaucaccuuag

SEQ ID NO: 136024 - RNA, 18 nt, Artificial Sequence
  Description of Artificial Sequence: Synthetic oligonucleotide
guuccugcuuccuaucac

SEQ ID NO: 136025 - RNA, 18 nt, Artificial Sequence
  Description of Artificial Sequence: Synthetic oligonucleotide
cccugguuccugcuuccu

SEQ ID NO: 136026 - RNA, 18 nt, Artificial Sequence
  Description of Artificial Sequence: Synthetic oligonucleotide
cccuucccugguuccugc

SEQ ID NO: 136027 - RNA, 18 nt, Artificial Sequence
  Description of Artificial Sequence: Synthetic oligonucleotide
ggcuccccuucccugguu

SEQ ID NO: 136028 - RNA, 18 nt, Artificial Sequence
  Description of Artificial Sequence: Synthetic oligonucleotide
gaauaggcuccccuuccc

SEQ ID NO: 136029 - RNA, 18 nt, Artificial Sequence
  Description of Artificial Sequence: Synthetic oligonucleotide
uguuagaauaggcucccc

SEQ ID NO: 136030 - RNA, 18 nt, Artificial Sequence
  Description of Artificial Sequence: Synthetic oligonucleotide
uacuguguuagaauaggc

SEQ ID NO: 136031 - RNA, 18 nt, Artificial Sequence
  Description of Artificial Sequence: Synthetic oligonucleotide
gcuucuacuguguuagaa

SEQ ID NO: 136032 - RNA, 18 nt, Artificial Sequence
  Description of Artificial Sequence: Synthetic oligonucleotide
uugcugcuucuacugugu

SEQ ID NO: 136033 - RNA, 18 nt, Artificial Sequence
  Description of Artificial Sequence: Synthetic oligonucleotide
agcaguugcugcuucuac

SEQ ID NO: 136034 - RNA, 18 nt, Artificial Sequence
  Description of Artificial Sequence: Synthetic oligonucleotide
accucagcaguugcugcu

SEQ ID NO: 136035 - RNA, 18 nt, Artificial Sequence
  Description of Artificial Sequence: Synthetic oligonucleotide
uccagaccucagcaguug

SEQ ID NO: 136036 - RNA, 18 nt, Artificial Sequence
  Description of Artificial Sequence: Synthetic oligonucleotide
ccucauccagaccucagc

SEQ ID NO: 136037 - RNA, 18 nt, Artificial Sequence
  Description of Artificial Sequence: Synthetic oligonucleotide
gguccccucauccagacc

SEQ ID NO: 136038 - RNA, 18 nt, Artificial Sequence
  Description of Artificial Sequence: Synthetic oligonucleotide
guugagguccccucaucc

SEQ ID NO: 136039 - RNA, 18 nt, Artificial Sequence
  Description of Artificial Sequence: Synthetic oligonucleotide
ccacaguugagguccccu

SEQ ID NO: 136040 - RNA, 18 nt, Artificial Sequence
  Description of Artificial Sequence: Synthetic oligonucleotide
uugggccacaguugaggu

SEQ ID NO: 136041 - RNA, 18 nt, Artificial Sequence
  Description of Artificial Sequence: Synthetic oligonucleotide
ggguuuugggccacaguu

SEQ ID NO: 136042 - RNA, 18 nt, Artificial Sequence
  Description of Artificial Sequence: Synthetic oligonucleotide
ccacaaugggaacuuggg

SEQ ID NO: 136043 - RNA, 18 nt, Artificial Sequence
  Description of Artificial Sequence: Synthetic oligonucleotide
gccacaaugggaacuugg

SEQ ID NO: 136044 - RNA, 18 nt, Artificial Sequence
  Description of Artificial Sequence: Synthetic oligonucleotide
gcagagccacaaugggaa

SEQ ID NO: 136045 - RNA, 18 nt, Artificial Sequence
  Description of Artificial Sequence: Synthetic oligonucleotide
uguuggcagagccacaau

SEQ ID NO: 136046 - RNA, 18 nt, Artificial Sequence
  Description of Artificial Sequence: Synthetic oligonucleotide
ccaguuguuggcagagcc

SEQ ID NO: 136047 - RNA, 18 nt, Artificial Sequence
  Description of Artificial Sequence: Synthetic oligonucleotide
cacagccaguuguuggca

SEQ ID NO: 136048 - RNA, 18 nt, Artificial Sequence
  Description of Artificial Sequence: Synthetic oligonucleotide
ggucgcacagccaguugu

SEQ ID NO: 136049 - RNA, 18 nt, Artificial Sequence
  Description of Artificial Sequence: Synthetic oligonucleotide
uccugggucgcacagcca

SEQ ID NO: 136050 - RNA, 18 nt, Artificial Sequence
  Description of Artificial Sequence: Synthetic oligonucleotide
acuuguccugggucgcac

SEQ ID NO: 136051 - RNA, 18 nt, Artificial Sequence
  Description of Artificial Sequence: Synthetic oligonucleotide
auaggacuuguccugggu

SEQ ID NO: 136052 - RNA, 18 nt, Artificial Sequence
  Description of Artificial Sequence: Synthetic oligonucleotide
caaagauaggacuugucc

SEQ ID NO: 136053 - RNA, 18 nt, Artificial Sequence
  Description of Artificial Sequence: Synthetic oligonucleotide
cagugcaaagauaggacu

SEQ ID NO: 136054 - RNA, 18 nt, Artificial Sequence
  Description of Artificial Sequence: Synthetic oligonucleotide
agacacagugcaaagaua

SEQ ID NO: 136055 - RNA, 18 nt, Artificial Sequence
  Description of Artificial Sequence: Synthetic oligonucleotide
aacccagacacagugcaa

SEQ ID NO: 136056 - RNA, 18 nt, Artificial Sequence
  Description of Artificial Sequence: Synthetic oligonucleotide
ccucaucuuacacacggg

SEQ ID NO: 136057 - RNA, 18 nt, Artificial Sequence
  Description of Artificial Sequence: Synthetic oligonucleotide
aaccgccucaucuuacac

SEQ ID NO: 136058 - RNA, 18 nt, Artificial Sequence
  Description of Artificial Sequence: Synthetic oligonucleotide
cuagcaaccgccucaucu

SEQ ID NO: 136059 - RNA, 18 nt, Artificial Sequence
  Description of Artificial Sequence: Synthetic oligonucleotide
agcaccuagcaaccgccu

SEQ ID NO: 136060 - RNA, 18 nt, Artificial Sequence
  Description of Artificial Sequence: Synthetic oligonucleotide
caauaagcaccuagcaac

SEQ ID NO: 136061 - RNA, 18 nt, Artificial Sequence
  Description of Artificial Sequence: Synthetic oligonucleotide
gcauccaauaagcaccua

SEQ ID NO: 136062 - RNA, 18 nt, Artificial Sequence
  Description of Artificial Sequence: Synthetic oligonucleotide
ggaaugcauccaauaagc

SEQ ID NO: 136063 - RNA, 18 nt, Artificial Sequence
  Description of Artificial Sequence: Synthetic oligonucleotide
cuugaggaaugcauccaa

SEQ ID NO: 136064 - RNA, 18 nt, Artificial Sequence
  Description of Artificial Sequence: Synthetic oligonucleotide
cgggacuugaggaaugca

SEQ ID NO: 136065 - RNA, 18 nt, Artificial Sequence
  Description of Artificial Sequence: Synthetic oligonucleotide
gagggcgggacuugagga

SEQ ID NO: 136066 - RNA, 18 nt, Artificial Sequence
  Description of Artificial Sequence: Synthetic oligonucleotide
agauggagggcgggacuu

SEQ ID NO: 136067 - RNA, 18 nt, Artificial Sequence
  Description of Artificial Sequence: Synthetic oligonucleotide
auaggagauggagggcgg

SEQ ID NO: 136068 - RNA, 18 nt, Artificial Sequence
  Description of Artificial Sequence: Synthetic oligonucleotide
cuaaaccagaagagaggg

SEQ ID NO: 136069 - RNA, 18 nt, Artificial Sequence
  Description of Artificial Sequence: Synthetic oligonucleotide
aagcacuaaaccagaaga

SEQ ID NO: 136070 - RNA, 18 nt, Artificial Sequence
  Description of Artificial Sequence: Synthetic oligonucleotide
uccuaaagcacuaaacca

SEQ ID NO: 136071 - RNA, 18 nt, Artificial Sequence
  Description of Artificial Sequence: Synthetic oligonucleotide
acauuuccuaaagcacua

SEQ ID NO: 136072 - RNA, 18 nt, Artificial Sequence
  Description of Artificial Sequence: Synthetic oligonucleotide
cugccacauuuccuaaag

SEQ ID NO: 136073 - RNA, 18 nt, Artificial Sequence
  Description of Artificial Sequence: Synthetic oligonucleotide
gauuucugccacauuucc

SEQ ID NO: 136074 - RNA, 18 nt, Artificial Sequence
  Description of Artificial Sequence: Synthetic oligonucleotide
aaaaagauuucugccaca

SEQ ID NO: 136075 - RNA, 18 nt, Artificial Sequence
  Description of Artificial Sequence: Synthetic oligonucleotide
ggcagaaaaagauuucug

SEQ ID NO: 136076 - RNA, 18 nt, Artificial Sequence
  Description of Artificial Sequence: Synthetic oligonucleotide
acacaggcagaaaaagau

SEQ ID NO: 136077 - RNA, 18 nt, Artificial Sequence
  Description of Artificial Sequence: Synthetic oligonucleotide
ccuagacacaggcagaaa

SEQ ID NO: 136078 - RNA, 18 nt, Artificial Sequence
  Description of Artificial Sequence: Synthetic oligonucleotide
gauuuccuagacacaggc

SEQ ID NO: 136079 - RNA, 18 nt, Artificial Sequence
  Description of Artificial Sequence: Synthetic oligonucleotide
auuaugauuuccuagaca

SEQ ID NO: 136080 - RNA, 18 nt, Artificial Sequence
  Description of Artificial Sequence: Synthetic oligonucleotide
caugaauuaugauuuccu

SEQ ID NO: 136081 - RNA, 18 nt, Artificial Sequence
  Description of Artificial Sequence: Synthetic oligonucleotide
gccagcaugaauuaugau

SEQ ID NO: 136082 - RNA, 18 nt, Artificial Sequence
  Description of Artificial Sequence: Synthetic oligonucleotide
gguacgccagcaugaauu

SEQ ID NO: 136083 - RNA, 18 nt, Artificial Sequence
  Description of Artificial Sequence: Synthetic oligonucleotide
accaggguacgccagcau

SEQ ID NO: 136084 - RNA, 18 nt, Artificial Sequence
  Description of Artificial Sequence: Synthetic oligonucleotide
caacaaccaggguacgcc

SEQ ID NO: 136085 - RNA, 18 nt, Artificial Sequence
  Description of Artificial Sequence: Synthetic oligonucleotide
gaccucaacaaccagggu

SEQ ID NO: 136086 - RNA, 18 nt, Artificial Sequence
  Description of Artificial Sequence: Synthetic oligonucleotide
ucagggaccucaacaacc

SEQ ID NO: 136087 - RNA, 18 nt, Artificial Sequence
  Description of Artificial Sequence: Synthetic oligonucleotide
aggauucagggaccucaa

SEQ ID NO: 136088 - RNA, 18 nt, Artificial Sequence
  Description of Artificial Sequence: Synthetic oligonucleotide
gcacaaggauucagggac

SEQ ID NO: 136089 - RNA, 18 nt, Artificial Sequence
  Description of Artificial Sequence: Synthetic oligonucleotide
ugugggcacaaggauuca

SEQ ID NO: 136090 - RNA, 18 nt, Artificial Sequence
  Description of Artificial Sequence: Synthetic oligonucleotide
agcagugugggcacaagg

SEQ ID NO: 136091 - RNA, 18 nt, Artificial Sequence
  Description of Artificial Sequence: Synthetic oligonucleotide
ucuucagcagugugggca

SEQ ID NO: 136092 - RNA, 18 nt, Artificial Sequence
  Description of Artificial Sequence: Synthetic oligonucleotide
aggagucuucagcagugu

SEQ ID NO: 136093 - RNA, 18 nt, Artificial Sequence
  Description of Artificial Sequence: Synthetic oligonucleotide
acacaaggagucuucagc

SEQ ID NO: 136094 - RNA, 18 nt, Artificial Sequence
  Description of Artificial Sequence: Synthetic oligonucleotide
guaucacacaaggagucu

SEQ ID NO: 136095 - RNA, 18 nt, Artificial Sequence
  Description of Artificial Sequence: Synthetic oligonucleotide
gacuuguaucacacaagg

SEQ ID NO: 136096 - RNA, 18 nt, Artificial Sequence
  Description of Artificial Sequence: Synthetic oligonucleotide
ccccugacuuguaucaca

SEQ ID NO: 136097 - RNA, 18 nt, Artificial Sequence
  Description of Artificial Sequence: Synthetic oligonucleotide
gauguccccugacuugua

SEQ ID NO: 136098 - RNA, 18 nt, Artificial Sequence
  Description of Artificial Sequence: Synthetic oligonucleotide
acccagauguccccugac

SEQ ID NO: 136099 - RNA, 18 nt, Artificial Sequence
  Description of Artificial Sequence: Synthetic oligonucleotide
ucaagacccagauguccc

SEQ ID NO: 136100 - RNA, 18 nt, Artificial Sequence
  Description of Artificial Sequence: Synthetic oligonucleotide
gggagucaagacccagau

SEQ ID NO: 136101 - RNA, 18 nt, Artificial Sequence
  Description of Artificial Sequence: Synthetic oligonucleotide
ccagcuggagcaucuggg

SEQ ID NO: 136102 - RNA, 18 nt, Artificial Sequence
  Description of Artificial Sequence: Synthetic oligonucleotide
ggguccagcuggagcauc

SEQ ID NO: 136103 - RNA, 18 nt, Artificial Sequence
  Description of Artificial Sequence: Synthetic oligonucleotide
cagcaggguccagcugga

SEQ ID NO: 136104 - RNA, 18 nt, Artificial Sequence
  Description of Artificial Sequence: Synthetic oligonucleotide
gagggcagcaggguccag

SEQ ID NO: 136105 - RNA, 18 nt, Artificial Sequence
  Description of Artificial Sequence: Synthetic oligonucleotide
caagggagggcagcaggg

SEQ ID NO: 136106 - RNA, 18 nt, Artificial Sequence
  Description of Artificial Sequence: Synthetic oligonucleotide
gugggcaagggagggcag

SEQ ID NO: 136107 - RNA, 18 nt, Artificial Sequence
  Description of Artificial Sequence: Synthetic oligonucleotide
ucgcucagccccuuggca

SEQ ID NO: 136108 - RNA, 18 nt, Artificial Sequence
  Description of Artificial Sequence: Synthetic oligonucleotide
cuggaucgcucagccccu

SEQ ID NO: 136109 - RNA, 18 nt, Artificial Sequence
  Description of Artificial Sequence: Synthetic oligonucleotide
cuucccuggaucgcucag

SEQ ID NO: 136110 - RNA, 18 nt, Artificial Sequence
  Description of Artificial Sequence: Synthetic oligonucleotide
uugaucuucccuggaucg

SEQ ID NO: 136111 - RNA, 18 nt, Artificial Sequence
  Description of Artificial Sequence: Synthetic oligonucleotide
gccgcuugaucuucccug

SEQ ID NO: 136112 - RNA, 18 nt, Artificial Sequence
  Description of Artificial Sequence: Synthetic oligonucleotide
acgcagccgcuugaucuu

SEQ ID NO: 136113 - RNA, 18 nt, Artificial Sequence
  Description of Artificial Sequence: Synthetic oligonucleotide
ugggaacgcagccgcuug

SEQ ID NO: 136114 - RNA, 18 nt, Artificial Sequence
  Description of Artificial Sequence: Synthetic oligonucleotide
gcaccugggaacgcagcc

SEQ ID NO: 136115 - RNA, 18 nt, Artificial Sequence
  Description of Artificial Sequence: Synthetic oligonucleotide
caccugcaccugggaacg

SEQ ID NO: 136116 - RNA, 18 nt, Artificial Sequence
  Description of Artificial Sequence: Synthetic oligonucleotide
aagcucaccugcaccugg

SEQ ID NO: 136117 - RNA, 18 nt, Artificial Sequence
  Description of Artificial Sequence: Synthetic oligonucleotide
ccuccaagcucaccugca

SEQ ID NO: 136118 - RNA, 18 nt, Artificial Sequence
  Description of Artificial Sequence: Synthetic oligonucleotide
guaguccuccaagcucac

SEQ ID NO: 136119 - RNA, 18 nt, Artificial Sequence
  Description of Artificial Sequence: Synthetic oligonucleotide
uugauguaguccuccaag

SEQ ID NO: 136120 - RNA, 18 nt, Artificial Sequence
  Description of Artificial Sequence: Synthetic oligonucleotide
ggucguugauguaguccu

SEQ ID NO: 136121 - RNA, 18 nt, Artificial Sequence
  Description of Artificial Sequence: Synthetic oligonucleotide
cuggcggucguugaugua

SEQ ID NO: 136122 - RNA, 18 nt, Artificial Sequence
  Description of Artificial Sequence: Synthetic oligonucleotide
ucauacuggcggucguug

SEQ ID NO: 136123 - RNA, 18 nt, Artificial Sequence
  Description of Artificial Sequence: Synthetic oligonucleotide
gcgagucauacuggcggu

SEQ ID NO: 136124 - RNA, 18 nt, Artificial Sequence
  Description of Artificial Sequence: Synthetic oligonucleotide
gccacgcgagucauacug

SEQ ID NO: 136125 - RNA, 18 nt, Artificial Sequence
  Description of Artificial Sequence: Synthetic oligonucleotide
aagcggccacgcgaguca

SEQ ID NO: 136126 - RNA, 18 nt, Artificial Sequence
  Description of Artificial Sequence: Synthetic oligonucleotide
cuccaaagcggccacgcg

SEQ ID NO: 136127 - RNA, 18 nt, Artificial Sequence
  Description of Artificial Sequence: Synthetic oligonucleotide
cagcucuccaaagcggcc

SEQ ID NO: 136128 - RNA, 18 nt, Artificial Sequence
  Description of Artificial Sequence: Synthetic oligonucleotide
agcagcagcucuccaaag

SEQ ID NO: 136129 - RNA, 18 nt, Artificial Sequence
  Description of Artificial Sequence: Synthetic oligonucleotide
gcagcagcagcagcucuc

SEQ ID NO: 136130 - RNA, 18 nt, Artificial Sequence
  Description of Artificial Sequence: Synthetic oligonucleotide
gggcagcagcagcagcag

SEQ ID NO: 136131 - RNA, 18 nt, Artificial Sequence
  Description of Artificial Sequence: Synthetic oligonucleotide
aaggugggcagcagcagc

SEQ ID NO: 136132 - RNA, 18 nt, Artificial Sequence
  Description of Artificial Sequence: Synthetic oligonucleotide
ucugcaaggugggcagca

SEQ ID NO: 136133 - RNA, 18 nt, Artificial Sequence
  Description of Artificial Sequence: Synthetic oligonucleotide
gaugcucugcaagguggg

SEQ ID NO: 136134 - RNA, 18 nt, Artificial Sequence
  Description of Artificial Sequence: Synthetic oligonucleotide
caggugaugcucugcaag

SEQ ID NO: 136135 - RNA, 18 nt, Artificial Sequence
  Description of Artificial Sequence: Synthetic oligonucleotide
ucugccaggugaugcucu

SEQ ID NO: 136136 - RNA, 18 nt, Artificial Sequence
  Description of Artificial Sequence: Synthetic oligonucleotide
gaucaucugccaggugau

SEQ ID NO: 136137 - RNA, 18 nt, Artificial Sequence
  Description of Artificial Sequence: Synthetic oligonucleotide
ugcucgaucaucugccag

SEQ ID NO: 136138 - RNA, 18 nt, Artificial Sequence
  Description of Artificial Sequence: Synthetic oligonucleotide
ggaucugcucgaucaucu

SEQ ID NO: 136139 - RNA, 18 nt, Artificial Sequence
  Description of Artificial Sequence: Synthetic oligonucleotide
gaacuggaucugcucgau

SEQ ID NO: 136140 - RNA, 18 nt, Artificial Sequence
  Description of Artificial Sequence: Synthetic oligonucleotide
uugaugaacuggaucugc

SEQ ID NO: 136141 - RNA, 18 nt, Artificial Sequence
  Description of Artificial Sequence: Synthetic oligonucleotide
agagcuugaugaacugga

SEQ ID NO: 136142 - RNA, 18 nt, Artificial Sequence
  Description of Artificial Sequence: Synthetic oligonucleotide
gccgaagagcuugaugaa

SEQ ID NO: 136143 - RNA, 18 nt, Artificial Sequence
  Description of Artificial Sequence: Synthetic oligonucleotide
gccaugccgaagagcuug

SEQ ID NO: 136144 - RNA, 18 nt, Artificial Sequence
  Description of Artificial Sequence: Synthetic oligonucleotide
ucuuggccaugccgaaga

SEQ ID NO: 136145 - RNA, 18 nt, Artificial Sequence
  Description of Artificial Sequence: Synthetic oligonucleotide
gucaaucuuggccaugcc

SEQ ID NO: 136146 - RNA, 18 nt, Artificial Sequence
  Description of Artificial Sequence: Synthetic oligonucleotide
agguugucaaucuuggcc

SEQ ID NO: 136147 - RNA, 18 nt, Artificial Sequence
  Description of Artificial Sequence: Synthetic oligonucleotide
gcaacagguugucaaucu

SEQ ID NO: 136148 - RNA, 18 nt, Artificial Sequence
  Description of Artificial Sequence: Synthetic oligonucleotide
cuccugcaacagguuguc

SEQ ID NO: 136149 - RNA, 18 nt, Artificial Sequence
  Description of Artificial Sequence: Synthetic oligonucleotide
agcaucuccugcaacagg

SEQ ID NO: 136150 - RNA, 18 nt, Artificial Sequence
  Description of Artificial Sequence: Synthetic oligonucleotide
ccagcagcaucuccugca

SEQ ID NO: 136151 - RNA, 18 nt, Artificial Sequence
  Description of Artificial Sequence: Synthetic oligonucleotide
accucccagcagcaucuc

SEQ ID NO: 136152 - RNA, 18 nt, Artificial Sequence
  Description of Artificial Sequence: Synthetic oligonucleotide
cacggaccucccagcagc

SEQ ID NO: 136153 - RNA, 18 nt, Artificial Sequence
  Description of Artificial Sequence: Synthetic oligonucleotide
cuuggcacggaccuccca

SEQ ID NO: 136154 - RNA, 18 nt, Artificial Sequence
  Description of Artificial Sequence: Synthetic oligonucleotide
cugggcuuggcacggacc

SEQ ID NO: 136155 - RNA, 18 nt, Artificial Sequence
  Description of Artificial Sequence: Synthetic oligonucleotide
cccuccugggcuuggcac

SEQ ID NO: 136156 - RNA, 18 nt, Artificial Sequence
  Description of Artificial Sequence: Synthetic oligonucleotide
cccgccccuccugggcuu

SEQ ID NO: 136157 - RNA, 18 nt, Artificial Sequence
  Description of Artificial Sequence: Synthetic oligonucleotide
ccaaccccgccccuccug

SEQ ID NO: 136158 - RNA, 18 nt, Artificial Sequence
  Description of Artificial Sequence: Synthetic oligonucleotide
ccacuccaaccccgcccc

SEQ ID NO: 136159 - RNA, 18 nt, Artificial Sequence
  Description of Artificial Sequence: Synthetic oligonucleotide
aguccccacuccaacccc

SEQ ID NO: 136160 - RNA, 18 nt, Artificial Sequence
  Description of Artificial Sequence: Synthetic oligonucleotide
gggaguccccacuccaac

SEQ ID NO: 136161 - RNA, 18 nt, Artificial Sequence
  Description of Artificial Sequence: Synthetic oligonucleotide
ugaggccugucuccuggg

SEQ ID NO: 136162 - RNA, 18 nt, Artificial Sequence
  Description of Artificial Sequence: Synthetic oligonucleotide
cugugugaggccugucuc

SEQ ID NO: 136163 - RNA, 18 nt, Artificial Sequence
  Description of Artificial Sequence: Synthetic oligonucleotide
gcucacugugugaggccu

SEQ ID NO: 136164 - RNA, 18 nt, Artificial Sequence
  Description of Artificial Sequence: Synthetic oligonucleotide
ggugagcucacuguguga

SEQ ID NO: 136165 - RNA, 18 nt, Artificial Sequence
  Description of Artificial Sequence: Synthetic oligonucleotide
gggugagcucacugugug

SEQ ID NO: 136166 - RNA, 18 nt, Artificial Sequence
  Description of Artificial Sequence: Synthetic oligonucleotide
aagccaaggagcugaggg

SEQ ID NO: 136167 - RNA, 18 nt, Artificial Sequence
  Description of Artificial Sequence: Synthetic oligonucleotide
gggaagccaaggagcuga

SEQ ID NO: 136168 - RNA, 18 nt, Artificial Sequence
  Description of Artificial Sequence: Synthetic oligonucleotide
ccaaagcggcacaguggg

SEQ ID NO: 136169 - RNA, 18 nt, Artificial Sequence
  Description of Artificial Sequence: Synthetic oligonucleotide
cuugcccaaagcggcaca

SEQ ID NO: 136170 - RNA, 18 nt, Artificial Sequence
  Description of Artificial Sequence: Synthetic oligonucleotide
agcaacuugcccaaagcg

SEQ ID NO: 136171 - RNA, 18 nt, Artificial Sequence
  Description of Artificial Sequence: Synthetic oligonucleotide
gguuaagcaacuugccca

SEQ ID NO: 136172 - RNA, 18 nt, Artificial Sequence
  Description of Artificial Sequence: Synthetic oligonucleotide
agacagguuaagcaacuu

SEQ ID NO: 136173 - RNA, 18 nt, Artificial Sequence
  Description of Artificial Sequence: Synthetic oligonucleotide
ggcacagacagguuaagc

SEQ ID NO: 136174 - RNA, 18 nt, Artificial Sequence
  Description of Artificial Sequence: Synthetic oligonucleotide
acugaggcacagacaggu

SEQ ID NO: 136175 - RNA, 18 nt, Artificial Sequence
  Description of Artificial Sequence: Synthetic oligonucleotide
aggaaacugaggcacaga

SEQ ID NO: 136176 - RNA, 18 nt, Artificial Sequence
  Description of Artificial Sequence: Synthetic oligonucleotide
uggugaggaaacugaggc

SEQ ID NO: 136177 - RNA, 18 nt, Artificial Sequence
  Description of Artificial Sequence: Synthetic oligonucleotide
uuuucuggugaggaaacu

SEQ ID NO: 136178 - RNA, 18 nt, Artificial Sequence
  Description of Artificial Sequence: Synthetic oligonucleotide
cccauuuuucuggugagg

SEQ ID NO: 136179 - RNA, 18 nt, Artificial Sequence
  Description of Artificial Sequence: Synthetic oligonucleotide
uuguucccauuuuucugg

SEQ ID NO: 136180 - RNA, 18 nt, Artificial Sequence
  Description of Artificial Sequence: Synthetic oligonucleotide
uugccuuguucccauuuu

SEQ ID NO: 136181 - RNA, 18 nt, Artificial Sequence
  Description of Artificial Sequence: Synthetic oligonucleotide
gaccauugccuuguuccc

SEQ ID NO: 136182 - RNA, 18 nt, Artificial Sequence
  Description of Artificial Sequence: Synthetic oligonucleotide
aaauagaccauugccuug

SEQ ID NO: 136183 - RNA, 18 nt, Artificial Sequence
  Description of Artificial Sequence: Synthetic oligonucleotide
ugaacaaauagaccauug

SEQ ID NO: 136184 - RNA, 18 nt, Artificial Sequence
  Description of Artificial Sequence: Synthetic oligonucleotide
gugccugaacaaauagac

SEQ ID NO: 136185 - RNA, 18 nt, Artificial Sequence
  Description of Artificial Sequence: Synthetic oligonucleotide
ucucggugccugaacaaa

SEQ ID NO: 136186 - RNA, 18 nt, Artificial Sequence
  Description of Artificial Sequence: Synthetic oligonucleotide
uagguucucggugccuga

SEQ ID NO: 136187 - RNA, 18 nt, Artificial Sequence
  Description of Artificial Sequence: Synthetic oligonucleotide
cgugcuagguucucggug

SEQ ID NO: 136188 - RNA, 18 nt, Artificial Sequence
  Description of Artificial Sequence: Synthetic oligonucleotide
uggcacgugcuagguucu

SEQ ID NO: 136189 - RNA, 18 nt, Artificial Sequence
  Description of Artificial Sequence: Synthetic oligonucleotide
gugacuggcacgugcuag

SEQ ID NO: 136190 - RNA, 18 nt, Artificial Sequence
  Description of Artificial Sequence: Synthetic oligonucleotide
gaacagugacuggcacgu

SEQ ID NO: 136191 - RNA, 18 nt, Artificial Sequence
  Description of Artificial Sequence: Synthetic oligonucleotide
acuuagaacagugacugg

SEQ ID NO: 136192 - RNA, 18 nt, Artificial Sequence
  Description of Artificial Sequence: Synthetic oligonucleotide
ccagcacuuagaacagug

SEQ ID NO: 136193 - RNA, 18 nt, Artificial Sequence
  Description of Artificial Sequence: Synthetic oligonucleotide
aauugccagcacuuagaa

SEQ ID NO: 136194 - RNA, 18 nt, Artificial Sequence
  Description of Artificial Sequence: Synthetic oligonucleotide
ugcugaauugccagcacu

SEQ ID NO: 136195 - RNA, 18 nt, Artificial Sequence
  Description of Artificial Sequence: Synthetic oligonucleotide
uucuuugcugaauugcca

SEQ ID NO: 136196 - RNA, 18 nt, Artificial Sequence
  Description of Artificial Sequence: Synthetic oligonucleotide
ucuuguucuuugcugaau

SEQ ID NO: 136197 - RNA, 18 nt, Artificial Sequence
  Description of Artificial Sequence: Synthetic oligonucleotide
aaagaucuuguucuuugc

SEQ ID NO: 136198 - RNA, 18 nt, Artificial Sequence
  Description of Artificial Sequence: Synthetic oligonucleotide
agggcaaagaucuuguuc

SEQ ID NO: 136199 - RNA, 18 nt, Artificial Sequence
  Description of Artificial Sequence: Synthetic oligonucleotide
ccccgagggcaaagaucu

SEQ ID NO: 136200 - RNA, 18 nt, Artificial Sequence
  Description of Artificial Sequence: Synthetic oligonucleotide
agccuccccgagggcaaa

SEQ ID NO: 136201 - RNA, 18 nt, Artificial Sequence
  Description of Artificial Sequence: Synthetic oligonucleotide
cacacagccuccccgagg

SEQ ID NO: 136202 - RNA, 18 nt, Artificial Sequence
  Description of Artificial Sequence: Synthetic oligonucleotide
acacacacacagccuccc

SEQ ID NO: 136203 - RNA, 18 nt, Artificial Sequence
  Description of Artificial Sequence: Synthetic oligonucleotide
uacucacacacacacagc

SEQ ID NO: 136204 - RNA, 18 nt, Artificial Sequence
  Description of Artificial Sequence: Synthetic oligonucleotide
auacauacucacacacac

SEQ ID NO: 136205 - RNA, 18 nt, Artificial Sequence
  Description of Artificial Sequence: Synthetic oligonucleotide
cauccauacauacucaca

SEQ ID NO: 136206 - RNA, 18 nt, Artificial Sequence
  Description of Artificial Sequence: Synthetic oligonucleotide
ccacgcauccauacauac

SEQ ID NO: 136207 - RNA, 18 nt, Artificial Sequence
  Description of Artificial Sequence: Synthetic oligonucleotide
gauauccacgcauccaua

SEQ ID NO: 136208 - RNA, 18 nt, Artificial Sequence
  Description of Artificial Sequence: Synthetic oligonucleotide
acacagauauccacgcau

SEQ ID NO: 136209 - RNA, 18 nt, Artificial Sequence
  Description of Artificial Sequence: Synthetic oligonucleotide
cauauacacagauaucca

SEQ ID NO: 136210 - RNA, 18 nt, Artificial Sequence
  Description of Artificial Sequence: Synthetic oligonucleotide
acgggcauauacacagau

SEQ ID NO: 136211 - RNA, 18 nt, Artificial Sequence
  Description of Artificial Sequence: Synthetic oligonucleotide
cacauacgggcauauaca

SEQ ID NO: 136212 - RNA, 18 nt, Artificial Sequence
  Description of Artificial Sequence: Synthetic oligonucleotide
gcacgcacauacgggcau

SEQ ID NO: 136213 - RNA, 18 nt, Artificial Sequence
  Description of Artificial Sequence: Synthetic oligonucleotide
cacaugcacgcacauacg

SEQ ID NO: 136214 - RNA, 18 nt, Artificial Sequence
  Description of Artificial Sequence: Synthetic oligonucleotide
auauacacaugcacgcac

SEQ ID NO: 136215 - RNA, 18 nt, Artificial Sequence
  Description of Artificial Sequence: Synthetic oligonucleotide
gcuuuauauacacaugca

SEQ ID NO: 136216 - RNA, 18 nt, Artificial Sequence
  Description of Artificial Sequence: Synthetic oligonucleotide
gugaggcuuuauauacac

SEQ ID NO: 136217 - RNA, 18 nt, Artificial Sequence
  Description of Artificial Sequence: Synthetic oligonucleotide
aaaaugugaggcuuuaua

SEQ ID NO: 136218 - RNA, 18 nt, Artificial Sequence
  Description of Artificial Sequence: Synthetic oligonucleotide
aucauaaaaugugaggcu

SEQ ID NO: 136219 - RNA, 18 nt, Artificial Sequence
  Description of Artificial Sequence: Synthetic oligonucleotide
ucaaaaucauaaaaugug

SEQ ID NO: 136220 - RNA, 18 nt, Artificial Sequence
  Description of Artificial Sequence: Synthetic oligonucleotide
uuauuucaaaaucauaaa

SEQ ID NO: 136221 - RNA, 18 nt, Artificial Sequence
  Description of Artificial Sequence: Synthetic oligonucleotide
ccuguuuauuucaaaauc

SEQ ID NO: 136222 - RNA, 18 nt, Artificial Sequence
  Description of Artificial Sequence: Synthetic oligonucleotide
uauuaccuguuuauuuca

SEQ ID NO: 136223 - RNA, 18 nt, Artificial Sequence
  Description of Artificial Sequence: Synthetic oligonucleotide
ucugccuuccuuucaaac

SEQ ID NO: 136224 - RNA, 18 nt, Artificial Sequence
  Description of Artificial Sequence: Synthetic oligonucleotide
cccucucugccuuccuuu

SEQ ID NO: 136225 - RNA, 18 nt, Artificial Sequence
  Description of Artificial Sequence: Synthetic oligonucleotide
cagugcccucucugccuu

SEQ ID NO: 136226 - RNA, 18 nt, Artificial Sequence
  Description of Artificial Sequence: Synthetic oligonucleotide
ccucccagugcccucucu

SEQ ID NO: 136227 - RNA, 18 nt, Artificial Sequence
  Description of Artificial Sequence: Synthetic oligonucleotide
ugccuccucccagugccc

SEQ ID NO: 136228 - RNA, 18 nt, Artificial Sequence
  Description of Artificial Sequence: Synthetic oligonucleotide
cccacugccuccucccag

SEQ ID NO: 136229 - RNA, 18 nt, Artificial Sequence
  Description of Artificial Sequence: Synthetic oligonucleotide
gcccucccacugccuccu

SEQ ID NO: 136230 - RNA, 18 nt, Artificial Sequence
  Description of Artificial Sequence: Synthetic oligonucleotide
ccuccgcccucccacugc

SEQ ID NO: 136231 - RNA, 18 nt, Artificial Sequence
  Description of Artificial Sequence: Synthetic oligonucleotide
cccgcccuccgcccuccc

SEQ ID NO: 136232 - RNA, 18 nt, Artificial Sequence
  Description of Artificial Sequence: Synthetic oligonucleotide
aggcccccgcccuccgcc

SEQ ID NO: 136233 - RNA, 18 nt, Artificial Sequence
  Description of Artificial Sequence: Synthetic oligonucleotide
cccgaaggcccccgcccu

SEQ ID NO: 136234 - RNA, 18 nt, Artificial Sequence
  Description of Artificial Sequence: Synthetic oligonucleotide
cccaccccgaaggccccc

SEQ ID NO: 136235 - RNA, 18 nt, Artificial Sequence
  Description of Artificial Sequence: Synthetic oligonucleotide
gggcgcccaccccgaagg

SEQ ID NO: 136236 - RNA, 18 nt, Artificial Sequence
  Description of Artificial Sequence: Synthetic oligonucleotide
acccugggcgcccacccc

SEQ ID NO: 136237 - RNA, 18 nt, Artificial Sequence
  Description of Artificial Sequence: Synthetic oligonucleotide
gcccuacccugggcgccc

SEQ ID NO: 136238 - RNA, 18 nt, Artificial Sequence
  Description of Artificial Sequence: Synthetic oligonucleotide
caccugcccuacccuggg

SEQ ID NO: 136239 - RNA, 18 nt, Artificial Sequence
  Description of Artificial Sequence: Synthetic oligonucleotide
gcggccaccugcccuacc

SEQ ID NO: 136240 - RNA, 18 nt, Artificial Sequence
  Description of Artificial Sequence: Synthetic oligonucleotide
acgccgcggccaccugcc

SEQ ID NO: 136241 - RNA, 18 nt, Artificial Sequence
  Description of Artificial Sequence: Synthetic oligonucleotide
ccuccacgccgcggccac

SEQ ID NO: 136242 - RNA, 18 nt, Artificial Sequence
  Description of Artificial Sequence: Synthetic oligonucleotide
cccugccuccacgccgcg

SEQ ID NO: 136243 - RNA, 18 nt, Artificial Sequence
  Description of Artificial Sequence: Synthetic oligonucleotide
auucucccugccuccacg

SEQ ID NO: 136244 - RNA, 18 nt, Artificial Sequence
  Description of Artificial Sequence: Synthetic oligonucleotide
gucgcauucucccugccu

SEQ ID NO: 136245 - RNA, 18 nt, Artificial Sequence
  Description of Artificial Sequence: Synthetic oligonucleotide
ggagagucgcauucuccc

SEQ ID NO: 136246 - RNA, 18 nt, Artificial Sequence
  Description of Artificial Sequence: Synthetic oligonucleotide
guuuuggagagucgcauu

SEQ ID NO: 136247 - RNA, 18 nt, Artificial Sequence
  Description of Artificial Sequence: Synthetic oligonucleotide
cgaggguuuuggagaguc

SEQ ID NO: 136248 - RNA, 18 nt, Artificial Sequence
  Description of Artificial Sequence: Synthetic oligonucleotide
gucgacgaggguuuugga

SEQ ID NO: 136249 - RNA, 18 nt, Artificial Sequence
  Description of Artificial Sequence: Synthetic oligonucleotide
uccaugucgacgaggguu

SEQ ID NO: 136250 - RNA, 18 nt, Artificial Sequence
  Description of Artificial Sequence: Synthetic oligonucleotide
ccauguccaugucgacga

SEQ ID NO: 136251 - RNA, 18 nt, Artificial Sequence
  Description of Artificial Sequence: Synthetic oligonucleotide
gucggccauguccauguc

SEQ ID NO: 136252 - RNA, 18 nt, Artificial Sequence
  Description of Artificial Sequence: Synthetic oligonucleotide
cuguagucggccaugucc

SEQ ID NO: 136253 - RNA, 18 nt, Artificial Sequence
  Description of Artificial Sequence: Synthetic oligonucleotide
cagcacuguagucggcca

SEQ ID NO: 136254 - RNA, 18 nt, Artificial Sequence
  Description of Artificial Sequence: Synthetic oligonucleotide
cagugcagcacuguaguc

SEQ ID NO: 136255 - RNA, 18 nt, Artificial Sequence
  Description of Artificial Sequence: Synthetic oligonucleotide
ggguccagugcagcacug

SEQ ID NO: 136256 - RNA, 18 nt, Artificial Sequence
  Description of Artificial Sequence: Synthetic oligonucleotide
aggcuggguccagugcag

SEQ ID NO: 136257 - RNA, 18 nt, Artificial Sequence
  Description of Artificial Sequence: Synthetic oligonucleotide
gguguaggcuggguccag

SEQ ID NO: 136258 - RNA, 18 nt, Artificial Sequence
  Description of Artificial Sequence: Synthetic oligonucleotide
agggugguguaggcuggg

SEQ ID NO: 136259 - RNA, 18 nt, Artificial Sequence
  Description of Artificial Sequence: Synthetic oligonucleotide
auuccagggugguguagg

SEQ ID NO: 136260 - RNA, 18 nt, Artificial Sequence
  Description of Artificial Sequence: Synthetic oligonucleotide
cucaaauuccaggguggu

SEQ ID NO: 136261 - RNA, 18 nt, Artificial Sequence
  Description of Artificial Sequence: Synthetic oligonucleotide
acauucucaaauuccagg

SEQ ID NO: 136262 - RNA, 18 nt, Artificial Sequence
  Description of Artificial Sequence: Synthetic oligonucleotide
ccugcacauucucaaauu

SEQ ID NO: 136263 - RNA, 18 nt, Artificial Sequence
  Description of Artificial Sequence: Synthetic oligonucleotide
caacaccugcacauucuc

SEQ ID NO: 136264 - RNA, 18 nt, Artificial Sequence
  Description of Artificial Sequence: Synthetic oligonucleotide
aucgucaacaccugcaca

SEQ ID NO: 136265 - RNA, 18 nt, Artificial Sequence
  Description of Artificial Sequence: Synthetic oligonucleotide
ugcccaucgucaacaccu

SEQ ID NO: 136266 - RNA, 18 nt, Artificial Sequence
  Description of Artificial Sequence: Synthetic oligonucleotide
ugggcacaucugccccca

SEQ ID NO: 136267 - RNA, 18 nt, Artificial Sequence
  Description of Artificial Sequence: Synthetic oligonucleotide
acaccugggcacaucugc

SEQ ID NO: 136268 - RNA, 18 nt, Artificial Sequence
  Description of Artificial Sequence: Synthetic oligonucleotide
cuggcacaccugggcaca

SEQ ID NO: 136269 - RNA, 18 nt, Artificial Sequence
  Description of Artificial Sequence: Synthetic oligonucleotide
ccccacuggcacaccugg

SEQ ID NO: 136270 - RNA, 18 nt, Artificial Sequence
  Description of Artificial Sequence: Synthetic oligonucleotide
ccugcccccacuggcaca

SEQ ID NO: 136271 - RNA, 18 nt, Artificial Sequence
  Description of Artificial Sequence: Synthetic oligonucleotide
gcacaccugcccccacug

SEQ ID NO: 136272 - RNA, 18 nt, Artificial Sequence
  Description of Artificial Sequence: Synthetic oligonucleotide
cccaggcacaccugcccc

SEQ ID NO: 136273 - RNA, 18 nt, Artificial Sequence
  Description of Artificial Sequence: Synthetic oligonucleotide
cuggacccaggcacaccu

SEQ ID NO: 136274 - RNA, 18 nt, Artificial Sequence
  Description of Artificial Sequence: Synthetic oligonucleotide
ugcuccuggacccaggca

SEQ ID NO: 136275 - RNA, 18 nt, Artificial Sequence
  Description of Artificial Sequence: Synthetic oligonucleotide
agaucugcuccuggaccc

SEQ ID NO: 136276 - RNA, 18 nt, Artificial Sequence
  Description of Artificial Sequence: Synthetic oligonucleotide
gccaaagaucugcuccug

SEQ ID NO: 136277 - RNA, 18 nt, Artificial Sequence
  Description of Artificial Sequence: Synthetic oligonucleotide
ugagugccaaagaucugc

SEQ ID NO: 136278 - RNA, 18 nt, Artificial Sequence
  Description of Artificial Sequence: Synthetic oligonucleotide
aaaguugagugccaaaga

SEQ ID NO: 136279 - RNA, 18 nt, Artificial Sequence
  Description of Artificial Sequence: Synthetic oligonucleotide
accccaaaguugagugcc

SEQ ID NO: 136280 - RNA, 18 nt, Artificial Sequence
  Description of Artificial Sequence: Synthetic oligonucleotide
cucccaccccaaaguuga

SEQ ID NO: 136281 - RNA, 18 nt, Artificial Sequence
  Description of Artificial Sequence: Synthetic oligonucleotide
uucuccucccaccccaaa

SEQ ID NO: 136282 - RNA, 18 nt, Artificial Sequence
  Description of Artificial Sequence: Synthetic oligonucleotide
uaucauucuccucccacc

SEQ ID NO: 136283 - RNA, 18 nt, Artificial Sequence
  Description of Artificial Sequence: Synthetic oligonucleotide
uuuuguaucauucuccuc

SEQ ID NO: 136284 - RNA, 18 nt, Artificial Sequence
  Description of Artificial Sequence: Synthetic oligonucleotide
uaccauuuuguaucauuc

SEQ ID NO: 136285 - RNA, 18 nt, Artificial Sequence
  Description of Artificial Sequence: Synthetic oligonucleotide
caaccuaccauuuuguau

SEQ ID NO: 136286 - RNA, 18 nt, Artificial Sequence
  Description of Artificial Sequence: Synthetic oligonucleotide
aggaccaaccuaccauuu

SEQ ID NO: 136287 - RNA, 18 nt, Artificial Sequence
  Description of Artificial Sequence: Synthetic oligonucleotide
ccuguaggaccaaccuac

SEQ ID NO: 136288 - RNA, 18 nt, Artificial Sequence
  Description of Artificial Sequence: Synthetic oligonucleotide
gcuggccuguaggaccaa

SEQ ID NO: 136289 - RNA, 18 nt, Artificial Sequence
  Description of Artificial Sequence: Synthetic oligonucleotide
ccugugcuggccuguagg

SEQ ID NO: 136290 - RNA, 18 nt, Artificial Sequence
  Description of Artificial Sequence: Synthetic oligonucleotide
caacaccugugcuggccu

SEQ ID NO: 136291 - RNA, 18 nt, Artificial Sequence
  Description of Artificial Sequence: Synthetic oligonucleotide
cuuggcaacaccugugcu

SEQ ID NO: 136292 - RNA, 18 nt, Artificial Sequence
  Description of Artificial Sequence: Synthetic oligonucleotide
cuucacuuggcaacaccu

SEQ ID NO: 136293 - RNA, 18 nt, Artificial Sequence
  Description of Artificial Sequence: Synthetic oligonucleotide
augggcuucacuuggcaa

SEQ ID NO: 136294 - RNA, 18 nt, Artificial Sequence
  Description of Artificial Sequence: Synthetic oligonucleotide
ggcacaugggcuucacuu

SEQ ID NO: 136295 - RNA, 18 nt, Artificial Sequence
  Description of Artificial Sequence: Synthetic oligonucleotide
gccugggcacaugggcuu

SEQ ID NO: 136296 - RNA, 18 nt, Artificial Sequence
  Description of Artificial Sequence: Synthetic oligonucleotide
acugugccugggcacaug

SEQ ID NO: 136297 - RNA, 18 nt, Artificial Sequence
  Description of Artificial Sequence: Synthetic oligonucleotide
ugaucacugugccugggc

SEQ ID NO: 136298 - RNA, 18 nt, Artificial Sequence
  Description of Artificial Sequence: Synthetic oligonucleotide
gccugugaucacugugcc

SEQ ID NO: 136299 - RNA, 18 nt, Artificial Sequence
  Description of Artificial Sequence: Synthetic oligonucleotide
agaaugccugugaucacu

SEQ ID NO: 136300 - RNA, 18 nt, Artificial Sequence
  Description of Artificial Sequence: Synthetic oligonucleotide
cacccagaaugccuguga

SEQ ID NO: 136301 - RNA, 18 nt, Artificial Sequence
  Description of Artificial Sequence: Synthetic oligonucleotide
cccuucacccagaaugcc

SEQ ID NO: 136302 - RNA, 18 nt, Artificial Sequence
  Description of Artificial Sequence: Synthetic oligonucleotide
ggccucccuucacccaga

SEQ ID NO: 136303 - RNA, 18 nt, Artificial Sequence
  Description of Artificial Sequence: Synthetic oligonucleotide
uugcaggccucccuucac

SEQ ID NO: 136304 - RNA, 18 nt, Artificial Sequence
  Description of Artificial Sequence: Synthetic oligonucleotide
ggcccuugcaggccuccc

SEQ ID NO: 136305 - RNA, 18 nt, Artificial Sequence
  Description of Artificial Sequence: Synthetic oligonucleotide
aaauuggcccuugcaggc

SEQ ID NO: 136306 - RNA, 18 nt, Artificial Sequence
  Description of Artificial Sequence: Synthetic oligonucleotide
gcuggaaauuggcccuug

SEQ ID NO: 136307 - RNA, 18 nt, Artificial Sequence
  Description of Artificial Sequence: Synthetic oligonucleotide
cuuuugcuggaaauuggc

SEQ ID NO: 136308 - RNA, 18 nt, Artificial Sequence
  Description of Artificial Sequence: Synthetic oligonucleotide
aucgacuuuugcuggaaa

SEQ ID NO: 136309 - RNA, 18 nt, Artificial Sequence
  Description of Artificial Sequence: Synthetic oligonucleotide
ccgggaucgacuuuugcu

SEQ ID NO: 136310 - RNA, 18 nt, Artificial Sequence
  Description of Artificial Sequence: Synthetic oligonucleotide
aauagccgggaucgacuu

SEQ ID NO: 136311 - RNA, 18 nt, Artificial Sequence
  Description of Artificial Sequence: Synthetic oligonucleotide
ggaggaauagccgggauc

SEQ ID NO: 136312 - RNA, 18 nt, Artificial Sequence
  Description of Artificial Sequence: Synthetic oligonucleotide
gccugggaggaauagccg

SEQ ID NO: 136313 - RNA, 18 nt, Artificial Sequence
  Description of Artificial Sequence: Synthetic oligonucleotide
gaagggccugggaggaau

SEQ ID NO: 136314 - RNA, 18 nt, Artificial Sequence
  Description of Artificial Sequence: Synthetic oligonucleotide
gacuggaagggccuggga

SEQ ID NO: 136315 - RNA, 18 nt, Artificial Sequence
  Description of Artificial Sequence: Synthetic oligonucleotide
gugaggacuggaagggcc

SEQ ID NO: 136316 - RNA, 18 nt, Artificial Sequence
  Description of Artificial Sequence: Synthetic oligonucleotide
aggcagugaggacuggaa

SEQ ID NO: 136317 - RNA, 18 nt, Artificial Sequence
  Description of Artificial Sequence: Synthetic oligonucleotide
cugugaggcagugaggac

SEQ ID NO: 136318 - RNA, 18 nt, Artificial Sequence
  Description of Artificial Sequence: Synthetic oligonucleotide
agccacugugaggcagug

SEQ ID NO: 136319 - RNA, 18 nt, Artificial Sequence
  Description of Artificial Sequence: Synthetic oligonucleotide
agcagagccacugugagg

SEQ ID NO: 136320 - RNA, 18 nt, Artificial Sequence
  Description of Artificial Sequence: Synthetic oligonucleotide
cgccaagcagagccacug

SEQ ID NO: 136321 - RNA, 18 nt, Artificial Sequence
  Description of Artificial Sequence: Synthetic oligonucleotide
ccaagcgccaagcagagc

SEQ ID NO: 136322 - RNA, 18 nt, Artificial Sequence
  Description of Artificial Sequence: Synthetic oligonucleotide
cugugccaagcgccaagc

SEQ ID NO: 136323 - RNA, 18 nt, Artificial Sequence
  Description of Artificial Sequence: Synthetic oligonucleotide
cgucacugugccaagcgc

SEQ ID NO: 136324 - RNA, 18 nt, Artificial Sequence
  Description of Artificial Sequence: Synthetic oligonucleotide
caucacgucacugugcca

SEQ ID NO: 136325 - RNA, 18 nt, Artificial Sequence
  Description of Artificial Sequence: Synthetic oligonucleotide
cucaccaucacgucacug

SEQ ID NO: 136326 - RNA, 18 nt, Artificial Sequence
  Description of Artificial Sequence: Synthetic oligonucleotide
gggagcucaccaucacgu

SEQ ID NO: 136327 - RNA, 18 nt, Artificial Sequence
  Description of Artificial Sequence: Synthetic oligonucleotide
gcuggagcugggcaccaa

SEQ ID NO: 136328 - RNA, 18 nt, Artificial Sequence
  Description of Artificial Sequence: Synthetic oligonucleotide
gaaucgcuggagcugggc

SEQ ID NO: 136329 - RNA, 18 nt, Artificial Sequence
  Description of Artificial Sequence: Synthetic oligonucleotide
gggcugaaucgcuggagc

SEQ ID NO: 136330 - RNA, 18 nt, Artificial Sequence
  Description of Artificial Sequence: Synthetic oligonucleotide
gugcugggcugaaucgcu

SEQ ID NO: 136331 - RNA, 18 nt, Artificial Sequence
  Description of Artificial Sequence: Synthetic oligonucleotide
gggccgugcugggcugaa

SEQ ID NO: 136332 - RNA, 18 nt, Artificial Sequence
  Description of Artificial Sequence: Synthetic oligonucleotide
ucugaaccuaggcccaag

SEQ ID NO: 136333 - RNA, 18 nt, Artificial Sequence
  Description of Artificial Sequence: Synthetic oligonucleotide
gucucucugaaccuaggc

SEQ ID NO: 136334 - RNA, 18 nt, Artificial Sequence
  Description of Artificial Sequence: Synthetic oligonucleotide
uugccgucucucugaacc

SEQ ID NO: 136335 - RNA, 18 nt, Artificial Sequence
  Description of Artificial Sequence: Synthetic oligonucleotide
aucccuugccgucucucu

SEQ ID NO: 136336 - RNA, 18 nt, Artificial Sequence
  Description of Artificial Sequence: Synthetic oligonucleotide
acaacaucccuugccguc

SEQ ID NO: 136337 - RNA, 18 nt, Artificial Sequence
  Description of Artificial Sequence: Synthetic oligonucleotide
gggauacaacaucccuug

SEQ ID NO: 136338 - RNA, 18 nt, Artificial Sequence
  Description of Artificial Sequence: Synthetic oligonucleotide
cuccagggauacaacauc

SEQ ID NO: 136339 - RNA, 18 nt, Artificial Sequence
  Description of Artificial Sequence: Synthetic oligonucleotide
accaucuccagggauaca

SEQ ID NO: 136340 - RNA, 18 nt, Artificial Sequence
  Description of Artificial Sequence: Synthetic oligonucleotide
caaccaccaucuccaggg

SEQ ID NO: 136341 - RNA, 18 nt, Artificial Sequence
  Description of Artificial Sequence: Synthetic oligonucleotide
gucuccaaccaccaucuc

SEQ ID NO: 136342 - RNA, 18 nt, Artificial Sequence
  Description of Artificial Sequence: Synthetic oligonucleotide
guuaugucuccaaccacc

SEQ ID NO: 136343 - RNA, 18 nt, Artificial Sequence
  Description of Artificial Sequence: Synthetic oligonucleotide
augcgguuaugucuccaa

SEQ ID NO: 136344 - RNA, 18 nt, Artificial Sequence
  Description of Artificial Sequence: Synthetic oligonucleotide
gagaaaugcgguuauguc

SEQ ID NO: 136345 - RNA, 18 nt, Artificial Sequence
  Description of Artificial Sequence: Synthetic oligonucleotide
acaccgagaaaugcgguu

SEQ ID NO: 136346 - RNA, 18 nt, Artificial Sequence
  Description of Artificial Sequence: Synthetic oligonucleotide
caaagacaccgagaaaug

SEQ ID NO: 136347 - RNA, 18 nt, Artificial Sequence
  Description of Artificial Sequence: Synthetic oligonucleotide
agucccaaagacaccgag

SEQ ID NO: 136348 - RNA, 18 nt, Artificial Sequence
  Description of Artificial Sequence: Synthetic oligonucleotide
aggaaagucccaaagaca

SEQ ID NO: 136349 - RNA, 18 nt, Artificial Sequence
  Description of Artificial Sequence: Synthetic oligonucleotide
ucccuaggaaagucccaa

SEQ ID NO: 136350 - RNA, 18 nt, Artificial Sequence
  Description of Artificial Sequence: Synthetic oligonucleotide
ucauuucccuaggaaagu

SEQ ID NO: 136351 - RNA, 18 nt, Artificial Sequence
  Description of Artificial Sequence: Synthetic oligonucleotide
caauuucauuucccuagg

SEQ ID NO: 136352 - RNA, 18 nt, Artificial Sequence
  Description of Artificial Sequence: Synthetic oligonucleotide
agugccaauuucauuucc

SEQ ID NO: 136353 - RNA, 18 nt, Artificial Sequence
  Description of Artificial Sequence: Synthetic oligonucleotide
cccuaagugccaauuuca

SEQ ID NO: 136354 - RNA, 18 nt, Artificial Sequence
  Description of Artificial Sequence: Synthetic oligonucleotide
auuuucccuaagugccaa

SEQ ID NO: 136355 - RNA, 18 nt, Artificial Sequence
  Description of Artificial Sequence: Synthetic oligonucleotide
gcuccauuuucccuaagu

SEQ ID NO: 136356 - RNA, 18 nt, Artificial Sequence
  Description of Artificial Sequence: Synthetic oligonucleotide
ugagagcuccauuuuccc

SEQ ID NO: 136357 - RNA, 18 nt, Artificial Sequence
  Description of Artificial Sequence: Synthetic oligonucleotide
uccuaggagggucuggac

SEQ ID NO: 136358 - RNA, 18 nt, Artificial Sequence
  Description of Artificial Sequence: Synthetic oligonucleotide
uggccuccuaggaggguc

SEQ ID NO: 136359 - RNA, 18 nt, Artificial Sequence
  Description of Artificial Sequence: Synthetic oligonucleotide
ucauguggccuccuagga

SEQ ID NO: 136360 - RNA, 18 nt, Artificial Sequence
  Description of Artificial Sequence: Synthetic oligonucleotide
cacacucauguggccucc

SEQ ID NO: 136361 - RNA, 18 nt, Artificial Sequence
  Description of Artificial Sequence: Synthetic oligonucleotide
acagucacacucaugugg

SEQ ID NO: 136362 - RNA, 18 nt, Artificial Sequence
  Description of Artificial Sequence: Synthetic oligonucleotide
cgagaacagucacacuca

SEQ ID NO: 136363 - RNA, 18 nt, Artificial Sequence
  Description of Artificial Sequence: Synthetic oligonucleotide
ugggccgagaacagucac

SEQ ID NO: 136364 - RNA, 18 nt, Artificial Sequence
  Description of Artificial Sequence: Synthetic oligonucleotide
agacuugggccgagaaca

SEQ ID NO: 136365 - RNA, 18 nt, Artificial Sequence
  Description of Artificial Sequence: Synthetic oligonucleotide
gagaaagacuugggccga

SEQ ID NO: 136366 - RNA, 18 nt, Artificial Sequence
  Description of Artificial Sequence: Synthetic oligonucleotide
ggaacgagaaagacuugg

SEQ ID NO: 136367 - RNA, 18 nt, Artificial Sequence
  Description of Artificial Sequence: Synthetic oligonucleotide
ucugaggaacgagaaaga

SEQ ID NO: 136368 - RNA, 18 nt, Artificial Sequence
  Description of Artificial Sequence: Synthetic oligonucleotide
aauucucugaggaacgag

SEQ ID NO: 136369 - RNA, 18 nt, Artificial Sequence
  Description of Artificial Sequence: Synthetic oligonucleotide
ccgcaaauucucugagga

SEQ ID NO: 136370 - RNA, 18 nt, Artificial Sequence
  Description of Artificial Sequence: Synthetic oligonucleotide
gggccccgcaaauucucu

SEQ ID NO: 136371 - RNA, 18 nt, Artificial Sequence
  Description of Artificial Sequence: Synthetic oligonucleotide
cagcuugugugcccaggg

SEQ ID NO: 136372 - RNA, 18 nt, Artificial Sequence
  Description of Artificial Sequence: Synthetic oligonucleotide
ucucagcuugugugccca

SEQ ID NO: 136373 - RNA, 18 nt, Artificial Sequence
  Description of Artificial Sequence: Synthetic oligonucleotide
guggaucucagcuugugu

SEQ ID NO: 136374 - RNA, 18 nt, Artificial Sequence
  Description of Artificial Sequence: Synthetic oligonucleotide
gcuggguggaucucagcu

SEQ ID NO: 136375 - RNA, 18 nt, Artificial Sequence
  Description of Artificial Sequence: Synthetic oligonucleotide
ccagggcuggguggaucu

SEQ ID NO: 136376 - RNA, 18 nt, Artificial Sequence
  Description of Artificial Sequence: Synthetic oligonucleotide
agggaccagggcugggug

SEQ ID NO: 136377 - RNA, 18 nt, Artificial Sequence
  Description of Artificial Sequence: Synthetic oligonucleotide
ugccaagggaccagggcu

SEQ ID NO: 136378 - RNA, 18 nt, Artificial Sequence
  Description of Artificial Sequence: Synthetic oligonucleotide
guucuugccaagggacca

SEQ ID NO: 136379 - RNA, 18 nt, Artificial Sequence
  Description of Artificial Sequence: Synthetic oligonucleotide
ccucaguucuugccaagg

SEQ ID NO: 136380 - RNA, 18 nt, Artificial Sequence
  Description of Artificial Sequence: Synthetic oligonucleotide
cugucccucaguucuugc

SEQ ID NO: 136381 - RNA, 18 nt, Artificial Sequence
  Description of Artificial Sequence: Synthetic oligonucleotide
agguccugucccucaguu

SEQ ID NO: 136382 - RNA, 18 nt, Artificial Sequence
  Description of Artificial Sequence: Synthetic oligonucleotide
gaaccagguccugucccu

SEQ ID NO: 136383 - RNA, 18 nt, Artificial Sequence
  Description of Artificial Sequence: Synthetic oligonucleotide
ccccagaaccagguccug

SEQ ID NO: 136384 - RNA, 18 nt, Artificial Sequence
  Description of Artificial Sequence: Synthetic oligonucleotide
auuuuccccagaaccagg

SEQ ID NO: 136385 - RNA, 18 nt, Artificial Sequence
  Description of Artificial Sequence: Synthetic oligonucleotide
ccugcauuuuccccagaa

SEQ ID NO: 136386 - RNA, 18 nt, Artificial Sequence
  Description of Artificial Sequence: Synthetic oligonucleotide
auuccccugcauuuuccc

SEQ ID NO: 136387 - RNA, 18 nt, Artificial Sequence
  Description of Artificial Sequence: Synthetic oligonucleotide
gaaacauuccccugcauu

SEQ ID NO: 136388 - RNA, 18 nt, Artificial Sequence
  Description of Artificial Sequence: Synthetic oligonucleotide
agggagaaacauuccccu

SEQ ID NO: 136389 - RNA, 18 nt, Artificial Sequence
  Description of Artificial Sequence: Synthetic oligonucleotide
guggaagggagaaacauu

SEQ ID NO: 136390 - RNA, 18 nt, Artificial Sequence
  Description of Artificial Sequence: Synthetic oligonucleotide
gggcuguggaagggagaa

SEQ ID NO: 136391 - RNA, 18 nt, Artificial Sequence
  Description of Artificial Sequence: Synthetic oligonucleotide
ccuccuaacucgcaaggg

SEQ ID NO: 136392 - RNA, 18 nt, Artificial Sequence
  Description of Artificial Sequence: Synthetic oligonucleotide
cggccuccuaacucgcaa

SEQ ID NO: 136393 - RNA, 18 nt, Artificial Sequence
  Description of Artificial Sequence: Synthetic oligonucleotide
ggagccggccuccuaacu

SEQ ID NO: 136394 - RNA, 18 nt, Artificial Sequence
  Description of Artificial Sequence: Synthetic oligonucleotide
gggugggagccggccucc

SEQ ID NO: 136395 - RNA, 18 nt, Artificial Sequence
  Description of Artificial Sequence: Synthetic oligonucleotide
accuggccaccuucuggg

SEQ ID NO: 136396 - RNA, 18 nt, Artificial Sequence
  Description of Artificial Sequence: Synthetic oligonucleotide
gaaaaccuggccaccuuc

SEQ ID NO: 136397 - RNA, 18 nt, Artificial Sequence
  Description of Artificial Sequence: Synthetic oligonucleotide
ggcaugaaaaccuggcca

SEQ ID NO: 136398 - RNA, 18 nt, Artificial Sequence
  Description of Artificial Sequence: Synthetic oligonucleotide
aggaaggcaugaaaaccu

SEQ ID NO: 136399 - RNA, 18 nt, Artificial Sequence
  Description of Artificial Sequence: Synthetic oligonucleotide
ucucuaggaaggcaugaa

SEQ ID NO: 136400 - RNA, 18 nt, Artificial Sequence
  Description of Artificial Sequence: Synthetic oligonucleotide
agcuuucucuaggaaggc

SEQ ID NO: 136401 - RNA, 18 nt, Artificial Sequence
  Description of Artificial Sequence: Synthetic oligonucleotide
gccccagcuuucucuagg

SEQ ID NO: 136402 - RNA, 18 nt, Artificial Sequence
  Description of Artificial Sequence: Synthetic oligonucleotide
cacgagccccagcuuucu

SEQ ID NO: 136403 - RNA, 18 nt, Artificial Sequence
  Description of Artificial Sequence: Synthetic oligonucleotide
gaggccacgagccccagc

SEQ ID NO: 136404 - RNA, 18 nt, Artificial Sequence
  Description of Artificial Sequence: Synthetic oligonucleotide
ugguggaggccacgagcc

SEQ ID NO: 136405 - RNA, 18 nt, Artificial Sequence
  Description of Artificial Sequence: Synthetic oligonucleotide
uccugugguggaggccac

SEQ ID NO: 136406 - RNA, 18 nt, Artificial Sequence
  Description of Artificial Sequence: Synthetic oligonucleotide
cgucuuccugugguggag

SEQ ID NO: 136407 - RNA, 18 nt, Artificial Sequence
  Description of Artificial Sequence: Synthetic oligonucleotide
gucugcgucuuccugugg

SEQ ID NO: 136408 - RNA, 18 nt, Artificial Sequence
  Description of Artificial Sequence: Synthetic oligonucleotide
ugagggucugcgucuucc

SEQ ID NO: 136409 - RNA, 18 nt, Artificial Sequence
  Description of Artificial Sequence: Synthetic oligonucleotide
guuucugagggucugcgu

SEQ ID NO: 136410 - RNA, 18 nt, Artificial Sequence
  Description of Artificial Sequence: Synthetic oligonucleotide
gacuuguuucugaggguc

SEQ ID NO: 136411 - RNA, 18 nt, Artificial Sequence
  Description of Artificial Sequence: Synthetic oligonucleotide
ucacagacuuguuucuga

SEQ ID NO: 136412 - RNA, 18 nt, Artificial Sequence
  Description of Artificial Sequence: Synthetic oligonucleotide
ugacuucacagacuuguu

SEQ ID NO: 136413 - RNA, 18 nt, Artificial Sequence
  Description of Artificial Sequence: Synthetic oligonucleotide
gguugugacuucacagac

SEQ ID NO: 136414 - RNA, 18 nt, Artificial Sequence
  Description of Artificial Sequence: Synthetic oligonucleotide
gggcugguugugacuuca

SEQ ID NO: 136415 - RNA, 18 nt, Artificial Sequence
  Description of Artificial Sequence: Synthetic oligonucleotide
ucacaucuguaaacuggg

SEQ ID NO: 136416 - RNA, 18 nt, Artificial Sequence
  Description of Artificial Sequence: Synthetic oligonucleotide
aguuucacaucuguaaac

SEQ ID NO: 136417 - RNA, 18 nt, Artificial Sequence
  Description of Artificial Sequence: Synthetic oligonucleotide
gcuucaguuucacaucug

SEQ ID NO: 136418 - RNA, 18 nt, Artificial Sequence
  Description of Artificial Sequence: Synthetic oligonucleotide
uuggagcuucaguuucac

SEQ ID NO: 136419 - RNA, 18 nt, Artificial Sequence
  Description of Artificial Sequence: Synthetic oligonucleotide
acuuuuuggagcuucagu

SEQ ID NO: 136420 - RNA, 18 nt, Artificial Sequence
  Description of Artificial Sequence: Synthetic oligonucleotide
uccugacuuuuuggagcu

SEQ ID NO: 136421 - RNA, 18 nt, Artificial Sequence
  Description of Artificial Sequence: Synthetic oligonucleotide
ugaccuccugacuuuuug

SEQ ID NO: 136422 - RNA, 18 nt, Artificial Sequence
  Description of Artificial Sequence: Synthetic oligonucleotide
cucagugaccuccugacu

SEQ ID NO: 136423 - RNA, 18 nt, Artificial Sequence
  Description of Artificial Sequence: Synthetic oligonucleotide
ccccacucagugaccucc

SEQ ID NO: 136424 - RNA, 18 nt, Artificial Sequence
  Description of Artificial Sequence: Synthetic oligonucleotide
caccuccccacucaguga

SEQ ID NO: 136425 - RNA, 18 nt, Artificial Sequence
  Description of Artificial Sequence: Synthetic oligonucleotide
uccaucaccuccccacuc

SEQ ID NO: 136426 - RNA, 18 nt, Artificial Sequence
  Description of Artificial Sequence: Synthetic oligonucleotide
cccacuccaucaccuccc

SEQ ID NO: 136427 - RNA, 18 nt, Artificial Sequence
  Description of Artificial Sequence: Synthetic oligonucleotide
cuguucccacuccaucac

SEQ ID NO: 136428 - RNA, 18 nt, Artificial Sequence
  Description of Artificial Sequence: Synthetic oligonucleotide
gccucagccagaucuggg

SEQ ID NO: 136429 - RNA, 18 nt, Artificial Sequence
  Description of Artificial Sequence: Synthetic oligonucleotide
cuucggccucagccagau

SEQ ID NO: 136430 - RNA, 18 nt, Artificial Sequence
  Description of Artificial Sequence: Synthetic oligonucleotide
cagggcuucggccucagc

SEQ ID NO: 136431 - RNA, 18 nt, Artificial Sequence
  Description of Artificial Sequence: Synthetic oligonucleotide
cucuccagggcuucggcc

SEQ ID NO: 136432 - RNA, 18 nt, Artificial Sequence
  Description of Artificial Sequence: Synthetic oligonucleotide
gggaucucuccagggcuu

SEQ ID NO: 136433 - RNA, 18 nt, Artificial Sequence
  Description of Artificial Sequence: Synthetic oligonucleotide
cuaagggagccuugcggg

SEQ ID NO: 136434 - RNA, 18 nt, Artificial Sequence
  Description of Artificial Sequence: Synthetic oligonucleotide
caucuaagggagccuugc

SEQ ID NO: 136435 - RNA, 18 nt, Artificial Sequence
  Description of Artificial Sequence: Synthetic oligonucleotide
ucaggcaucuaagggagc

SEQ ID NO: 136436 - RNA, 18 nt, Artificial Sequence
  Description of Artificial Sequence: Synthetic oligonucleotide
gaaugucaggcaucuaag

SEQ ID NO: 136437 - RNA, 18 nt, Artificial Sequence
  Description of Artificial Sequence: Synthetic oligonucleotide
gaacagaaugucaggcau

SEQ ID NO: 136438 - RNA, 18 nt, Artificial Sequence
  Description of Artificial Sequence: Synthetic oligonucleotide
aggaagaacagaauguca

SEQ ID NO: 136439 - RNA, 18 nt, Artificial Sequence
  Description of Artificial Sequence: Synthetic oligonucleotide
gcuucaggaagaacagaa

SEQ ID NO: 136440 - RNA, 18 nt, Artificial Sequence
  Description of Artificial Sequence: Synthetic oligonucleotide
gugaggcuucaggaagaa

SEQ ID NO: 136441 - RNA, 18 nt, Artificial Sequence
  Description of Artificial Sequence: Synthetic oligonucleotide
agggagugaggcuucagg

SEQ ID NO: 136442 - RNA, 18 nt, Artificial Sequence
  Description of Artificial Sequence: Synthetic oligonucleotide
gagguuggugccuucuga

SEQ ID NO: 136443 - RNA, 18 nt, Artificial Sequence
  Description of Artificial Sequence: Synthetic oligonucleotide
gcguugagguuggugccu

SEQ ID NO: 136444 - RNA, 18 nt, Artificial Sequence
  Description of Artificial Sequence: Synthetic oligonucleotide
ugggcgcguugagguugg

SEQ ID NO: 136445 - RNA, 18 nt, Artificial Sequence
  Description of Artificial Sequence: Synthetic oligonucleotide
gcuguugggcgcguugag

SEQ ID NO: 136446 - RNA, 18 nt, Artificial Sequence
  Description of Artificial Sequence: Synthetic oligonucleotide
cccaggcuguugggcgcg

SEQ ID NO: 136447 - RNA, 18 nt, Artificial Sequence
  Description of Artificial Sequence: Synthetic oligonucleotide
ugacacccaggcuguugg

SEQ ID NO: 136448 - RNA, 18 nt, Artificial Sequence
  Description of Artificial Sequence: Synthetic oligonucleotide
ggcgcugacacccaggcu

SEQ ID NO: 136449 - RNA, 18 nt, Artificial Sequence
  Description of Artificial Sequence: Synthetic oligonucleotide
cacagggcgcugacaccc

SEQ ID NO: 136450 - RNA, 18 nt, Artificial Sequence
  Description of Artificial Sequence: Synthetic oligonucleotide
uggcacacagggcgcuga

SEQ ID NO: 136451 - RNA, 18 nt, Artificial Sequence
  Description of Artificial Sequence: Synthetic oligonucleotide
gcagauggcacacagggc

SEQ ID NO: 136452 - RNA, 18 nt, Artificial Sequence
  Description of Artificial Sequence: Synthetic oligonucleotide
uccccgcagauggcacac

SEQ ID NO: 136453 - RNA, 18 nt, Artificial Sequence
  Description of Artificial Sequence: Synthetic oligonucleotide
cccgguccccgcagaugg

SEQ ID NO: 136454 - RNA, 18 nt, Artificial Sequence
  Description of Artificial Sequence: Synthetic oligonucleotide
cguggcccgguccccgca

SEQ ID NO: 136455 - RNA, 18 nt, Artificial Sequence
  Description of Artificial Sequence: Synthetic oligonucleotide
uugcccguggcccggucc

SEQ ID NO: 136456 - RNA, 18 nt, Artificial Sequence
  Description of Artificial Sequence: Synthetic oligonucleotide
aguguuugcccguggccc

SEQ ID NO: 136457 - RNA, 18 nt, Artificial Sequence
  Description of Artificial Sequence: Synthetic oligonucleotide
accguaguguuugcccgu

SEQ ID NO: 136458 - RNA, 18 nt, Artificial Sequence
  Description of Artificial Sequence: Synthetic oligonucleotide
gaggcaccguaguguuug

SEQ ID NO: 136459 - RNA, 18 nt, Artificial Sequence
  Description of Artificial Sequence: Synthetic oligonucleotide
agcucgaggcaccguagu

SEQ ID NO: 136460 - RNA, 18 nt, Artificial Sequence
  Description of Artificial Sequence: Synthetic oligonucleotide
gucacagcucgaggcacc

SEQ ID NO: 136461 - RNA, 18 nt, Artificial Sequence
  Description of Artificial Sequence: Synthetic oligonucleotide
cagccgucacagcucgag

SEQ ID NO: 136462 - RNA, 18 nt, Artificial Sequence
  Description of Artificial Sequence: Synthetic oligonucleotide
ccuugcagccgucacagc

SEQ ID NO: 136463 - RNA, 18 nt, Artificial Sequence
  Description of Artificial Sequence: Synthetic oligonucleotide
gaagcccuugcagccguc

SEQ ID NO: 136464 - RNA, 18 nt, Artificial Sequence
  Description of Artificial Sequence: Synthetic oligonucleotide
cggaagaagcccuugcag

SEQ ID NO: 136465 - RNA, 18 nt, Artificial Sequence
  Description of Artificial Sequence: Synthetic oligonucleotide
uccuccggaagaagcccu

SEQ ID NO: 136466 - RNA, 18 nt, Artificial Sequence
  Description of Artificial Sequence: Synthetic oligonucleotide
cacgcuccuccggaagaa

SEQ ID NO: 136467 - RNA, 18 nt, Artificial Sequence
  Description of Artificial Sequence: Synthetic oligonucleotide
uuccgcacgcuccuccgg

SEQ ID NO: 136468 - RNA, 18 nt, Artificial Sequence
  Description of Artificial Sequence: Synthetic oligonucleotide
gguucuuccgcacgcucc

SEQ ID NO: 136469 - RNA, 18 nt, Artificial Sequence
  Description of Artificial Sequence: Synthetic oligonucleotide
caugugguucuuccgcac

SEQ ID NO: 136470 - RNA, 18 nt, Artificial Sequence
  Description of Artificial Sequence: Synthetic oligonucleotide
gaguacaugugguucuuc

SEQ ID NO: 136471 - RNA, 18 nt, Artificial Sequence
  Description of Artificial Sequence: Synthetic oligonucleotide
ugcaggaguacauguggu

SEQ ID NO: 136472 - RNA, 18 nt, Artificial Sequence
  Description of Artificial Sequence: Synthetic oligonucleotide
uuggugccuucugauggg

SEQ ID NO: 136473 - RNA, 18 nt, Artificial Sequence
  Description of Artificial Sequence: Synthetic oligonucleotide
gguuggugccuucugaug

SEQ ID NO: 136474 - RNA, 18 nt, Artificial Sequence
  Description of Artificial Sequence: Synthetic oligonucleotide
guugagguuggugccuuc

SEQ ID NO: 136475 - RNA, 18 nt, Artificial Sequence
  Description of Artificial Sequence: Synthetic oligonucleotide
ggcgcguugagguuggug

SEQ ID NO: 136476 - RNA, 18 nt, Artificial Sequence
  Description of Artificial Sequence: Synthetic oligonucleotide
uguugggcgcguugaggu

SEQ ID NO: 136477 - RNA, 18 nt, Artificial Sequence
  Description of Artificial Sequence: Synthetic oligonucleotide
caggcuguugggcgcguu

SEQ ID NO: 136478 - RNA, 18 nt, Artificial Sequence
  Description of Artificial Sequence: Synthetic oligonucleotide
acacccaggcuguugggc

SEQ ID NO: 136479 - RNA, 18 nt, Artificial Sequence
  Description of Artificial Sequence: Synthetic oligonucleotide
cgcugacacccaggcugu

SEQ ID NO: 136480 - RNA, 18 nt, Artificial Sequence
  Description of Artificial Sequence: Synthetic oligonucleotide
cagggcgcugacacccag

SEQ ID NO: 136481 - RNA, 18 nt, Artificial Sequence
  Description of Artificial Sequence: Synthetic oligonucleotide
gcacacagggcgcugaca

SEQ ID NO: 136482 - RNA, 18 nt, Artificial Sequence
  Description of Artificial Sequence: Synthetic oligonucleotide
agauggcacacagggcgc

SEQ ID NO: 136483 - RNA, 18 nt, Artificial Sequence
  Description of Artificial Sequence: Synthetic oligonucleotide
cccgcagauggcacacag

SEQ ID NO: 136484 - RNA, 18 nt, Artificial Sequence
  Description of Artificial Sequence: Synthetic oligonucleotide
cgguccccgcagauggca

SEQ ID NO: 136485 - RNA, 18 nt, Artificial Sequence
  Description of Artificial Sequence: Synthetic oligonucleotide
uggcccgguccccgcaga

SEQ ID NO: 136486 - RNA, 18 nt, Artificial Sequence
  Description of Artificial Sequence: Synthetic oligonucleotide
gcccguggcccggucccc

SEQ ID NO: 136487 - RNA, 18 nt, Artificial Sequence
  Description of Artificial Sequence: Synthetic oligonucleotide
uguuugcccguggcccgg

SEQ ID NO: 136488 - RNA, 18 nt, Artificial Sequence
  Description of Artificial Sequence: Synthetic oligonucleotide
cguaguguuugcccgugg

SEQ ID NO: 136489 - RNA, 18 nt, Artificial Sequence
  Description of Artificial Sequence: Synthetic oligonucleotide
ggcaccguaguguuugcc

SEQ ID NO: 136490 - RNA, 18 nt, Artificial Sequence
  Description of Artificial Sequence: Synthetic oligonucleotide
cucgaggcaccguagugu

SEQ ID NO: 136491 - RNA, 18 nt, Artificial Sequence
  Description of Artificial Sequence: Synthetic oligonucleotide
cacagcucgaggcaccgu

SEQ ID NO: 136492 - RNA, 18 nt, Artificial Sequence
  Description of Artificial Sequence: Synthetic oligonucleotide
gccgucacagcucgaggc

SEQ ID NO: 136493 - RNA, 18 nt, Artificial Sequence
  Description of Artificial Sequence: Synthetic oligonucleotide
uugcagccgucacagcuc

SEQ ID NO: 136494 - RNA, 18 nt, Artificial Sequence
  Description of Artificial Sequence: Synthetic oligonucleotide
agcccuugcagccgucac

SEQ ID NO: 136495 - RNA, 18 nt, Artificial Sequence
  Description of Artificial Sequence: Synthetic oligonucleotide
gaagaagcccuugcagcc

SEQ ID NO: 136496 - RNA, 18 nt, Artificial Sequence
  Description of Artificial Sequence: Synthetic oligonucleotide
cuccggaagaagcccuug

SEQ ID NO: 136497 - RNA, 18 nt, Artificial Sequence
  Description of Artificial Sequence: Synthetic oligonucleotide
cgcuccuccggaagaagc

SEQ ID NO: 136498 - RNA, 18 nt, Artificial Sequence
  Description of Artificial Sequence: Synthetic oligonucleotide
ccgcacgcuccuccggaa

SEQ ID NO: 136499 - RNA, 18 nt, Artificial Sequence
  Description of Artificial Sequence: Synthetic oligonucleotide
uucuuccgcacgcuccuc

SEQ ID NO: 136500 - RNA, 18 nt, Artificial Sequence
  Description of Artificial Sequence: Synthetic oligonucleotide
ugugguucuuccgcacgc

SEQ ID NO: 136501 - RNA, 18 nt, Artificial Sequence
  Description of Artificial Sequence: Synthetic oligonucleotide
guacaugugguucuuccg

SEQ ID NO: 136502 - RNA, 18 nt, Artificial Sequence
  Description of Artificial Sequence: Synthetic oligonucleotide
caggaguacaugugguuc

SEQ ID NO: 136503 - RNA, 18 nt, Artificial Sequence
  Description of Artificial Sequence: Synthetic oligonucleotide
cugaagaaauugaggcuc

SEQ ID NO: 136504 - RNA, 18 nt, Artificial Sequence
  Description of Artificial Sequence: Synthetic oligonucleotide
cccagcugaagaaauuga

SEQ ID NO: 136505 - RNA, 18 nt, Artificial Sequence
  Description of Artificial Sequence: Synthetic oligonucleotide
cauuucccagcugaagaa

SEQ ID NO: 136506 - RNA, 18 nt, Artificial Sequence
  Description of Artificial Sequence: Synthetic oligonucleotide
gugcccauuucccagcug

SEQ ID NO: 136507 - RNA, 18 nt, Artificial Sequence
  Description of Artificial Sequence: Synthetic oligonucleotide
caagugugcccauuuccc

SEQ ID NO: 136508 - RNA, 18 nt, Artificial Sequence
  Description of Artificial Sequence: Synthetic oligonucleotide
gagcccaagugugcccau

SEQ ID NO: 136509 - RNA, 18 nt, Artificial Sequence
  Description of Artificial Sequence: Synthetic oligonucleotide
gccaugagcccaagugug

SEQ ID NO: 136510 - RNA, 18 nt, Artificial Sequence
  Description of Artificial Sequence: Synthetic oligonucleotide
gggccaugagcccaagug

SEQ ID NO: 136511 - RNA, 18 nt, Artificial Sequence
  Description of Artificial Sequence: Synthetic oligonucleotide
gagaagacagaccuuggg

SEQ ID NO: 136512 - RNA, 18 nt, Artificial Sequence
  Description of Artificial Sequence: Synthetic oligonucleotide
ucagggagaagacagacc

SEQ ID NO: 136513 - RNA, 18 nt, Artificial Sequence
  Description of Artificial Sequence: Synthetic oligonucleotide
cccacucagggagaagac

SEQ ID NO: 136514 - RNA, 18 nt, Artificial Sequence
  Description of Artificial Sequence: Synthetic oligonucleotide
accuacccacucagggag

SEQ ID NO: 136515 - RNA, 18 nt, Artificial Sequence
  Description of Artificial Sequence: Synthetic oligonucleotide
cugggaccuacccacuca

SEQ ID NO: 136516 - RNA, 18 nt, Artificial Sequence
  Description of Artificial Sequence: Synthetic oligonucleotide
ugucucugggaccuaccc

SEQ ID NO: 136517 - RNA, 18 nt, Artificial Sequence
  Description of Artificial Sequence: Synthetic oligonucleotide
gcagcugucucugggacc

SEQ ID NO: 136518 - RNA, 18 nt, Artificial Sequence
  Description of Artificial Sequence: Synthetic oligonucleotide
gaagggcagcugucucug

SEQ ID NO: 136519 - RNA, 18 nt, Artificial Sequence
  Description of Artificial Sequence: Synthetic oligonucleotide
gcccugaagggcagcugu

SEQ ID NO: 136520 - RNA, 18 nt, Artificial Sequence
  Description of Artificial Sequence: Synthetic oligonucleotide
ugaaggcccugaagggca

SEQ ID NO: 136521 - RNA, 18 nt, Artificial Sequence
  Description of Artificial Sequence: Synthetic oligonucleotide
agccuugaaggcccugaa

SEQ ID NO: 136522 - RNA, 18 nt, Artificial Sequence
  Description of Artificial Sequence: Synthetic oligonucleotide
agaagagccuugaaggcc

SEQ ID NO: 136523 - RNA, 18 nt, Artificial Sequence
  Description of Artificial Sequence: Synthetic oligonucleotide
aaaccagaagagccuuga

SEQ ID NO: 136524 - RNA, 18 nt, Artificial Sequence
  Description of Artificial Sequence: Synthetic oligonucleotide
uuacaaaaccagaagagc

SEQ ID NO: 136525 - RNA, 18 nt, Artificial Sequence
  Description of Artificial Sequence: Synthetic oligonucleotide
gucuuuuacaaaaccaga

SEQ ID NO: 136526 - RNA, 18 nt, Artificial Sequence
  Description of Artificial Sequence: Synthetic oligonucleotide
acaaagucuuuuacaaaa

SEQ ID NO: 136527 - RNA, 18 nt, Artificial Sequence
  Description of Artificial Sequence: Synthetic oligonucleotide
gauucacaaagucuuuua

SEQ ID NO: 136528 - RNA, 18 nt, Artificial Sequence
  Description of Artificial Sequence: Synthetic oligonucleotide
ucuuggauucacaaaguc

SEQ ID NO: 136529 - RNA, 18 nt, Artificial Sequence
  Description of Artificial Sequence: Synthetic oligonucleotide
gcucuucuuggauucaca

SEQ ID NO: 136530 - RNA, 18 nt, Artificial Sequence
  Description of Artificial Sequence: Synthetic oligonucleotide
uagaugcucuucuuggau

SEQ ID NO: 136531 - RNA, 18 nt, Artificial Sequence
  Description of Artificial Sequence: Synthetic oligonucleotide
uagaauagaugcucuucu

SEQ ID NO: 136532 - RNA, 18 nt, Artificial Sequence
  Description of Artificial Sequence: Synthetic oligonucleotide
guuccuagaauagaugcu

SEQ ID NO: 136533 - RNA, 18 nt, Artificial Sequence
  Description of Artificial Sequence: Synthetic oligonucleotide
augugguuccuagaauag

SEQ ID NO: 136534 - RNA, 18 nt, Artificial Sequence
  Description of Artificial Sequence: Synthetic oligonucleotide
aguaaaugugguuccuag

SEQ ID NO: 136535 - RNA, 18 nt, Artificial Sequence
  Description of Artificial Sequence: Synthetic oligonucleotide
ugaucaguaaaugugguu

SEQ ID NO: 136536 - RNA, 18 nt, Artificial Sequence
  Description of Artificial Sequence: Synthetic oligonucleotide
cuugaugaucaguaaaug

SEQ ID NO: 136537 - RNA, 18 nt, Artificial Sequence
  Description of Artificial Sequence: Synthetic oligonucleotide
aguagcuugaugaucagu

SEQ ID NO: 136538 - RNA, 18 nt, Artificial Sequence
  Description of Artificial Sequence: Synthetic oligonucleotide
cagccaguagcuugauga

SEQ ID NO: 136539 - RNA, 18 nt, Artificial Sequence
  Description of Artificial Sequence: Synthetic oligonucleotide
aacggcagccaguagcuu

SEQ ID NO: 136540 - RNA, 18 nt, Artificial Sequence
  Description of Artificial Sequence: Synthetic oligonucleotide
caauaaacggcagccagu

SEQ ID NO: 136541 - RNA, 18 nt, Artificial Sequence
  Description of Artificial Sequence: Synthetic oligonucleotide
gagcucaauaaacggcag

SEQ ID NO: 136542 - RNA, 18 nt, Artificial Sequence
  Description of Artificial Sequence: Synthetic oligonucleotide
gauaagagcucaauaaac

SEQ ID NO: 136543 - RNA, 18 nt, Artificial Sequence
  Description of Artificial Sequence: Synthetic oligonucleotide
cauaugauaagagcucaa

SEQ ID NO: 136544 - RNA, 18 nt, Artificial Sequence
  Description of Artificial Sequence: Synthetic oligonucleotide
ccuggcauaugauaagag

SEQ ID NO: 136545 - RNA, 18 nt, Artificial Sequence
  Description of Artificial Sequence: Synthetic oligonucleotide
uugugccuggcauaugau

SEQ ID NO: 136546 - RNA, 18 nt, Artificial Sequence
  Description of Artificial Sequence: Synthetic oligonucleotide
uaguauugugccuggcau

SEQ ID NO: 136547 - RNA, 18 nt, Artificial Sequence
  Description of Artificial Sequence: Synthetic oligonucleotide
agacuuaguauugugccu

SEQ ID NO: 136548 - RNA, 18 nt, Artificial Sequence
  Description of Artificial Sequence: Synthetic oligonucleotide
cacaaagacuuaguauug

SEQ ID NO: 136549 - RNA, 18 nt, Artificial Sequence
  Description of Artificial Sequence: Synthetic oligonucleotide
auacacacaaagacuuag

SEQ ID NO: 136550 - RNA, 18 nt, Artificial Sequence
  Description of Artificial Sequence: Synthetic oligonucleotide
gguaaauacacacaaaga

SEQ ID NO: 136551 - RNA, 18 nt, Artificial Sequence
  Description of Artificial Sequence: Synthetic oligonucleotide
ggauggguaaauacacac

SEQ ID NO: 136552 - RNA, 18 nt, Artificial Sequence
  Description of Artificial Sequence: Synthetic oligonucleotide
gggauggguaaauacaca

SEQ ID NO: 136553 - RNA, 18 nt, Artificial Sequence
  Description of Artificial Sequence: Synthetic oligonucleotide
caacaaugggcucaaggg

SEQ ID NO: 136554 - RNA, 18 nt, Artificial Sequence
  Description of Artificial Sequence: Synthetic oligonucleotide
aaaaacaacaaugggcuc

SEQ ID NO: 136555 - RNA, 18 nt, Artificial Sequence
  Description of Artificial Sequence: Synthetic oligonucleotide
augggaaaaacaacaaug

SEQ ID NO: 136556 - RNA, 18 nt, Artificial Sequence
  Description of Artificial Sequence: Synthetic oligonucleotide
auggaaugggaaaaacaa

SEQ ID NO: 136557 - RNA, 18 nt, Artificial Sequence
  Description of Artificial Sequence: Synthetic oligonucleotide
gccccauggaaugggaaa

SEQ ID NO: 136558 - RNA, 18 nt, Artificial Sequence
  Description of Artificial Sequence: Synthetic oligonucleotide
gagaggccccauggaaug

SEQ ID NO: 136559 - RNA, 18 nt, Artificial Sequence
  Description of Artificial Sequence: Synthetic oligonucleotide
uucaggagaggccccaug

SEQ ID NO: 136560 - RNA, 18 nt, Artificial Sequence
  Description of Artificial Sequence: Synthetic oligonucleotide
gaggcuucaggagaggcc

SEQ ID NO: 136561 - RNA, 18 nt, Artificial Sequence
  Description of Artificial Sequence: Synthetic oligonucleotide
cuacugaggcuucaggag

SEQ ID NO: 136562 - RNA, 18 nt, Artificial Sequence
  Description of Artificial Sequence: Synthetic oligonucleotide
cucaucuacugaggcuuc

SEQ ID NO: 136563 - RNA, 18 nt, Artificial Sequence
  Description of Artificial Sequence: Synthetic oligonucleotide
acgggcucaucuacugag

SEQ ID NO: 136564 - RNA, 18 nt, Artificial Sequence
  Description of Artificial Sequence: Synthetic oligonucleotide
ggaagacgggcucaucua

SEQ ID NO: 136565 - RNA, 18 nt, Artificial Sequence
  Description of Artificial Sequence: Synthetic oligonucleotide
agacuggaagacgggcuc

SEQ ID NO: 136566 - RNA, 18 nt, Artificial Sequence
  Description of Artificial Sequence: Synthetic oligonucleotide
gcaccagacuggaagacg

SEQ ID NO: 136567 - RNA, 18 nt, Artificial Sequence
  Description of Artificial Sequence: Synthetic oligonucleotide
aaacagcaccagacugga

SEQ ID NO: 136568 - RNA, 18 nt, Artificial Sequence
  Description of Artificial Sequence: Synthetic oligonucleotide
cccaaaaacagcaccaga

SEQ ID NO: 136569 - RNA, 18 nt, Artificial Sequence
  Description of Artificial Sequence: Synthetic oligonucleotide
uuugucccaaaaacagca

SEQ ID NO: 136570 - RNA, 18 nt, Artificial Sequence
  Description of Artificial Sequence: Synthetic oligonucleotide
uccuauuugucccaaaaa

SEQ ID NO: 136571 - RNA, 18 nt, Artificial Sequence
  Description of Artificial Sequence: Synthetic oligonucleotide
caaucuccuauuuguccc

SEQ ID NO: 136572 - RNA, 18 nt, Artificial Sequence
  Description of Artificial Sequence: Synthetic oligonucleotide
gggucaaucuccuauuug

SEQ ID NO: 136573 - RNA, 18 nt, Artificial Sequence
  Description of Artificial Sequence: Synthetic oligonucleotide
uagguggaacggccuggg

SEQ ID NO: 136574 - RNA, 18 nt, Artificial Sequence
  Description of Artificial Sequence: Synthetic oligonucleotide
ggguagguggaacggccu

SEQ ID NO: 136575 - RNA, 18 nt, Artificial Sequence
  Description of Artificial Sequence: Synthetic oligonucleotide
uugguggaagccccuggg

SEQ ID NO: 136576 - RNA, 18 nt, Artificial Sequence
  Description of Artificial Sequence: Synthetic oligonucleotide
ggguugguggaagccccu

SEQ ID NO: 136577 - RNA, 18 nt, Artificial Sequence
  Description of Artificial Sequence: Synthetic oligonucleotide
ccuugggaagacuuuggg

SEQ ID NO: 136578 - RNA, 18 nt, Artificial Sequence
  Description of Artificial Sequence: Synthetic oligonucleotide
caaggccuugggaagacu

SEQ ID NO: 136579 - RNA, 18 nt, Artificial Sequence
  Description of Artificial Sequence: Synthetic oligonucleotide
cucuccaaggccuuggga

SEQ ID NO: 136580 - RNA, 18 nt, Artificial Sequence
  Description of Artificial Sequence: Synthetic oligonucleotide
gagggcucuccaaggccu

SEQ ID NO: 136581 - RNA, 18 nt, Artificial Sequence
  Description of Artificial Sequence: Synthetic oligonucleotide
cgaaagagggcucuccaa

SEQ ID NO: 136582 - RNA, 18 nt, Artificial Sequence
  Description of Artificial Sequence: Synthetic oligonucleotide
gcuuucgaaagagggcuc

SEQ ID NO: 136583 - RNA, 18 nt, Artificial Sequence
  Description of Artificial Sequence: Synthetic oligonucleotide
gagaugcuuucgaaagag

SEQ ID NO: 136584 - RNA, 18 nt, Artificial Sequence
  Description of Artificial Sequence: Synthetic oligonucleotide
aacaggagaugcuuucga

SEQ ID NO: 136585 - RNA, 18 nt, Artificial Sequence
  Description of Artificial Sequence: Synthetic oligonucleotide
cccagaacaggagaugcu

SEQ ID NO: 136586 - RNA, 18 nt, Artificial Sequence
  Description of Artificial Sequence: Synthetic oligonucleotide
cauuacccagaacaggag

SEQ ID NO: 136587 - RNA, 18 nt, Artificial Sequence
  Description of Artificial Sequence: Synthetic oligonucleotide
auugucauuacccagaac

SEQ ID NO: 136588 - RNA, 18 nt, Artificial Sequence
  Description of Artificial Sequence: Synthetic oligonucleotide
uuauuauugucauuaccc

SEQ ID NO: 136589 - RNA, 18 nt, Artificial Sequence
  Description of Artificial Sequence: Synthetic oligonucleotide
ugauuuuauuauugucau

SEQ ID NO: 136590 - RNA, 18 nt, Artificial Sequence
  Description of Artificial Sequence: Synthetic oligonucleotide
ugcuaugauuuuauuauu

SEQ ID NO: 136591 - RNA, 18 nt, Artificial Sequence
  Description of Artificial Sequence: Synthetic oligonucleotide
acagcugcuaugauuuua

SEQ ID NO: 136592 - RNA, 18 nt, Artificial Sequence
  Description of Artificial Sequence: Synthetic oligonucleotide
aauugacagcugcuauga

SEQ ID NO: 136593 - RNA, 18 nt, Artificial Sequence
  Description of Artificial Sequence: Synthetic oligonucleotide
cucgcaauugacagcugc

SEQ ID NO: 136594 - RNA, 18 nt, Artificial Sequence
  Description of Artificial Sequence: Synthetic oligonucleotide
caaaugccuagcccucca

SEQ ID NO: 136595 - RNA, 18 nt, Artificial Sequence
  Description of Artificial Sequence: Synthetic oligonucleotide
uugggcaaaugccuagcc

SEQ ID NO: 136596 - RNA, 18 nt, Artificial Sequence
  Description of Artificial Sequence: Synthetic oligonucleotide
ugaccuugggcaaaugcc

SEQ ID NO: 136597 - RNA, 18 nt, Artificial Sequence
  Description of Artificial Sequence: Synthetic oligonucleotide
cugguugaccuugggcaa

SEQ ID NO: 136598 - RNA, 18 nt, Artificial Sequence
  Description of Artificial Sequence: Synthetic oligonucleotide
ucaagcugguugaccuug

SEQ ID NO: 136599 - RNA, 18 nt, Artificial Sequence
  Description of Artificial Sequence: Synthetic oligonucleotide
gugauucaagcugguuga

SEQ ID NO: 136600 - RNA, 18 nt, Artificial Sequence
  Description of Artificial Sequence: Synthetic oligonucleotide
ugccagugauucaagcug

SEQ ID NO: 136601 - RNA, 18 nt, Artificial Sequence
  Description of Artificial Sequence: Synthetic oligonucleotide
ggcucugccagugauuca

SEQ ID NO: 136602 - RNA, 18 nt, Artificial Sequence
  Description of Artificial Sequence: Synthetic oligonucleotide
acccuggcucugccagug

SEQ ID NO: 136603 - RNA, 18 nt, Artificial Sequence
  Description of Artificial Sequence: Synthetic oligonucleotide
uguuaacccuggcucugc

SEQ ID NO: 136604 - RNA, 18 nt, Artificial Sequence
  Description of Artificial Sequence: Synthetic oligonucleotide
cugaauguuaacccuggc

SEQ ID NO: 136605 - RNA, 18 nt, Artificial Sequence
  Description of Artificial Sequence: Synthetic oligonucleotide
gggcccugaauguuaacc

SEQ ID NO: 136606 - RNA, 18 nt, Artificial Sequence
  Description of Artificial Sequence: Synthetic oligonucleotide
accguggugauggguggg

SEQ ID NO: 136607 - RNA, 18 nt, Artificial Sequence
  Description of Artificial Sequence: Synthetic oligonucleotide
caccguggugaugggugg

SEQ ID NO: 136608 - RNA, 18 nt, Artificial Sequence
  Description of Artificial Sequence: Synthetic oligonucleotide
ugccacaccguggugaug

SEQ ID NO: 136609 - RNA, 18 nt, Artificial Sequence
  Description of Artificial Sequence: Synthetic oligonucleotide
ggcagugccacaccgugg

SEQ ID NO: 136610 - RNA, 18 nt, Artificial Sequence
  Description of Artificial Sequence: Synthetic oligonucleotide
guagaggcagugccacac

SEQ ID NO: 136611 - RNA, 18 nt, Artificial Sequence
  Description of Artificial Sequence: Synthetic oligonucleotide
aggaaguagaggcagugc

SEQ ID NO: 136612 - RNA, 18 nt, Artificial Sequence
  Description of Artificial Sequence: Synthetic oligonucleotide
gggauaggaaguagaggc

SEQ ID NO: 136613 - RNA, 18 nt, Artificial Sequence
  Description of Artificial Sequence: Synthetic oligonucleotide
aagccucucucuggaggg

SEQ ID NO: 136614 - RNA, 18 nt, Artificial Sequence
  Description of Artificial Sequence: Synthetic oligonucleotide
cauaagccucucucugga

SEQ ID NO: 136615 - RNA, 18 nt, Artificial Sequence
  Description of Artificial Sequence: Synthetic oligonucleotide
guucacauaagccucucu

SEQ ID NO: 136616 - RNA, 18 nt, Artificial Sequence
  Description of Artificial Sequence: Synthetic oligonucleotide
acucgguucacauaagcc

SEQ ID NO: 136617 - RNA, 18 nt, Artificial Sequence
  Description of Artificial Sequence: Synthetic oligonucleotide
uuaauacucgguucacau

SEQ ID NO: 136618 - RNA, 18 nt, Artificial Sequence
  Description of Artificial Sequence: Synthetic oligonucleotide
cagaguuaauacucgguu

SEQ ID NO: 136619 - RNA, 18 nt, Artificial Sequence
  Description of Artificial Sequence: Synthetic oligonucleotide
uggcucagaguuaauacu

SEQ ID NO: 136620 - RNA, 18 nt, Artificial Sequence
  Description of Artificial Sequence: Synthetic oligonucleotide
gguuauggcucagaguua

SEQ ID NO: 136621 - RNA, 18 nt, Artificial Sequence
  Description of Artificial Sequence: Synthetic oligonucleotide
cuccugguuauggcucag

SEQ ID NO: 136622 - RNA, 18 nt, Artificial Sequence
  Description of Artificial Sequence: Synthetic oligonucleotide
gcaggcuccugguuaugg

SEQ ID NO: 136623 - RNA, 18 nt, Artificial Sequence
  Description of Artificial Sequence: Synthetic oligonucleotide
ccauagcaggcuccuggu

SEQ ID NO: 136624 - RNA, 18 nt, Artificial Sequence
  Description of Artificial Sequence: Synthetic oligonucleotide
agaacccauagcaggcuc

SEQ ID NO: 136625 - RNA, 18 nt, Artificial Sequence
  Description of Artificial Sequence: Synthetic oligonucleotide
agcucagaacccauagca

SEQ ID NO: 136626 - RNA, 18 nt, Artificial Sequence
  Description of Artificial Sequence: Synthetic oligonucleotide
auaaaagcucagaaccca

SEQ ID NO: 136627 - RNA, 18 nt, Artificial Sequence
  Description of Artificial Sequence: Synthetic oligonucleotide
auccuauaaaagcucaga

SEQ ID NO: 136628 - RNA, 18 nt, Artificial Sequence
  Description of Artificial Sequence: Synthetic oligonucleotide
accacauccuauaaaagc

SEQ ID NO: 136629 - RNA, 18 nt, Artificial Sequence
  Description of Artificial Sequence: Synthetic oligonucleotide
uuuccaccacauccuaua

SEQ ID NO: 136630 - RNA, 18 nt, Artificial Sequence
  Description of Artificial Sequence: Synthetic oligonucleotide
ugcuauuuccaccacauc

SEQ ID NO: 136631 - RNA, 18 nt, Artificial Sequence
  Description of Artificial Sequence: Synthetic oligonucleotide
agcccugcuauuuccacc

SEQ ID NO: 136632 - RNA, 18 nt, Artificial Sequence
  Description of Artificial Sequence: Synthetic oligonucleotide
accagagcccugcuauuu

SEQ ID NO: 136633 - RNA, 18 nt, Artificial Sequence
  Description of Artificial Sequence: Synthetic oligonucleotide
ggaguaccagagcccugc

SEQ ID NO: 136634 - RNA, 18 nt, Artificial Sequence
  Description of Artificial Sequence: Synthetic oligonucleotide
ccucuggaguaccagagc

SEQ ID NO: 136635 - RNA, 18 nt, Artificial Sequence
  Description of Artificial Sequence: Synthetic oligonucleotide
cuugaccucuggaguacc

SEQ ID NO: 136636 - RNA, 18 nt, Artificial Sequence
  Description of Artificial Sequence: Synthetic oligonucleotide
ggaaccuugaccucugga

SEQ ID NO: 136637 - RNA, 18 nt, Artificial Sequence
  Description of Artificial Sequence: Synthetic oligonucleotide
aguugggaaccuugaccu

SEQ ID NO: 136638 - RNA, 18 nt, Artificial Sequence
  Description of Artificial Sequence: Synthetic oligonucleotide
agcugaguugggaaccuu

SEQ ID NO: 136639 - RNA, 18 nt, Artificial Sequence
  Description of Artificial Sequence: Synthetic oligonucleotide
guuagagcugaguuggga

SEQ ID NO: 136640 - RNA, 18 nt, Artificial Sequence
  Description of Artificial Sequence: Synthetic oligonucleotide
uugguguuagagcugagu

SEQ ID NO: 136641 - RNA, 18 nt, Artificial Sequence
  Description of Artificial Sequence: Synthetic oligonucleotide
gcugguugguguuagagc

SEQ ID NO: 136642 - RNA, 18 nt, Artificial Sequence
  Description of Artificial Sequence: Synthetic oligonucleotide
gcucugcugguugguguu

SEQ ID NO: 136643 - RNA, 18 nt, Artificial Sequence
  Description of Artificial Sequence: Synthetic oligonucleotide
gggucgcucugcugguug

SEQ ID NO: 136644 - RNA, 18 nt, Artificial Sequence
  Description of Artificial Sequence: Synthetic oligonucleotide
guccugggucgcucugcu

SEQ ID NO: 136645 - RNA, 18 nt, Artificial Sequence
  Description of Artificial Sequence: Synthetic oligonucleotide
augugguccugggucgcu

SEQ ID NO: 136646 - RNA, 18 nt, Artificial Sequence
  Description of Artificial Sequence: Synthetic oligonucleotide
gcaacaugugguccuggg

SEQ ID NO: 136647 - RNA, 18 nt, Artificial Sequence
  Description of Artificial Sequence: Synthetic oligonucleotide
gagaggcaacaugugguc

SEQ ID NO: 136648 - RNA, 18 nt, Artificial Sequence
  Description of Artificial Sequence: Synthetic oligonucleotide
gcucagagaggcaacaug

SEQ ID NO: 136649 - RNA, 18 nt, Artificial Sequence
  Description of Artificial Sequence: Synthetic oligonucleotide
cugaggcucagagaggca

SEQ ID NO: 136650 - RNA, 18 nt, Artificial Sequence
  Description of Artificial Sequence: Synthetic oligonucleotide
gaaaacugaggcucagag

SEQ ID NO: 136651 - RNA, 18 nt, Artificial Sequence
  Description of Artificial Sequence: Synthetic oligonucleotide
caugggaaaacugaggcu

SEQ ID NO: 136652 - RNA, 18 nt, Artificial Sequence
  Description of Artificial Sequence: Synthetic oligonucleotide
cuaaacaugggaaaacug

SEQ ID NO: 136653 - RNA, 18 nt, Artificial Sequence
  Description of Artificial Sequence: Synthetic oligonucleotide
uccugcuaaacaugggaa

SEQ ID NO: 136654 - RNA, 18 nt, Artificial Sequence
  Description of Artificial Sequence: Synthetic oligonucleotide
uccuguccugcuaaacau

SEQ ID NO: 136655 - RNA, 18 nt, Artificial Sequence
  Description of Artificial Sequence: Synthetic oligonucleotide
cccaguccuguccugcua

SEQ ID NO: 136656 - RNA, 18 nt, Artificial Sequence
  Description of Artificial Sequence: Synthetic oligonucleotide
aagagcccaguccugucc

SEQ ID NO: 136657 - RNA, 18 nt, Artificial Sequence
  Description of Artificial Sequence: Synthetic oligonucleotide
ucucuaagagcccagucc

SEQ ID NO: 136658 - RNA, 18 nt, Artificial Sequence
  Description of Artificial Sequence: Synthetic oligonucleotide
ugaacucucuaagagccc

SEQ ID NO: 136659 - RNA, 18 nt, Artificial Sequence
  Description of Artificial Sequence: Synthetic oligonucleotide
ugcuaugaacucucuaag

SEQ ID NO: 136660 - RNA, 18 nt, Artificial Sequence
  Description of Artificial Sequence: Synthetic oligonucleotide
aaaggugcuaugaacucu

SEQ ID NO: 136661 - RNA, 18 nt, Artificial Sequence
  Description of Artificial Sequence: Synthetic oligonucleotide
gcuggaaaggugcuauga

SEQ ID NO: 136662 - RNA, 18 nt, Artificial Sequence
  Description of Artificial Sequence: Synthetic oligonucleotide
caggagcuggaaaggugc

SEQ ID NO: 136663 - RNA, 18 nt, Artificial Sequence
  Description of Artificial Sequence: Synthetic oligonucleotide
cccaccaggagcuggaaa

SEQ ID NO: 136664 - RNA, 18 nt, Artificial Sequence
  Description of Artificial Sequence: Synthetic oligonucleotide
uugaacccaccaggagcu

SEQ ID NO: 136665 - RNA, 18 nt, Artificial Sequence
  Description of Artificial Sequence: Synthetic oligonucleotide
cucucuugaacccaccag

SEQ ID NO: 136666 - RNA, 18 nt, Artificial Sequence
  Description of Artificial Sequence: Synthetic oligonucleotide
gaguucucucuugaaccc

SEQ ID NO: 136667 - RNA, 18 nt, Artificial Sequence
  Description of Artificial Sequence: Synthetic oligonucleotide
cccgggaguucucucuug

SEQ ID NO: 136668 - RNA, 18 nt, Artificial Sequence
  Description of Artificial Sequence: Synthetic oligonucleotide
uucaucccgggaguucuc

SEQ ID NO: 136669 - RNA, 18 nt, Artificial Sequence
  Description of Artificial Sequence: Synthetic oligonucleotide
aucucuucaucccgggag

SEQ ID NO: 136670 - RNA, 18 nt, Artificial Sequence
  Description of Artificial Sequence: Synthetic oligonucleotide
cucucaucucuucauccc

SEQ ID NO: 136671 - RNA, 18 nt, Artificial Sequence
  Description of Artificial Sequence: Synthetic oligonucleotide
cagugcucucaucucuuc

SEQ ID NO: 136672 - RNA, 18 nt, Artificial Sequence
  Description of Artificial Sequence: Synthetic oligonucleotide
aaccucagugcucucauc

SEQ ID NO: 136673 - RNA, 18 nt, Artificial Sequence
  Description of Artificial Sequence: Synthetic oligonucleotide
cccccaaccucagugcuc

SEQ ID NO: 136674 - RNA, 18 nt, Artificial Sequence
  Description of Artificial Sequence: Synthetic oligonucleotide
uugaccccccaaccucag

SEQ ID NO: 136675 - RNA, 18 nt, Artificial Sequence
  Description of Artificial Sequence: Synthetic oligonucleotide
uccaguugaccccccaac

SEQ ID NO: 136676 - RNA, 18 nt, Artificial Sequence
  Description of Artificial Sequence: Synthetic oligonucleotide
ggcuauccaguugacccc

SEQ ID NO: 136677 - RNA, 18 nt, Artificial Sequence
  Description of Artificial Sequence: Synthetic oligonucleotide
gcccuggcuauccaguug

SEQ ID NO: 136678 - RNA, 18 nt, Artificial Sequence
  Description of Artificial Sequence: Synthetic oligonucleotide
cuagggcccuggcuaucc

SEQ ID NO: 136679 - RNA, 18 nt, Artificial Sequence
  Description of Artificial Sequence: Synthetic oligonucleotide
cagaacuagggcccuggc

SEQ ID NO: 136680 - RNA, 18 nt, Artificial Sequence
  Description of Artificial Sequence: Synthetic oligonucleotide
uaggacagaacuagggcc

SEQ ID NO: 136681 - RNA, 18 nt, Artificial Sequence
  Description of Artificial Sequence: Synthetic oligonucleotide
ccucuuaggacagaacua

SEQ ID NO: 136682 - RNA, 18 nt, Artificial Sequence
  Description of Artificial Sequence: Synthetic oligonucleotide
uuccuccucuuaggacag

SEQ ID NO: 136683 - RNA, 18 nt, Artificial Sequence
  Description of Artificial Sequence: Synthetic oligonucleotide
acaacuuccuccucuuag

SEQ ID NO: 136684 - RNA, 18 nt, Artificial Sequence
  Description of Artificial Sequence: Synthetic oligonucleotide
aagacacaacuuccuccu

SEQ ID NO: 136685 - RNA, 18 nt, Artificial Sequence
  Description of Artificial Sequence: Synthetic oligonucleotide
uggagaagacacaacuuc

SEQ ID NO: 136686 - RNA, 18 nt, Artificial Sequence
  Description of Artificial Sequence: Synthetic oligonucleotide
uuggauggagaagacaca

SEQ ID NO: 136687 - RNA, 18 nt, Artificial Sequence
  Description of Artificial Sequence: Synthetic oligonucleotide
gaugguuggauggagaag

SEQ ID NO: 136688 - RNA, 18 nt, Artificial Sequence
  Description of Artificial Sequence: Synthetic oligonucleotide
cacgcacugccggcuaaa

SEQ ID NO: 136689 - RNA, 18 nt, Artificial Sequence
  Description of Artificial Sequence: Synthetic oligonucleotide
uccaccacgcacugccgg

SEQ ID NO: 136690 - RNA, 18 nt, Artificial Sequence
  Description of Artificial Sequence: Synthetic oligonucleotide
cuuuguccaccacgcacu

SEQ ID NO: 136691 - RNA, 18 nt, Artificial Sequence
  Description of Artificial Sequence: Synthetic oligonucleotide
cuugucuuuguccaccac

SEQ ID NO: 136692 - RNA, 18 nt, Artificial Sequence
  Description of Artificial Sequence: Synthetic oligonucleotide
uuccucuugucuuugucc

SEQ ID NO: 136693 - RNA, 18 nt, Artificial Sequence
  Description of Artificial Sequence: Synthetic oligonucleotide
acugguuccucuugucuu

SEQ ID NO: 136694 - RNA, 18 nt, Artificial Sequence
  Description of Artificial Sequence: Synthetic oligonucleotide
gcggcacugguuccucuu

SEQ ID NO: 136695 - RNA, 18 nt, Artificial Sequence
  Description of Artificial Sequence: Synthetic oligonucleotide
caguagcggcacugguuc

SEQ ID NO: 136696 - RNA, 18 nt, Artificial Sequence
  Description of Artificial Sequence: Synthetic oligonucleotide
gccugcaguagcggcacu

SEQ ID NO: 136697 - RNA, 18 nt, Artificial Sequence
  Description of Artificial Sequence: Synthetic oligonucleotide
cuugagccugcaguagcg

SEQ ID NO: 136698 - RNA, 18 nt, Artificial Sequence
  Description of Artificial Sequence: Synthetic oligonucleotide
cauuucuugagccugcag

SEQ ID NO: 136699 - RNA, 18 nt, Artificial Sequence
  Description of Artificial Sequence: Synthetic oligonucleotide
ggaagcauuucuugagcc

SEQ ID NO: 136700 - RNA, 18 nt, Artificial Sequence
  Description of Artificial Sequence: Synthetic oligonucleotide
agcccggaagcauuucuu

SEQ ID NO: 136701 - RNA, 18 nt, Artificial Sequence
  Description of Artificial Sequence: Synthetic oligonucleotide
augccagcccggaagcau

SEQ ID NO: 136702 - RNA, 18 nt, Artificial Sequence
  Description of Artificial Sequence: Synthetic oligonucleotide
ucuucaugccagcccgga

SEQ ID NO: 136703 - RNA, 18 nt, Artificial Sequence
  Description of Artificial Sequence: Synthetic oligonucleotide
uuccuucuucaugccagc

SEQ ID NO: 136704 - RNA, 18 nt, Artificial Sequence
  Description of Artificial Sequence: Synthetic oligonucleotide
caccacgcacugccggcu

SEQ ID NO: 136705 - RNA, 18 nt, Artificial Sequence
  Description of Artificial Sequence: Synthetic oligonucleotide
uuguccaccacgcacugc

SEQ ID NO: 136706 - RNA, 18 nt, Artificial Sequence
  Description of Artificial Sequence: Synthetic oligonucleotide
ugucuuuguccaccacgc

SEQ ID NO: 136707 - RNA, 18 nt, Artificial Sequence
  Description of Artificial Sequence: Synthetic oligonucleotide
ccucuugucuuuguccac

SEQ ID NO: 136708 - RNA, 18 nt, Artificial Sequence
  Description of Artificial Sequence: Synthetic oligonucleotide
ugguuccucuugucuuug

SEQ ID NO: 136709 - RNA, 18 nt, Artificial Sequence
  Description of Artificial Sequence: Synthetic oligonucleotide
ggcacugguuccucuugu

SEQ ID NO: 136710 - RNA, 18 nt, Artificial Sequence
  Description of Artificial Sequence: Synthetic oligonucleotide
guagcggcacugguuccu

SEQ ID NO: 136711 - RNA, 18 nt, Artificial Sequence
  Description of Artificial Sequence: Synthetic oligonucleotide
cugcaguagcggcacugg

SEQ ID NO: 136712 - RNA, 18 nt, Artificial Sequence
  Description of Artificial Sequence: Synthetic oligonucleotide
ugagccugcaguagcggc

SEQ ID NO: 136713 - RNA, 18 nt, Artificial Sequence
  Description of Artificial Sequence: Synthetic oligonucleotide
uuucuugagccugcagua

SEQ ID NO: 136714 - RNA, 18 nt, Artificial Sequence
  Description of Artificial Sequence: Synthetic oligonucleotide
aagcauuucuugagccug

SEQ ID NO: 136715 - RNA, 18 nt, Artificial Sequence
  Description of Artificial Sequence: Synthetic oligonucleotide
cccggaagcauuucuuga

SEQ ID NO: 136716 - RNA, 18 nt, Artificial Sequence
  Description of Artificial Sequence: Synthetic oligonucleotide
gccagcccggaagcauuu

SEQ ID NO: 136717 - RNA, 18 nt, Artificial Sequence
  Description of Artificial Sequence: Synthetic oligonucleotide
uucaugccagcccggaag

SEQ ID NO: 136718 - RNA, 18 nt, Artificial Sequence
  Description of Artificial Sequence: Synthetic oligonucleotide
ccuucuucaugccagccc

SEQ ID NO: 136719 - RNA, 18 nt, Artificial Sequence
  Description of Artificial Sequence: Synthetic oligonucleotide
gcugugggugcagguggg

SEQ ID NO: 136720 - RNA, 18 nt, Artificial Sequence
  Description of Artificial Sequence: Synthetic oligonucleotide
gggagcugugggugcagg

SEQ ID NO: 136721 - RNA, 18 nt, Artificial Sequence
  Description of Artificial Sequence: Synthetic oligonucleotide
uuguaaaugacugucggg

SEQ ID NO: 136722 - RNA, 18 nt, Artificial Sequence
  Description of Artificial Sequence: Synthetic oligonucleotide
uacaguuguaaaugacug

SEQ ID NO: 136723 - RNA, 18 nt, Artificial Sequence
  Description of Artificial Sequence: Synthetic oligonucleotide
guggcuacaguuguaaau

SEQ ID NO: 136724 - RNA, 18 nt, Artificial Sequence
  Description of Artificial Sequence: Synthetic oligonucleotide
aaaguguggcuacaguug

SEQ ID NO: 136725 - RNA, 18 nt, Artificial Sequence
  Description of Artificial Sequence: Synthetic oligonucleotide
gucauaaaguguggcuac

SEQ ID NO: 136726 - RNA, 18 nt, Artificial Sequence
  Description of Artificial Sequence: Synthetic oligonucleotide
acugagucauaaagugug

SEQ ID NO: 136727 - RNA, 18 nt, Artificial Sequence
  Description of Artificial Sequence: Synthetic oligonucleotide
cugccacugagucauaaa

SEQ ID NO: 136728 - RNA, 18 nt, Artificial Sequence
  Description of Artificial Sequence: Synthetic oligonucleotide
gggccugccacugaguca

SEQ ID NO: 136729 - RNA, 18 nt, Artificial Sequence
  Description of Artificial Sequence: Synthetic oligonucleotide
uuagccagucacccuggg

SEQ ID NO: 136730 - RNA, 18 nt, Artificial Sequence
  Description of Artificial Sequence: Synthetic oligonucleotide
agccauuagccagucacc

SEQ ID NO: 136731 - RNA, 18 nt, Artificial Sequence
  Description of Artificial Sequence: Synthetic oligonucleotide
uucucagccauuagccag

SEQ ID NO: 136732 - RNA, 18 nt, Artificial Sequence
  Description of Artificial Sequence: Synthetic oligonucleotide
cccucuucucagccauua

SEQ ID NO: 136733 - RNA, 18 nt, Artificial Sequence
  Description of Artificial Sequence: Synthetic oligonucleotide
gcccucccucuucucagc

SEQ ID NO: 136734 - RNA, 18 nt, Artificial Sequence
  Description of Artificial Sequence: Synthetic oligonucleotide
uccaggcccucccucuuc

SEQ ID NO: 136735 - RNA, 18 nt, Artificial Sequence
  Description of Artificial Sequence: Synthetic oligonucleotide
agauuuccaggcccuccc

SEQ ID NO: 136736 - RNA, 18 nt, Artificial Sequence
  Description of Artificial Sequence: Synthetic oligonucleotide
uggucagauuuccaggcc

SEQ ID NO: 136737 - RNA, 18 nt, Artificial Sequence
  Description of Artificial Sequence: Synthetic oligonucleotide
cccuauggucagauuucc

SEQ ID NO: 136738 - RNA, 18 nt, Artificial Sequence
  Description of Artificial Sequence: Synthetic oligonucleotide
ccgcucccuauggucaga

SEQ ID NO: 136739 - RNA, 18 nt, Artificial Sequence
  Description of Artificial Sequence: Synthetic oligonucleotide
cccagccgcucccuaugg

SEQ ID NO: 136740 - RNA, 18 nt, Artificial Sequence
  Description of Artificial Sequence: Synthetic oligonucleotide
ccaagcccagccgcuccc

SEQ ID NO: 136741 - RNA, 18 nt, Artificial Sequence
  Description of Artificial Sequence: Synthetic oligonucleotide
caagaccaagcccagccg

SEQ ID NO: 136742 - RNA, 18 nt, Artificial Sequence
  Description of Artificial Sequence: Synthetic oligonucleotide
uuucucaagaccaagccc

SEQ ID NO: 136743 - RNA, 18 nt, Artificial Sequence
  Description of Artificial Sequence: Synthetic oligonucleotide
gaaucuuucucaagacca

SEQ ID NO: 136744 - RNA, 18 nt, Artificial Sequence
  Description of Artificial Sequence: Synthetic oligonucleotide
ucucugaaucuuucucaa

SEQ ID NO: 136745 - RNA, 18 nt, Artificial Sequence
  Description of Artificial Sequence: Synthetic oligonucleotide
uuaucucucugaaucuuu

SEQ ID NO: 136746 - RNA, 18 nt, Artificial Sequence
  Description of Artificial Sequence: Synthetic oligonucleotide
ggagcuuaucucucugaa

SEQ ID NO: 136747 - RNA, 18 nt, Artificial Sequence
  Description of Artificial Sequence: Synthetic oligonucleotide
gagugggagcuuaucucu

SEQ ID NO: 136748 - RNA, 18 nt, Artificial Sequence
  Description of Artificial Sequence: Synthetic oligonucleotide
gccaagagugggagcuua

SEQ ID NO: 136749 - RNA, 18 nt, Artificial Sequence
  Description of Artificial Sequence: Synthetic oligonucleotide
gaggagccaagaguggga

SEQ ID NO: 136750 - RNA, 18 nt, Artificial Sequence
  Description of Artificial Sequence: Synthetic oligonucleotide
agccugaggagccaagag

SEQ ID NO: 136751 - RNA, 18 nt, Artificial Sequence
  Description of Artificial Sequence: Synthetic oligonucleotide
cugggagccugaggagcc

SEQ ID NO: 136752 - RNA, 18 nt, Artificial Sequence
  Description of Artificial Sequence: Synthetic oligonucleotide
gguugcugggagccugag

SEQ ID NO: 136753 - RNA, 18 nt, Artificial Sequence
  Description of Artificial Sequence: Synthetic oligonucleotide
guggugguugcugggagc

SEQ ID NO: 136754 - RNA, 18 nt, Artificial Sequence
  Description of Artificial Sequence: Synthetic oligonucleotide
ggguggugguugcuggga

SEQ ID NO: 136755 - RNA, 18 nt, Artificial Sequence
  Description of Artificial Sequence: Synthetic oligonucleotide
gcagacaggcaggcaggg

SEQ ID NO: 136756 - RNA, 18 nt, Artificial Sequence
  Description of Artificial Sequence: Synthetic oligonucleotide
guggcgcagacaggcagg

SEQ ID NO: 136757 - RNA, 18 nt, Artificial Sequence
  Description of Artificial Sequence: Synthetic oligonucleotide
uugugguggcgcagacag

SEQ ID NO: 136758 - RNA, 18 nt, Artificial Sequence
  Description of Artificial Sequence: Synthetic oligonucleotide
cugcuuugugguggcgca

SEQ ID NO: 136759 - RNA, 18 nt, Artificial Sequence
  Description of Artificial Sequence: Synthetic oligonucleotide
cguggcugcuuuguggug

SEQ ID NO: 136760 - RNA, 18 nt, Artificial Sequence
  Description of Artificial Sequence: Synthetic oligonucleotide
cacaacguggcugcuuug

SEQ ID NO: 136761 - RNA, 18 nt, Artificial Sequence
  Description of Artificial Sequence: Synthetic oligonucleotide
acacacacaacguggcug

SEQ ID NO: 136762 - RNA, 18 nt, Artificial Sequence
  Description of Artificial Sequence: Synthetic oligonucleotide
cacacacacacacaacgu

SEQ ID NO: 136763 - RNA, 18 nt, Artificial Sequence
  Description of Artificial Sequence: Synthetic oligonucleotide
acacacacacacacacac

SEQ ID NO: 136764 - RNA, 18 nt, Artificial Sequence
  Description of Artificial Sequence: Synthetic oligonucleotide
cacacacacacacacaca

SEQ ID NO: 136765 - RNA, 18 nt, Artificial Sequence
  Description of Artificial Sequence: Synthetic oligonucleotide
acacacacacacacacac

SEQ ID NO: 136766 - RNA, 18 nt, Artificial Sequence
  Description of Artificial Sequence: Synthetic oligonucleotide
cacacacacacacacaca

SEQ ID NO: 136767 - RNA, 18 nt, Artificial Sequence
  Description of Artificial Sequence: Synthetic oligonucleotide
uuaaacacacacacacac

SEQ ID NO: 136768 - RNA, 18 nt, Artificial Sequence
  Description of Artificial Sequence: Synthetic oligonucleotide
uuauauuaaacacacaca

SEQ ID NO: 136769 - RNA, 18 nt, Artificial Sequence
  Description of Artificial Sequence: Synthetic oligonucleotide
aaauauuauauuaaacac

SEQ ID NO: 136770 - RNA, 18 nt, Artificial Sequence
  Description of Artificial Sequence: Synthetic oligonucleotide
guucgaaauauuauauua

SEQ ID NO: 136771 - RNA, 18 nt, Artificial Sequence
  Description of Artificial Sequence: Synthetic oligonucleotide
cuaacguucgaaauauua

SEQ ID NO: 136772 - RNA, 18 nt, Artificial Sequence
  Description of Artificial Sequence: Synthetic oligonucleotide
uuguccuaacguucgaaa

SEQ ID NO: 136773 - RNA, 18 nt, Artificial Sequence
  Description of Artificial Sequence: Synthetic oligonucleotide
uaugcuuguccuaacguu

SEQ ID NO: 136774 - RNA, 18 nt, Artificial Sequence
  Description of Artificial Sequence: Synthetic oligonucleotide
uucucuaugcuuguccua

SEQ ID NO: 136775 - RNA, 18 nt, Artificial Sequence
  Description of Artificial Sequence: Synthetic oligonucleotide
uaucauucucuaugcuug

SEQ ID NO: 136776 - RNA, 18 nt, Artificial Sequence
  Description of Artificial Sequence: Synthetic oligonucleotide
ugcaauaucauucucuau

SEQ ID NO: 136777 - RNA, 18 nt, Artificial Sequence
  Description of Artificial Sequence: Synthetic oligonucleotide
auguuugcaauaucauuc

SEQ ID NO: 136778 - RNA, 18 nt, Artificial Sequence
  Description of Artificial Sequence: Synthetic oligonucleotide
cucagauguuugcaauau

SEQ ID NO: 136779 - RNA, 18 nt, Artificial Sequence
  Description of Artificial Sequence: Synthetic oligonucleotide
gaguacucagauguuugc

SEQ ID NO: 136780 - RNA, 18 nt, Artificial Sequence
  Description of Artificial Sequence: Synthetic oligonucleotide
auagugaguacucagaug

SEQ ID NO: 136781 - RNA, 18 nt, Artificial Sequence
  Description of Artificial Sequence: Synthetic oligonucleotide
uugggauagugaguacuc

SEQ ID NO: 136782 - RNA, 18 nt, Artificial Sequence
  Description of Artificial Sequence: Synthetic oligonucleotide
uaaaguugggauagugag

SEQ ID NO: 136783 - RNA, 18 nt, Artificial Sequence
  Description of Artificial Sequence: Synthetic oligonucleotide
uuuuguaaaguugggaua

SEQ ID NO: 136784 - RNA, 18 nt, Artificial Sequence
  Description of Artificial Sequence: Synthetic oligonucleotide
gucccuuuuguaaaguug

SEQ ID NO: 136785 - RNA, 18 nt, Artificial Sequence
  Description of Artificial Sequence: Synthetic oligonucleotide
uggcugucccuuuuguaa

SEQ ID NO: 136786 - RNA, 18 nt, Artificial Sequence
  Description of Artificial Sequence: Synthetic oligonucleotide
uccucuggcugucccuuu

SEQ ID NO: 136787 - RNA, 18 nt, Artificial Sequence
  Description of Artificial Sequence: Synthetic oligonucleotide
cgggcuccucuggcuguc

SEQ ID NO: 136788 - RNA, 18 nt, Artificial Sequence
  Description of Artificial Sequence: Synthetic oligonucleotide
ggcaucgggcuccucugg

SEQ ID NO: 136789 - RNA, 18 nt, Artificial Sequence
  Description of Artificial Sequence: Synthetic oligonucleotide
gcucaggcaucgggcucc

SEQ ID NO: 136790 - RNA, 18 nt, Artificial Sequence
  Description of Artificial Sequence: Synthetic oligonucleotide
cggaagcucaggcaucgg

SEQ ID NO: 136791 - RNA, 18 nt, Artificial Sequence
  Description of Artificial Sequence: Synthetic oligonucleotide
gggaccggaagcucaggc

SEQ ID NO: 136792 - RNA, 18 nt, Artificial Sequence
  Description of Artificial Sequence: Synthetic oligonucleotide
ucccugggaccggaagcu

SEQ ID NO: 136793 - RNA, 18 nt, Artificial Sequence
  Description of Artificial Sequence: Synthetic oligonucleotide
auuugucccugggaccgg

SEQ ID NO: 136794 - RNA, 18 nt, Artificial Sequence
  Description of Artificial Sequence: Synthetic oligonucleotide
gggcauuugucccuggga

SEQ ID NO: 136795 - RNA, 18 nt, Artificial Sequence
  Description of Artificial Sequence: Synthetic oligonucleotide
aauacuaagggaacuggg

SEQ ID NO: 136796 - RNA, 18 nt, Artificial Sequence
  Description of Artificial Sequence: Synthetic oligonucleotide
gaaugaauacuaagggaa

SEQ ID NO: 136797 - RNA, 18 nt, Artificial Sequence
  Description of Artificial Sequence: Synthetic oligonucleotide
cccacgaaugaauacuaa

SEQ ID NO: 136798 - RNA, 18 nt, Artificial Sequence
  Description of Artificial Sequence: Synthetic oligonucleotide
ugauacccacgaaugaau

SEQ ID NO: 136799 - RNA, 18 nt, Artificial Sequence
  Description of Artificial Sequence: Synthetic oligonucleotide
ucacgugauacccacgaa

SEQ ID NO: 136800 - RNA, 18 nt, Artificial Sequence
  Description of Artificial Sequence: Synthetic oligonucleotide
ggagaucacgugauaccc

SEQ ID NO: 136801 - RNA, 18 nt, Artificial Sequence
  Description of Artificial Sequence: Synthetic oligonucleotide
acuuuggagaucacguga

SEQ ID NO: 136802 - RNA, 18 nt, Artificial Sequence
  Description of Artificial Sequence: Synthetic oligonucleotide
ugaagacuuuggagauca

SEQ ID NO: 136803 - RNA, 18 nt, Artificial Sequence
  Description of Artificial Sequence: Synthetic oligonucleotide
gaaugugaagacuuugga

SEQ ID NO: 136804 - RNA, 18 nt, Artificial Sequence
  Description of Artificial Sequence: Synthetic oligonucleotide
uucuagaaugugaagacu

SEQ ID NO: 136805 - RNA, 18 nt, Artificial Sequence
  Description of Artificial Sequence: Synthetic oligonucleotide
acuaaccucagcaucagc

SEQ ID NO: 136806 - RNA, 18 nt, Artificial Sequence
  Description of Artificial Sequence: Synthetic oligonucleotide
uccagacuaaccucagca

SEQ ID NO: 136807 - RNA, 18 nt, Artificial Sequence
  Description of Artificial Sequence: Synthetic oligonucleotide
uguacuccagacuaaccu

SEQ ID NO: 136808 - RNA, 18 nt, Artificial Sequence
  Description of Artificial Sequence: Synthetic oligonucleotide
cugcauguacuccagacu

SEQ ID NO: 136809 - RNA, 18 nt, Artificial Sequence
  Description of Artificial Sequence: Synthetic oligonucleotide
aggagcugcauguacucc

SEQ ID NO: 136810 - RNA, 18 nt, Artificial Sequence
  Description of Artificial Sequence: Synthetic oligonucleotide
ucagcaggagcugcaugu

SEQ ID NO: 136811 - RNA, 18 nt, Artificial Sequence
  Description of Artificial Sequence: Synthetic oligonucleotide
guccaucagcaggagcug

SEQ ID NO: 136812 - RNA, 18 nt, Artificial Sequence
  Description of Artificial Sequence: Synthetic oligonucleotide
guuuuguccaucagcagg

SEQ ID NO: 136813 - RNA, 18 nt, Artificial Sequence
  Description of Artificial Sequence: Synthetic oligonucleotide
ugaugguuuuguccauca

SEQ ID NO: 136814 - RNA, 18 nt, Artificial Sequence
  Description of Artificial Sequence: Synthetic oligonucleotide
ugccuugaugguuuuguc

SEQ ID NO: 136815 - RNA, 18 nt, Artificial Sequence
  Description of Artificial Sequence: Synthetic oligonucleotide
ccaacugccuugaugguu

SEQ ID NO: 136816 - RNA, 18 nt, Artificial Sequence
  Description of Artificial Sequence: Synthetic oligonucleotide
gggcuccaacugccuuga

SEQ ID NO: 136817 - RNA, 18 nt, Artificial Sequence
  Description of Artificial Sequence: Synthetic oligonucleotide
ugaacaagaggaucuggg

SEQ ID NO: 136818 - RNA, 18 nt, Artificial Sequence
  Description of Artificial Sequence: Synthetic oligonucleotide
uccugaacaagaggaucu

SEQ ID NO: 136819 - RNA, 18 nt, Artificial Sequence
  Description of Artificial Sequence: Synthetic oligonucleotide
gggauuccugaacaagag

SEQ ID NO: 136820 - RNA, 18 nt, Artificial Sequence
  Description of Artificial Sequence: Synthetic oligonucleotide
acaaggagauggccuggg

SEQ ID NO: 136821 - RNA, 18 nt, Artificial Sequence
  Description of Artificial Sequence: Synthetic oligonucleotide
gugacaaggagauggccu

SEQ ID NO: 136822 - RNA, 18 nt, Artificial Sequence
  Description of Artificial Sequence: Synthetic oligonucleotide
ucugggugacaaggagau

SEQ ID NO: 136823 - RNA, 18 nt, Artificial Sequence
  Description of Artificial Sequence: Synthetic oligonucleotide
auuacucugggugacaag

SEQ ID NO: 136824 - RNA, 18 nt, Artificial Sequence
  Description of Artificial Sequence: Synthetic oligonucleotide
aacaaauuacucugggug

SEQ ID NO: 136825 - RNA, 18 nt, Artificial Sequence
  Description of Artificial Sequence: Synthetic oligonucleotide
agcaaaacaaauuacucu

SEQ ID NO: 136826 - RNA, 18 nt, Artificial Sequence
  Description of Artificial Sequence: Synthetic oligonucleotide
aagcaagcaaaacaaauu

SEQ ID NO: 136827 - RNA, 18 nt, Artificial Sequence
  Description of Artificial Sequence: Synthetic oligonucleotide
gaguaaagcaagcaaaac

SEQ ID NO: 136828 - RNA, 18 nt, Artificial Sequence
  Description of Artificial Sequence: Synthetic oligonucleotide
aaagugaguaaagcaagc

SEQ ID NO: 136829 - RNA, 18 nt, Artificial Sequence
  Description of Artificial Sequence: Synthetic oligonucleotide
aaaugaaagugaguaaag

SEQ ID NO: 136830 - RNA, 18 nt, Artificial Sequence
  Description of Artificial Sequence: Synthetic oligonucleotide
uuuccaaaugaaagugag

SEQ ID NO: 136831 - RNA, 18 nt, Artificial Sequence
  Description of Artificial Sequence: Synthetic oligonucleotide
cuuucuuuccaaaugaaa

SEQ ID NO: 136832 - RNA, 18 nt, Artificial Sequence
  Description of Artificial Sequence: Synthetic oligonucleotide
ggucccuuucuuuccaaa

SEQ ID NO: 136833 - RNA, 18 nt, Artificial Sequence
  Description of Artificial Sequence: Synthetic oligonucleotide
aaaagggucccuuucuuu

SEQ ID NO: 136834 - RNA, 18 nt, Artificial Sequence
  Description of Artificial Sequence: Synthetic oligonucleotide
ucuacaaaagggucccuu

SEQ ID NO: 136835 - RNA, 18 nt, Artificial Sequence
  Description of Artificial Sequence: Synthetic oligonucleotide
ucuggucuacaaaagggu

SEQ ID NO: 136836 - RNA, 18 nt, Artificial Sequence
  Description of Artificial Sequence: Synthetic oligonucleotide
caagcucuggucuacaaa

SEQ ID NO: 136837 - RNA, 18 nt, Artificial Sequence
  Description of Artificial Sequence: Synthetic oligonucleotide
auguucaagcucuggucu

SEQ ID NO: 136838 - RNA, 18 nt, Artificial Sequence
  Description of Artificial Sequence: Synthetic oligonucleotide
uaaagauguucaagcucu

SEQ ID NO: 136839 - RNA, 18 nt, Artificial Sequence
  Description of Artificial Sequence: Synthetic oligonucleotide
uagcuuaaagauguucaa

SEQ ID NO: 136840 - RNA, 18 nt, Artificial Sequence
  Description of Artificial Sequence: Synthetic oligonucleotide
cugacuagcuuaaagaug

SEQ ID NO: 136841 - RNA, 18 nt, Artificial Sequence
  Description of Artificial Sequence: Synthetic oligonucleotide
gggaucugacuagcuuaa

SEQ ID NO: 136842 - RNA, 18 nt, Artificial Sequence
  Description of Artificial Sequence: Synthetic oligonucleotide
cuugagcauugaggaggg

SEQ ID NO: 136843 - RNA, 18 nt, Artificial Sequence
  Description of Artificial Sequence: Synthetic oligonucleotide
ucuugagcauugaggagg

SEQ ID NO: 136844 - RNA, 18 nt, Artificial Sequence
  Description of Artificial Sequence: Synthetic oligonucleotide
auuggucuugagcauuga

SEQ ID NO: 136845 - RNA, 18 nt, Artificial Sequence
  Description of Artificial Sequence: Synthetic oligonucleotide
uuaaaauuggucuugagc

SEQ ID NO: 136846 - RNA, 18 nt, Artificial Sequence
  Description of Artificial Sequence: Synthetic oligonucleotide
uggguuuaaaauuggucu

SEQ ID NO: 136847 - RNA, 18 nt, Artificial Sequence
  Description of Artificial Sequence: Synthetic oligonucleotide
ggcuauggguuuaaaauu

SEQ ID NO: 136848 - RNA, 18 nt, Artificial Sequence
  Description of Artificial Sequence: Synthetic oligonucleotide
gacucggcuauggguuua

SEQ ID NO: 136849 - RNA, 18 nt, Artificial Sequence
  Description of Artificial Sequence: Synthetic oligonucleotide
gugaagacucggcuaugg

SEQ ID NO: 136850 - RNA, 18 nt, Artificial Sequence
  Description of Artificial Sequence: Synthetic oligonucleotide
agacagugaagacucggc

SEQ ID NO: 136851 - RNA, 18 nt, Artificial Sequence
  Description of Artificial Sequence: Synthetic oligonucleotide
gcgcaagacagugaagac

SEQ ID NO: 136852 - RNA, 18 nt, Artificial Sequence
  Description of Artificial Sequence: Synthetic oligonucleotide
auccacccaucagcaggg

SEQ ID NO: 136853 - RNA, 18 nt, Artificial Sequence
  Description of Artificial Sequence: Synthetic oligonucleotide
gagugauccacccaucag

SEQ ID NO: 136854 - RNA, 18 nt, Artificial Sequence
  Description of Artificial Sequence: Synthetic oligonucleotide
uauaagagugauccaccc

SEQ ID NO: 136855 - RNA, 18 nt, Artificial Sequence
  Description of Artificial Sequence: Synthetic oligonucleotide
gaggcuauaagagugauc

SEQ ID NO: 136856 - RNA, 18 nt, Artificial Sequence
  Description of Artificial Sequence: Synthetic oligonucleotide
auggagaggcuauaagag

SEQ ID NO: 136857 - RNA, 18 nt, Artificial Sequence
  Description of Artificial Sequence: Synthetic oligonucleotide
acacaauggagaggcuau

SEQ ID NO: 136858 - RNA, 18 nt, Artificial Sequence
  Description of Artificial Sequence: Synthetic oligonucleotide
ccccaacacaauggagag

SEQ ID NO: 136859 - RNA, 18 nt, Artificial Sequence
  Description of Artificial Sequence: Synthetic oligonucleotide
acugcccccaacacaaug

SEQ ID NO: 136860 - RNA, 18 nt, Artificial Sequence
  Description of Artificial Sequence: Synthetic oligonucleotide
ucacaacugcccccaaca

SEQ ID NO: 136861 - RNA, 18 nt, Artificial Sequence
  Description of Artificial Sequence: Synthetic oligonucleotide
acauaucacaacugcccc

SEQ ID NO: 136862 - RNA, 18 nt, Artificial Sequence
  Description of Artificial Sequence: Synthetic oligonucleotide
uuuccacauaucacaacu

SEQ ID NO: 136863 - RNA, 18 nt, Artificial Sequence
  Description of Artificial Sequence: Synthetic oligonucleotide
agaacuuuccacauauca

SEQ ID NO: 136864 - RNA, 18 nt, Artificial Sequence
  Description of Artificial Sequence: Synthetic oligonucleotide
guggaagaacuuuccaca

SEQ ID NO: 136865 - RNA, 18 nt, Artificial Sequence
  Description of Artificial Sequence: Synthetic oligonucleotide
agcugguggaagaacuuu

SEQ ID NO: 136866 - RNA, 18 nt, Artificial Sequence
  Description of Artificial Sequence: Synthetic oligonucleotide
aacucagcugguggaaga

SEQ ID NO: 136867 - RNA, 18 nt, Artificial Sequence
  Description of Artificial Sequence: Synthetic oligonucleotide
ccucuaacucagcuggug

SEQ ID NO: 136868 - RNA, 18 nt, Artificial Sequence
  Description of Artificial Sequence: Synthetic oligonucleotide
gauggccucuaacucagc

SEQ ID NO: 136869 - RNA, 18 nt, Artificial Sequence
  Description of Artificial Sequence: Synthetic oligonucleotide
cagcauguggaaugaggg

SEQ ID NO: 136870 - RNA, 18 nt, Artificial Sequence
  Description of Artificial Sequence: Synthetic oligonucleotide
cacaucagcauguggaau

SEQ ID NO: 136871 - RNA, 18 nt, Artificial Sequence
  Description of Artificial Sequence: Synthetic oligonucleotide
aggcccacaucagcaugu

SEQ ID NO: 136872 - RNA, 18 nt, Artificial Sequence
  Description of Artificial Sequence: Synthetic oligonucleotide
agaacaggcccacaucag

SEQ ID NO: 136873 - RNA, 18 nt, Artificial Sequence
  Description of Artificial Sequence: Synthetic oligonucleotide
uccagagaacaggcccac

SEQ ID NO: 136874 - RNA, 18 nt, Artificial Sequence
  Description of Artificial Sequence: Synthetic oligonucleotide
ggguguccagagaacagg

SEQ ID NO: 136875 - RNA, 18 nt, Artificial Sequence
  Description of Artificial Sequence: Synthetic oligonucleotide
gugggagcaggagguggg

SEQ ID NO: 136876 - RNA, 18 nt, Artificial Sequence
  Description of Artificial Sequence: Synthetic oligonucleotide
gagugggagcaggaggug

SEQ ID NO: 136877 - RNA, 18 nt, Artificial Sequence
  Description of Artificial Sequence: Synthetic oligonucleotide
augaggagugggagcagg

SEQ ID NO: 136878 - RNA, 18 nt, Artificial Sequence
  Description of Artificial Sequence: Synthetic oligonucleotide
gacugaugaggaguggga

SEQ ID NO: 136879 - RNA, 18 nt, Artificial Sequence
  Description of Artificial Sequence: Synthetic oligonucleotide
ucugugacugaugaggag

SEQ ID NO: 136880 - RNA, 18 nt, Artificial Sequence
  Description of Artificial Sequence: Synthetic oligonucleotide
gggugucugugacugaug

SEQ ID NO: 136881 - RNA, 18 nt, Artificial Sequence
  Description of Artificial Sequence: Synthetic oligonucleotide
aacagggauggaguaggg

SEQ ID NO: 136882 - RNA, 18 nt, Artificial Sequence
  Description of Artificial Sequence: Synthetic oligonucleotide
agaacagggauggaguag

SEQ ID NO: 136883 - RNA, 18 nt, Artificial Sequence
  Description of Artificial Sequence: Synthetic oligonucleotide
gagggagaacagggaugg

SEQ ID NO: 136884 - RNA, 18 nt, Artificial Sequence
  Description of Artificial Sequence: Synthetic oligonucleotide
gugaggagggagaacagg

SEQ ID NO: 136885 - RNA, 18 nt, Artificial Sequence
  Description of Artificial Sequence: Synthetic oligonucleotide
gagaggugaggagggaga

SEQ ID NO: 136886 - RNA, 18 nt, Artificial Sequence
  Description of Artificial Sequence: Synthetic oligonucleotide
ucccgcucauucuggacg

SEQ ID NO: 136887 - RNA, 18 nt, Artificial Sequence
  Description of Artificial Sequence: Synthetic oligonucleotide
uccggucccgcucauucu

SEQ ID NO: 136888 - RNA, 18 nt, Artificial Sequence
  Description of Artificial Sequence: Synthetic oligonucleotide
gcugauccggucccgcuc

SEQ ID NO: 136889 - RNA, 18 nt, Artificial Sequence
  Description of Artificial Sequence: Synthetic oligonucleotide
cgagugcugauccggucc

SEQ ID NO: 136890 - RNA, 18 nt, Artificial Sequence
  Description of Artificial Sequence: Synthetic oligonucleotide
accuucgagugcugaucc

SEQ ID NO: 136891 - RNA, 18 nt, Artificial Sequence
  Description of Artificial Sequence: Synthetic oligonucleotide
gcuugaccuucgagugcu

SEQ ID NO: 136892 - RNA, 18 nt, Artificial Sequence
  Description of Artificial Sequence: Synthetic oligonucleotide
ucauagcuugaccuucga

SEQ ID NO: 136893 - RNA, 18 nt, Artificial Sequence
  Description of Artificial Sequence: Synthetic oligonucleotide
uguccucauagcuugacc

SEQ ID NO: 136894 - RNA, 18 nt, Artificial Sequence
  Description of Artificial Sequence: Synthetic oligonucleotide
gcugcuguccucauagcu

SEQ ID NO: 136895 - RNA, 18 nt, Artificial Sequence
  Description of Artificial Sequence: Synthetic oligonucleotide
ggcaggcugcuguccuca

SEQ ID NO: 136896 - RNA, 18 nt, Artificial Sequence
  Description of Artificial Sequence: Synthetic oligonucleotide
uggagggcaggcugcugu

SEQ ID NO: 136897 - RNA, 18 nt, Artificial Sequence
  Description of Artificial Sequence: Synthetic oligonucleotide
auugauggagggcaggcu

SEQ ID NO: 136898 - RNA, 18 nt, Artificial Sequence
  Description of Artificial Sequence: Synthetic oligonucleotide
agcgcauugauggagggc

SEQ ID NO: 136899 - RNA, 18 nt, Artificial Sequence
  Description of Artificial Sequence: Synthetic oligonucleotide
gcaggagcgcauugaugg

SEQ ID NO: 136900 - RNA, 18 nt, Artificial Sequence
  Description of Artificial Sequence: Synthetic oligonucleotide
cgccugcaggagcgcauu

SEQ ID NO: 136901 - RNA, 18 nt, Artificial Sequence
  Description of Artificial Sequence: Synthetic oligonucleotide
accuccgccugcaggagc

SEQ ID NO: 136902 - RNA, 18 nt, Artificial Sequence
  Description of Artificial Sequence: Synthetic oligonucleotide
acaggaccuccgccugca

SEQ ID NO: 136903 - RNA, 18 nt, Artificial Sequence
  Description of Artificial Sequence: Synthetic oligonucleotide
ucgggacaggaccuccgc

SEQ ID NO: 136904 - RNA, 18 nt, Artificial Sequence
  Description of Artificial Sequence: Synthetic oligonucleotide
ucccgcucauucuggacg

SEQ ID NO: 136905 - RNA, 18 nt, Artificial Sequence
  Description of Artificial Sequence: Synthetic oligonucleotide
uccggucccgcucauucu

SEQ ID NO: 136906 - RNA, 18 nt, Artificial Sequence
  Description of Artificial Sequence: Synthetic oligonucleotide
gcugauccggucccgcuc

SEQ ID NO: 136907 - RNA, 18 nt, Artificial Sequence
  Description of Artificial Sequence: Synthetic oligonucleotide
cgagugcugauccggucc

SEQ ID NO: 136908 - RNA, 18 nt, Artificial Sequence
  Description of Artificial Sequence: Synthetic oligonucleotide
accuucgagugcugaucc

SEQ ID NO: 136909 - RNA, 18 nt, Artificial Sequence
  Description of Artificial Sequence: Synthetic oligonucleotide
gcuugaccuucgagugcu

SEQ ID NO: 136910 - RNA, 18 nt, Artificial Sequence
  Description of Artificial Sequence: Synthetic oligonucleotide
ucauagcuugaccuucga

SEQ ID NO: 136911 - RNA, 18 nt, Artificial Sequence
  Description of Artificial Sequence: Synthetic oligonucleotide
uguccucauagcuugacc

SEQ ID NO: 136912 - RNA, 18 nt, Artificial Sequence
  Description of Artificial Sequence: Synthetic oligonucleotide
gcugcuguccucauagcu

SEQ ID NO: 136913 - RNA, 18 nt, Artificial Sequence
  Description of Artificial Sequence: Synthetic oligonucleotide
ggcaggcugcuguccuca

SEQ ID NO: 136914 - RNA, 18 nt, Artificial Sequence
  Description of Artificial Sequence: Synthetic oligonucleotide
uggagggcaggcugcugu

SEQ ID NO: 136915 - RNA, 18 nt, Artificial Sequence
  Description of Artificial Sequence: Synthetic oligonucleotide
auugauggagggcaggcu

SEQ ID NO: 136916 - RNA, 18 nt, Artificial Sequence
  Description of Artificial Sequence: Synthetic oligonucleotide
agcgcauugauggagggc

SEQ ID NO: 136917 - RNA, 18 nt, Artificial Sequence
  Description of Artificial Sequence: Synthetic oligonucleotide
gcaggagcgcauugaugg

SEQ ID NO: 136918 - RNA, 18 nt, Artificial Sequence
  Description of Artificial Sequence: Synthetic oligonucleotide
cgccugcaggagcgcauu

SEQ ID NO: 136919 - RNA, 18 nt, Artificial Sequence
  Description of Artificial Sequence: Synthetic oligonucleotide
accuccgccugcaggagc

SEQ ID NO: 136920 - RNA, 18 nt, Artificial Sequence
  Description of Artificial Sequence: Synthetic oligonucleotide
acaggaccuccgccugca

SEQ ID NO: 136921 - RNA, 18 nt, Artificial Sequence
  Description of Artificial Sequence: Synthetic oligonucleotide
ucgggacaggaccuccgc

SEQ ID NO: 136922 - RNA, 18 nt, Artificial Sequence
  Description of Artificial Sequence: Synthetic oligonucleotide
ggguggcaggaucacccc

SEQ ID NO: 136923 - RNA, 18 nt, Artificial Sequence
  Description of Artificial Sequence: Synthetic oligonucleotide
uggguggguggcaggauc

SEQ ID NO: 136924 - RNA, 18 nt, Artificial Sequence
  Description of Artificial Sequence: Synthetic oligonucleotide
aucccuggguggguggca

SEQ ID NO: 136925 - RNA, 18 nt, Artificial Sequence
  Description of Artificial Sequence: Synthetic oligonucleotide
gggaucccugggugggug

SEQ ID NO: 136926 - RNA, 18 nt, Artificial Sequence
  Description of Artificial Sequence: Synthetic oligonucleotide
gcuccucuguaguguggg

SEQ ID NO: 136927 - RNA, 18 nt, Artificial Sequence
  Description of Artificial Sequence: Synthetic oligonucleotide
ggugagcuccucuguagu

SEQ ID NO: 136928 - RNA, 18 nt, Artificial Sequence
  Description of Artificial Sequence: Synthetic oligonucleotide
gaggaggugagcuccucu

SEQ ID NO: 136929 - RNA, 18 nt, Artificial Sequence
  Description of Artificial Sequence: Synthetic oligonucleotide
agguggaggaggugagcu

SEQ ID NO: 136930 - RNA, 18 nt, Artificial Sequence
  Description of Artificial Sequence: Synthetic oligonucleotide
aauggagguggaggaggu

SEQ ID NO: 136931 - RNA, 18 nt, Artificial Sequence
  Description of Artificial Sequence: Synthetic oligonucleotide
gggagaauggagguggag

SEQ ID NO: 136932 - RNA, 18 nt, Artificial Sequence
  Description of Artificial Sequence: Synthetic oligonucleotide
gcugcuccagggccuggc

SEQ ID NO: 136933 - RNA, 18 nt, Artificial Sequence
  Description of Artificial Sequence: Synthetic oligonucleotide
cgucagcugcuccagggc

SEQ ID NO: 136934 - RNA, 18 nt, Artificial Sequence
  Description of Artificial Sequence: Synthetic oligonucleotide
ccucccgucagcugcucc

SEQ ID NO: 136935 - RNA, 18 nt, Artificial Sequence
  Description of Artificial Sequence: Synthetic oligonucleotide
aggccccucccgucagcu

SEQ ID NO: 136936 - RNA, 18 nt, Artificial Sequence
  Description of Artificial Sequence: Synthetic oligonucleotide
aucugaggccccucccgu

SEQ ID NO: 136937 - RNA, 18 nt, Artificial Sequence
  Description of Artificial Sequence: Synthetic oligonucleotide
guaauaucugaggccccu

SEQ ID NO: 136938 - RNA, 18 nt, Artificial Sequence
  Description of Artificial Sequence: Synthetic oligonucleotide
cuucuguaauaucugagg

SEQ ID NO: 136939 - RNA, 18 nt, Artificial Sequence
  Description of Artificial Sequence: Synthetic oligonucleotide
ugucccuucuguaauauc

SEQ ID NO: 136940 - RNA, 18 nt, Artificial Sequence
  Description of Artificial Sequence: Synthetic oligonucleotide
cucagugucccuucugua

SEQ ID NO: 136941 - RNA, 18 nt, Artificial Sequence
  Description of Artificial Sequence: Synthetic oligonucleotide
ccggacucagugucccuu

SEQ ID NO: 136942 - RNA, 18 nt, Artificial Sequence
  Description of Artificial Sequence: Synthetic oligonucleotide
ugaaaccggacucagugu

SEQ ID NO: 136943 - RNA, 18 nt, Artificial Sequence
  Description of Artificial Sequence: Synthetic oligonucleotide
ccaugugaaaccggacuc

SEQ ID NO: 136944 - RNA, 18 nt, Artificial Sequence
  Description of Artificial Sequence: Synthetic oligonucleotide
cugggccaugugaaaccg

SEQ ID NO: 136945 - RNA, 18 nt, Artificial Sequence
  Description of Artificial Sequence: Synthetic oligonucleotide
gcaaacugggccauguga

SEQ ID NO: 136946 - RNA, 18 nt, Artificial Sequence
  Description of Artificial Sequence: Synthetic oligonucleotide
uugcugcaaacugggcca

SEQ ID NO: 136947 - RNA, 18 nt, Artificial Sequence
  Description of Artificial Sequence: Synthetic oligonucleotide
ugcccuugcugcaaacug

SEQ ID NO: 136948 - RNA, 18 nt, Artificial Sequence
  Description of Artificial Sequence: Synthetic oligonucleotide
auuccugcccuugcugca

SEQ ID NO: 136949 - RNA, 18 nt, Artificial Sequence
  Description of Artificial Sequence: Synthetic oligonucleotide
guucgauuccugcccuug

SEQ ID NO: 136950 - RNA, 18 nt, Artificial Sequence
  Description of Artificial Sequence: Synthetic oligonucleotide
gccagguucgauuccugc

SEQ ID NO: 136951 - RNA, 18 nt, Artificial Sequence
  Description of Artificial Sequence: Synthetic oligonucleotide
agggcgccagguucgauu

SEQ ID NO: 136952 - RNA, 18 nt, Artificial Sequence
  Description of Artificial Sequence: Synthetic oligonucleotide
gccccagggcgccagguu

SEQ ID NO: 136953 - RNA, 18 nt, Artificial Sequence
  Description of Artificial Sequence: Synthetic oligonucleotide
aaagugccccagggcgcc

SEQ ID NO: 136954 - RNA, 18 nt, Artificial Sequence
  Description of Artificial Sequence: Synthetic oligonucleotide
auuagaaagugccccagg

SEQ ID NO: 136955 - RNA, 18 nt, Artificial Sequence
  Description of Artificial Sequence: Synthetic oligonucleotide
gaugaauuagaaagugcc

SEQ ID NO: 136956 - RNA, 18 nt, Artificial Sequence
  Description of Artificial Sequence: Synthetic oligonucleotide
aguaggaugaauuagaaa

SEQ ID NO: 136957 - RNA, 18 nt, Artificial Sequence
  Description of Artificial Sequence: Synthetic oligonucleotide
caggcaguaggaugaauu

SEQ ID NO: 136958 - RNA, 18 nt, Artificial Sequence
  Description of Artificial Sequence: Synthetic oligonucleotide
ggaugcaggcaguaggau

SEQ ID NO: 136959 - RNA, 18 nt, Artificial Sequence
  Description of Artificial Sequence: Synthetic oligonucleotide
cugugggaugcaggcagu

SEQ ID NO: 136960 - RNA, 18 nt, Artificial Sequence
  Description of Artificial Sequence: Synthetic oligonucleotide
uuggccugugggaugcag

SEQ ID NO: 136961 - RNA, 18 nt, Artificial Sequence
  Description of Artificial Sequence: Synthetic oligonucleotide
ucugcuuggccuguggga

SEQ ID NO: 136962 - RNA, 18 nt, Artificial Sequence
  Description of Artificial Sequence: Synthetic oligonucleotide
aagacucugcuuggccug

SEQ ID NO: 136963 - RNA, 18 nt, Artificial Sequence
  Description of Artificial Sequence: Synthetic oligonucleotide
aggugaagacucugcuug

SEQ ID NO: 136964 - RNA, 18 nt, Artificial Sequence
  Description of Artificial Sequence: Synthetic oligonucleotide
agugaaggugaagacucu

SEQ ID NO: 136965 - RNA, 18 nt, Artificial Sequence
  Description of Artificial Sequence: Synthetic oligonucleotide
cccucagugaaggugaag

SEQ ID NO: 136966 - RNA, 18 nt, Artificial Sequence
  Description of Artificial Sequence: Synthetic oligonucleotide
gcaggcccucagugaagg

SEQ ID NO: 136967 - RNA, 18 nt, Artificial Sequence
  Description of Artificial Sequence: Synthetic oligonucleotide
ugaucgcaggcccucagu

SEQ ID NO: 136968 - RNA, 18 nt, Artificial Sequence
  Description of Artificial Sequence: Synthetic oligonucleotide
ugagcugaucgcaggccc

SEQ ID NO: 136969 - RNA, 18 nt, Artificial Sequence
  Description of Artificial Sequence: Synthetic oligonucleotide
ggagcugagcugaucgca

SEQ ID NO: 136970 - RNA, 18 nt, Artificial Sequence
  Description of Artificial Sequence: Synthetic oligonucleotide
cucucggagcugagcuga

SEQ ID NO: 136971 - RNA, 18 nt, Artificial Sequence
  Description of Artificial Sequence: Synthetic oligonucleotide
cuguucucucggagcuga

SEQ ID NO: 136972 - RNA, 18 nt, Artificial Sequence
  Description of Artificial Sequence: Synthetic oligonucleotide
cugcucuguucucucgga

SEQ ID NO: 136973 - RNA, 18 nt, Artificial Sequence
  Description of Artificial Sequence: Synthetic oligonucleotide
agccacugcucuguucuc

SEQ ID NO: 136974 - RNA, 18 nt, Artificial Sequence
  Description of Artificial Sequence: Synthetic oligonucleotide
cacugagccacugcucug

SEQ ID NO: 136975 - RNA, 18 nt, Artificial Sequence
  Description of Artificial Sequence: Synthetic oligonucleotide
cucuccacugagccacug

SEQ ID NO: 136976 - RNA, 18 nt, Artificial Sequence
  Description of Artificial Sequence: Synthetic oligonucleotide
caccucucuccacugagc

SEQ ID NO: 136977 - RNA, 18 nt, Artificial Sequence
  Description of Artificial Sequence: Synthetic oligonucleotide
uuugccaccucucuccac

SEQ ID NO: 136978 - RNA, 18 nt, Artificial Sequence
  Description of Artificial Sequence: Synthetic oligonucleotide
cccacuuugccaccucuc

SEQ ID NO: 136979 - RNA, 18 nt, Artificial Sequence
  Description of Artificial Sequence: Synthetic oligonucleotide
ugggccccacuuugccac

SEQ ID NO: 136980 - RNA, 18 nt, Artificial Sequence
  Description of Artificial Sequence: Synthetic oligonucleotide
agggcugggccccacuuu

SEQ ID NO: 136981 - RNA, 18 nt, Artificial Sequence
  Description of Artificial Sequence: Synthetic oligonucleotide
agggaagggcugggcccc

SEQ ID NO: 136982 - RNA, 18 nt, Artificial Sequence
  Description of Artificial Sequence: Synthetic oligonucleotide
cagcaagggaagggcugg

SEQ ID NO: 136983 - RNA, 18 nt, Artificial Sequence
  Description of Artificial Sequence: Synthetic oligonucleotide
ucacucagcaagggaagg

SEQ ID NO: 136984 - RNA, 18 nt, Artificial Sequence
  Description of Artificial Sequence: Synthetic oligonucleotide
caaggucacucagcaagg

SEQ ID NO: 136985 - RNA, 18 nt, Artificial Sequence
  Description of Artificial Sequence: Synthetic oligonucleotide
uugcccaaggucacucag

SEQ ID NO: 136986 - RNA, 18 nt, Artificial Sequence
  Description of Artificial Sequence: Synthetic oligonucleotide
gugacuugcccaagguca

SEQ ID NO: 136987 - RNA, 18 nt, Artificial Sequence
  Description of Artificial Sequence: Synthetic oligonucleotide
gugcugugacuugcccaa

SEQ ID NO: 136988 - RNA, 18 nt, Artificial Sequence
  Description of Artificial Sequence: Synthetic oligonucleotide
gagaggugcugugacuug

SEQ ID NO: 136989 - RNA, 18 nt, Artificial Sequence
  Description of Artificial Sequence: Synthetic oligonucleotide
gcucagagaggugcugug

SEQ ID NO: 136990 - RNA, 18 nt, Artificial Sequence
  Description of Artificial Sequence: Synthetic oligonucleotide
gaagggcugggccccacu

SEQ ID NO: 136991 - RNA, 18 nt, Artificial Sequence
  Description of Artificial Sequence: Synthetic oligonucleotide
caagggaagggcugggcc

SEQ ID NO: 136992 - RNA, 18 nt, Artificial Sequence
  Description of Artificial Sequence: Synthetic oligonucleotide
cucagcaagggaagggcu

SEQ ID NO: 136993 - RNA, 18 nt, Artificial Sequence
  Description of Artificial Sequence: Synthetic oligonucleotide
ggucacucagcaagggaa

SEQ ID NO: 136994 - RNA, 18 nt, Artificial Sequence
  Description of Artificial Sequence: Synthetic oligonucleotide
cccaaggucacucagcaa

SEQ ID NO: 136995 - RNA, 18 nt, Artificial Sequence
  Description of Artificial Sequence: Synthetic oligonucleotide
acuugcccaaggucacuc

SEQ ID NO: 136996 - RNA, 18 nt, Artificial Sequence
  Description of Artificial Sequence: Synthetic oligonucleotide
cugugacuugcccaaggu

SEQ ID NO: 136997 - RNA, 18 nt, Artificial Sequence
  Description of Artificial Sequence: Synthetic oligonucleotide
aggugcugugacuugccc

SEQ ID NO: 136998 - RNA, 18 nt, Artificial Sequence
  Description of Artificial Sequence: Synthetic oligonucleotide
cagagaggugcugugacu

SEQ ID NO: 136999 - RNA, 18 nt, Artificial Sequence
  Description of Artificial Sequence: Synthetic oligonucleotide
uggcucagagaggugcug

SEQ ID NO: 137000 - RNA, 18 nt, Artificial Sequence
  Description of Artificial Sequence: Synthetic oligonucleotide
aaccauggcucagagagg

SEQ ID NO: 137001 - RNA, 18 nt, Artificial Sequence
  Description of Artificial Sequence: Synthetic oligonucleotide
gaggcaaccauggcucag

SEQ ID NO: 137002 - RNA, 18 nt, Artificial Sequence
  Description of Artificial Sequence: Synthetic oligonucleotide
acaaugaggcaaccaugg

SEQ ID NO: 137003 - RNA, 18 nt, Artificial Sequence
  Description of Artificial Sequence: Synthetic oligonucleotide
uucugacaaugaggcaac

SEQ ID NO: 137004 - RNA, 18 nt, Artificial Sequence
  Description of Artificial Sequence: Synthetic oligonucleotide
uccuuuucugacaaugag

SEQ ID NO: 137005 - RNA, 18 nt, Artificial Sequence
  Description of Artificial Sequence: Synthetic oligonucleotide
caucauccuuuucugaca

SEQ ID NO: 137006 - RNA, 18 nt, Artificial Sequence
  Description of Artificial Sequence: Synthetic oligonucleotide
aaaaucaucauccuuuuc

SEQ ID NO: 137007 - RNA, 18 nt, Artificial Sequence
  Description of Artificial Sequence: Synthetic oligonucleotide
ggcaaaaaaucaucaucc

SEQ ID NO: 137008 - RNA, 18 nt, Artificial Sequence
  Description of Artificial Sequence: Synthetic oligonucleotide
agcagggcaaaaaaucau

SEQ ID NO: 137009 - RNA, 18 nt, Artificial Sequence
  Description of Artificial Sequence: Synthetic oligonucleotide
ggagaagcagggcaaaaa

SEQ ID NO: 137010 - RNA, 18 nt, Artificial Sequence
  Description of Artificial Sequence: Synthetic oligonucleotide
uuagaggagaagcagggc

SEQ ID NO: 137011 - RNA, 18 nt, Artificial Sequence
  Description of Artificial Sequence: Synthetic oligonucleotide
cagccuuagaggagaagc

SEQ ID NO: 137012 - RNA, 18 nt, Artificial Sequence
  Description of Artificial Sequence: Synthetic oligonucleotide
ucugucagccuuagagga

SEQ ID NO: 137013 - RNA, 18 nt, Artificial Sequence
  Description of Artificial Sequence: Synthetic oligonucleotide
aggagucugucagccuua

SEQ ID NO: 137014 - RNA, 18 nt, Artificial Sequence
  Description of Artificial Sequence: Synthetic oligonucleotide
ccccaaggagucugucag

SEQ ID NO: 137015 - RNA, 18 nt, Artificial Sequence
  Description of Artificial Sequence: Synthetic oligonucleotide
uagagccccaaggagucu

SEQ ID NO: 137016 - RNA, 18 nt, Artificial Sequence
  Description of Artificial Sequence: Synthetic oligonucleotide
agcuuuagagccccaagg

SEQ ID NO: 137017 - RNA, 18 nt, Artificial Sequence
  Description of Artificial Sequence: Synthetic oligonucleotide
cugucagcuuuagagccc

SEQ ID NO: 137018 - RNA, 18 nt, Artificial Sequence
  Description of Artificial Sequence: Synthetic oligonucleotide
cuccucugucagcuuuag

SEQ ID NO: 137019 - RNA, 18 nt, Artificial Sequence
  Description of Artificial Sequence: Synthetic oligonucleotide
gcccccuccucugucagc

SEQ ID NO: 137020 - RNA, 18 nt, Artificial Sequence
  Description of Artificial Sequence: Synthetic oligonucleotide
ccccugcccccuccucug

SEQ ID NO: 137021 - RNA, 18 nt, Artificial Sequence
  Description of Artificial Sequence: Synthetic oligonucleotide
ccugcccccugcccccuc

SEQ ID NO: 137022 - RNA, 18 nt, Artificial Sequence
  Description of Artificial Sequence: Synthetic oligonucleotide
uguuaccugcccccugcc

SEQ ID NO: 137023 - RNA, 18 nt, Artificial Sequence
  Description of Artificial Sequence: Synthetic oligonucleotide
ucaccuguuaccugcccc

SEQ ID NO: 137024 - RNA, 18 nt, Artificial Sequence
  Description of Artificial Sequence: Synthetic oligonucleotide
ugccuucaccuguuaccu

SEQ ID NO: 137025 - RNA, 18 nt, Artificial Sequence
  Description of Artificial Sequence: Synthetic oligonucleotide
cucugugccuucaccugu

SEQ ID NO: 137026 - RNA, 18 nt, Artificial Sequence
  Description of Artificial Sequence: Synthetic oligonucleotide
gcucccucugugccuuca

SEQ ID NO: 137027 - RNA, 18 nt, Artificial Sequence
  Description of Artificial Sequence: Synthetic oligonucleotide
gaagggcucccucugugc

SEQ ID NO: 137028 - RNA, 18 nt, Artificial Sequence
  Description of Artificial Sequence: Synthetic oligonucleotide
agggagaagggcucccuc

SEQ ID NO: 137029 - RNA, 18 nt, Artificial Sequence
  Description of Artificial Sequence: Synthetic oligonucleotide
ggaugagggagaagggcu

SEQ ID NO: 137030 - RNA, 18 nt, Artificial Sequence
  Description of Artificial Sequence: Synthetic oligonucleotide
ggcagggaugagggagaa

SEQ ID NO: 137031 - RNA, 18 nt, Artificial Sequence
  Description of Artificial Sequence: Synthetic oligonucleotide
gaggaggcagggaugagg

SEQ ID NO: 137032 - RNA, 18 nt, Artificial Sequence
  Description of Artificial Sequence: Synthetic oligonucleotide
ggagggaggaggcaggga

SEQ ID NO: 137033 - RNA, 18 nt, Artificial Sequence
  Description of Artificial Sequence: Synthetic oligonucleotide
cggagggagggaggaggc

SEQ ID NO: 137034 - RNA, 18 nt, Artificial Sequence
  Description of Artificial Sequence: Synthetic oligonucleotide
aaaaacggagggagggag

SEQ ID NO: 137035 - RNA, 18 nt, Artificial Sequence
  Description of Artificial Sequence: Synthetic oligonucleotide
aggguaaaaacggaggga

SEQ ID NO: 137036 - RNA, 18 nt, Artificial Sequence
  Description of Artificial Sequence: Synthetic oligonucleotide
agcucaggguaaaaacgg

SEQ ID NO: 137037 - RNA, 18 nt, Artificial Sequence
  Description of Artificial Sequence: Synthetic oligonucleotide
aaggaagcucaggguaaa

SEQ ID NO: 137038 - RNA, 18 nt, Artificial Sequence
  Description of Artificial Sequence: Synthetic oligonucleotide
cucugaaggaagcucagg

SEQ ID NO: 137039 - RNA, 18 nt, Artificial Sequence
  Description of Artificial Sequence: Synthetic oligonucleotide
uccagcucugaaggaagc

SEQ ID NO: 137040 - RNA, 18 nt, Artificial Sequence
  Description of Artificial Sequence: Synthetic oligonucleotide
ugcccuccagcucugaag

SEQ ID NO: 137041 - RNA, 18 nt, Artificial Sequence
  Description of Artificial Sequence: Synthetic oligonucleotide
gugggugcccuccagcuc

SEQ ID NO: 137042 - RNA, 18 nt, Artificial Sequence
  Description of Artificial Sequence: Synthetic oligonucleotide
ggauagugggugcccucc

SEQ ID NO: 137043 - RNA, 18 nt, Artificial Sequence
  Description of Artificial Sequence: Synthetic oligonucleotide
gggcuggauagugggugc

SEQ ID NO: 137044 - RNA, 18 nt, Artificial Sequence
  Description of Artificial Sequence: Synthetic oligonucleotide
ccuggaaucagauguggg

SEQ ID NO: 137045 - RNA, 18 nt, Artificial Sequence
  Description of Artificial Sequence: Synthetic oligonucleotide
ccucccuggaaucagaug

SEQ ID NO: 137046 - RNA, 18 nt, Artificial Sequence
  Description of Artificial Sequence: Synthetic oligonucleotide
agcccccucccuggaauc

SEQ ID NO: 137047 - RNA, 18 nt, Artificial Sequence
  Description of Artificial Sequence: Synthetic oligonucleotide
cacagagcccccucccug

SEQ ID NO: 137048 - RNA, 18 nt, Artificial Sequence
  Description of Artificial Sequence: Synthetic oligonucleotide
cccugcacagagcccccu

SEQ ID NO: 137049 - RNA, 18 nt, Artificial Sequence
  Description of Artificial Sequence: Synthetic oligonucleotide
cuguccccugcacagagc

SEQ ID NO: 137050 - RNA, 18 nt, Artificial Sequence
  Description of Artificial Sequence: Synthetic oligonucleotide
acucucuguccccugcac

SEQ ID NO: 137051 - RNA, 18 nt, Artificial Sequence
  Description of Artificial Sequence: Synthetic oligonucleotide
cccgcacucucugucccc

SEQ ID NO: 137052 - RNA, 18 nt, Artificial Sequence
  Description of Artificial Sequence: Synthetic oligonucleotide
gcccucccgcacucucug

SEQ ID NO: 137053 - RNA, 18 nt, Artificial Sequence
  Description of Artificial Sequence: Synthetic oligonucleotide
uccgggcccucccgcacu

SEQ ID NO: 137054 - RNA, 18 nt, Artificial Sequence
  Description of Artificial Sequence: Synthetic oligonucleotide
agauguccgggcccuccc

SEQ ID NO: 137055 - RNA, 18 nt, Artificial Sequence
  Description of Artificial Sequence: Synthetic oligonucleotide
gcuggagauguccgggcc

SEQ ID NO: 137056 - RNA, 18 nt, Artificial Sequence
  Description of Artificial Sequence: Synthetic oligonucleotide
aaaaugcuggagaugucc

SEQ ID NO: 137057 - RNA, 18 nt, Artificial Sequence
  Description of Artificial Sequence: Synthetic oligonucleotide
ggaagaaaaugcuggaga

SEQ ID NO: 137058 - RNA, 18 nt, Artificial Sequence
  Description of Artificial Sequence: Synthetic oligonucleotide
ccguugaucccggagacg

SEQ ID NO: 137059 - RNA, 18 nt, Artificial Sequence
  Description of Artificial Sequence: Synthetic oligonucleotide
ugucgccguugaucccgg

SEQ ID NO: 137060 - RNA, 18 nt, Artificial Sequence
  Description of Artificial Sequence: Synthetic oligonucleotide
ccgaaugucgccguugau

SEQ ID NO: 137061 - RNA, 18 nt, Artificial Sequence
  Description of Artificial Sequence: Synthetic oligonucleotide
uucgcccgaaugucgccg

SEQ ID NO: 137062 - RNA, 18 nt, Artificial Sequence
  Description of Artificial Sequence: Synthetic oligonucleotide
ucuucuucgcccgaaugu

SEQ ID NO: 137063 - RNA, 18 nt, Artificial Sequence
  Description of Artificial Sequence: Synthetic oligonucleotide
ggcaaucuucuucgcccg

SEQ ID NO: 137064 - RNA, 18 nt, Artificial Sequence
  Description of Artificial Sequence: Synthetic oligonucleotide
augcuggcaaucuucuuc

SEQ ID NO: 137065 - RNA, 18 nt, Artificial Sequence
  Description of Artificial Sequence: Synthetic oligonucleotide
cugcgaugcuggcaaucu

SEQ ID NO: 137066 - RNA, 18 nt, Artificial Sequence
  Description of Artificial Sequence: Synthetic oligonucleotide
cacaucugcgaugcuggc

SEQ ID NO: 137067 - RNA, 18 nt, Artificial Sequence
  Description of Artificial Sequence: Synthetic oligonucleotide
ucacacacaucugcgaug

SEQ ID NO: 137068 - RNA, 18 nt, Artificial Sequence
  Description of Artificial Sequence: Synthetic oligonucleotide
uggacucacacacaucug

SEQ ID NO: 137069 - RNA, 18 nt, Artificial Sequence
  Description of Artificial Sequence: Synthetic oligonucleotide
cuucauggacucacacac

SEQ ID NO: 137070 - RNA, 18 nt, Artificial Sequence
  Description of Artificial Sequence: Synthetic oligonucleotide
ugcuccuucauggacuca

SEQ ID NO: 137071 - RNA, 18 nt, Artificial Sequence
  Description of Artificial Sequence: Synthetic oligonucleotide
gcagcugcuccuucaugg

SEQ ID NO: 137072 - RNA, 18 nt, Artificial Sequence
  Description of Artificial Sequence: Synthetic oligonucleotide
aaccagcagcugcuccuu

SEQ ID NO: 137073 - RNA, 18 nt, Artificial Sequence
  Description of Artificial Sequence: Synthetic oligonucleotide
acgagaaccagcagcugc

SEQ ID NO: 137074 - RNA, 18 nt, Artificial Sequence
  Description of Artificial Sequence: Synthetic oligonucleotide
acucaacgagaaccagca

SEQ ID NO: 137075 - RNA, 18 nt, Artificial Sequence
  Description of Artificial Sequence: Synthetic oligonucleotide
ggcccacucaacgagaac

SEQ ID NO: 137076 - RNA, 18 nt, Artificial Sequence
  Description of Artificial Sequence: Synthetic oligonucleotide
uacuuggcccacucaacg

SEQ ID NO: 137077 - RNA, 18 nt, Artificial Sequence
  Description of Artificial Sequence: Synthetic oligonucleotide
ggauguacuuggcccacu

SEQ ID NO: 137078 - RNA, 18 nt, Artificial Sequence
  Description of Artificial Sequence: Synthetic oligonucleotide
agcugggauguacuuggc

SEQ ID NO: 137079 - RNA, 18 nt, Artificial Sequence
  Description of Artificial Sequence: Synthetic oligonucleotide
cagaaagcugggauguac

SEQ ID NO: 137080 - RNA, 18 nt, Artificial Sequence
  Description of Artificial Sequence: Synthetic oligonucleotide
gcucgcagaaagcuggga

SEQ ID NO: 137081 - RNA, 18 nt, Artificial Sequence
  Description of Artificial Sequence: Synthetic oligonucleotide
gggagcucgcagaaagcu

SEQ ID NO: 137082 - RNA, 18 nt, Artificial Sequence
  Description of Artificial Sequence: Synthetic oligonucleotide
guugaucccggagacggg

SEQ ID NO: 137083 - RNA, 18 nt, Artificial Sequence
  Description of Artificial Sequence: Synthetic oligonucleotide
cguugaucccggagacgg

SEQ ID NO: 137084 - RNA, 18 nt, Artificial Sequence
  Description of Artificial Sequence: Synthetic oligonucleotide
gucgccguugaucccgga

SEQ ID NO: 137085 - RNA, 18 nt, Artificial Sequence
  Description of Artificial Sequence: Synthetic oligonucleotide
cgaaugucgccguugauc

SEQ ID NO: 137086 - RNA, 18 nt, Artificial Sequence
  Description of Artificial Sequence: Synthetic oligonucleotide
ucgcccgaaugucgccgu

SEQ ID NO: 137087 - RNA, 18 nt, Artificial Sequence
  Description of Artificial Sequence: Synthetic oligonucleotide
cuucuucgcccgaauguc

SEQ ID NO: 137088 - RNA, 18 nt, Artificial Sequence
  Description of Artificial Sequence: Synthetic oligonucleotide
gcaaucuucuucgcccga

SEQ ID NO: 137089 - RNA, 18 nt, Artificial Sequence
  Description of Artificial Sequence: Synthetic oligonucleotide
ugcuggcaaucuucuucg

SEQ ID NO: 137090 - RNA, 18 nt, Artificial Sequence
  Description of Artificial Sequence: Synthetic oligonucleotide
ugcgaugcuggcaaucuu

SEQ ID NO: 137091 - RNA, 18 nt, Artificial Sequence
  Description of Artificial Sequence: Synthetic oligonucleotide
acaucugcgaugcuggca

SEQ ID NO: 137092 - RNA, 18 nt, Artificial Sequence
  Description of Artificial Sequence: Synthetic oligonucleotide
cacacacaucugcgaugc

SEQ ID NO: 137093 - RNA, 18 nt, Artificial Sequence
  Description of Artificial Sequence: Synthetic oligonucleotide
ggacucacacacaucugc

SEQ ID NO: 137094 - RNA, 18 nt, Artificial Sequence
  Description of Artificial Sequence: Synthetic oligonucleotide
uucauggacucacacaca

SEQ ID NO: 137095 - RNA, 18 nt, Artificial Sequence
  Description of Artificial Sequence: Synthetic oligonucleotide
gcuccuucauggacucac

SEQ ID NO: 137096 - RNA, 18 nt, Artificial Sequence
  Description of Artificial Sequence: Synthetic oligonucleotide
cagcugcuccuucaugga

SEQ ID NO: 137097 - RNA, 18 nt, Artificial Sequence
  Description of Artificial Sequence: Synthetic oligonucleotide
accagcagcugcuccuuc

SEQ ID NO: 137098 - RNA, 18 nt, Artificial Sequence
  Description of Artificial Sequence: Synthetic oligonucleotide
cgagaaccagcagcugcu

SEQ ID NO: 137099 - RNA, 18 nt, Artificial Sequence
  Description of Artificial Sequence: Synthetic oligonucleotide
cucaacgagaaccagcag

SEQ ID NO: 137100 - RNA, 18 nt, Artificial Sequence
  Description of Artificial Sequence: Synthetic oligonucleotide
gcccacucaacgagaacc

SEQ ID NO: 137101 - RNA, 18 nt, Artificial Sequence
  Description of Artificial Sequence: Synthetic oligonucleotide
acuuggcccacucaacga

SEQ ID NO: 137102 - RNA, 18 nt, Artificial Sequence
  Description of Artificial Sequence: Synthetic oligonucleotide
gauguacuuggcccacuc

SEQ ID NO: 137103 - RNA, 18 nt, Artificial Sequence
  Description of Artificial Sequence: Synthetic oligonucleotide
gcugggauguacuuggcc

SEQ ID NO: 137104 - RNA, 18 nt, Artificial Sequence
  Description of Artificial Sequence: Synthetic oligonucleotide
agaaagcugggauguacu

SEQ ID NO: 137105 - RNA, 18 nt, Artificial Sequence
  Description of Artificial Sequence: Synthetic oligonucleotide
cucgcagaaagcugggau

SEQ ID NO: 137106 - RNA, 18 nt, Artificial Sequence
  Description of Artificial Sequence: Synthetic oligonucleotide
gggagcucgcagaaagcu

SEQ ID NO: 137107 - RNA, 18 nt, Artificial Sequence
  Description of Artificial Sequence: Synthetic oligonucleotide
ccaccauccacgcccauc

SEQ ID NO: 137108 - RNA, 18 nt, Artificial Sequence
  Description of Artificial Sequence: Synthetic oligonucleotide
acugcccaccauccacgc

SEQ ID NO: 137109 - RNA, 18 nt, Artificial Sequence
  Description of Artificial Sequence: Synthetic oligonucleotide
ccacuacugcccaccauc

SEQ ID NO: 137110 - RNA, 18 nt, Artificial Sequence
  Description of Artificial Sequence: Synthetic oligonucleotide
acugcccacuacugccca

SEQ ID NO: 137111 - RNA, 18 nt, Artificial Sequence
  Description of Artificial Sequence: Synthetic oligonucleotide
cgcccacugcccacuacu

SEQ ID NO: 137112 - RNA, 18 nt, Artificial Sequence
  Description of Artificial Sequence: Synthetic oligonucleotide
ugccccgcccacugccca

SEQ ID NO: 137113 - RNA, 18 nt, Artificial Sequence
  Description of Artificial Sequence: Synthetic oligonucleotide
cuggcugccccgcccacu

SEQ ID NO: 137114 - RNA, 18 nt, Artificial Sequence
  Description of Artificial Sequence: Synthetic oligonucleotide
gcccccuggcugccccgc

SEQ ID NO: 137115 - RNA, 18 nt, Artificial Sequence
  Description of Artificial Sequence: Synthetic oligonucleotide
cagcagcccccuggcugc

SEQ ID NO: 137116 - RNA, 18 nt, Artificial Sequence
  Description of Artificial Sequence: Synthetic oligonucleotide
ugggccagcagcccccug

SEQ ID NO: 137117 - RNA, 18 nt, Artificial Sequence
  Description of Artificial Sequence: Synthetic oligonucleotide
ccaggugggccagcagcc

SEQ ID NO: 137118 - RNA, 18 nt, Artificial Sequence
  Description of Artificial Sequence: Synthetic oligonucleotide
auaucccaggugggccag

SEQ ID NO: 137119 - RNA, 18 nt, Artificial Sequence
  Description of Artificial Sequence: Synthetic oligonucleotide
cggcuauaucccaggugg

SEQ ID NO: 137120 - RNA, 18 nt, Artificial Sequence
  Description of Artificial Sequence: Synthetic oligonucleotide
guccacggcuauauccca

SEQ ID NO: 137121 - RNA, 18 nt, Artificial Sequence
  Description of Artificial Sequence: Synthetic oligonucleotide
agccaguccacggcuaua

SEQ ID NO: 137122 - RNA, 18 nt, Artificial Sequence
  Description of Artificial Sequence: Synthetic oligonucleotide
aaucaagccaguccacgg

SEQ ID NO: 137123 - RNA, 18 nt, Artificial Sequence
  Description of Artificial Sequence: Synthetic oligonucleotide
aauaaaaucaagccaguc

SEQ ID NO: 137124 - RNA, 18 nt, Artificial Sequence
  Description of Artificial Sequence: Synthetic oligonucleotide
aauaaaauaaaaucaagc

SEQ ID NO: 137125 - RNA, 18 nt, Artificial Sequence
  Description of Artificial Sequence: Synthetic oligonucleotide
uguuaaauaaaauaaaau

SEQ ID NO: 137126 - RNA, 18 nt, Artificial Sequence
  Description of Artificial Sequence: Synthetic oligonucleotide
uauuuuguuaaauaaaau

SEQ ID NO: 137127 - RNA, 18 nt, Artificial Sequence
  Description of Artificial Sequence: Synthetic oligonucleotide
cuacauauuuuguuaaau

SEQ ID NO: 137128 - RNA, 18 nt, Artificial Sequence
  Description of Artificial Sequence: Synthetic oligonucleotide
gugcacuacauauuuugu

SEQ ID NO: 137129 - RNA, 18 nt, Artificial Sequence
  Description of Artificial Sequence: Synthetic oligonucleotide
cgugugugcacuacauau

SEQ ID NO: 137130 - RNA, 18 nt, Artificial Sequence
  Description of Artificial Sequence: Synthetic oligonucleotide
agacacgugugugcacua

SEQ ID NO: 137131 - RNA, 18 nt, Artificial Sequence
  Description of Artificial Sequence: Synthetic oligonucleotide
guuucagacacgugugug

SEQ ID NO: 137132 - RNA, 18 nt, Artificial Sequence
  Description of Artificial Sequence: Synthetic oligonucleotide
uuaaaguuucagacacgu

SEQ ID NO: 137133 - RNA, 18 nt, Artificial Sequence
  Description of Artificial Sequence: Synthetic oligonucleotide
gugauuuaaaguuucaga

SEQ ID NO: 137134 - RNA, 18 nt, Artificial Sequence
  Description of Artificial Sequence: Synthetic oligonucleotide
guaaggugauuuaaaguu

SEQ ID NO: 137135 - RNA, 18 nt, Artificial Sequence
  Description of Artificial Sequence: Synthetic oligonucleotide
uauuuguaaggugauuua

SEQ ID NO: 137136 - RNA, 18 nt, Artificial Sequence
  Description of Artificial Sequence: Synthetic oligonucleotide
guuaauauuuguaaggug

SEQ ID NO: 137137 - RNA, 18 nt, Artificial Sequence
  Description of Artificial Sequence: Synthetic oligonucleotide
acugaguuaauauuugua

SEQ ID NO: 137138 - RNA, 18 nt, Artificial Sequence
  Description of Artificial Sequence: Synthetic oligonucleotide
agcuaacugaguuaauau

SEQ ID NO: 137139 - RNA, 18 nt, Artificial Sequence
  Description of Artificial Sequence: Synthetic oligonucleotide
ggaggagcuaacugaguu

SEQ ID NO: 137140 - RNA, 18 nt, Artificial Sequence
  Description of Artificial Sequence: Synthetic oligonucleotide
uuguuggaggagcuaacu

SEQ ID NO: 137141 - RNA, 18 nt, Artificial Sequence
  Description of Artificial Sequence: Synthetic oligonucleotide
uagaguuguuggaggagc

SEQ ID NO: 137142 - RNA, 18 nt, Artificial Sequence
  Description of Artificial Sequence: Synthetic oligonucleotide
ccucauagaguuguugga

SEQ ID NO: 137143 - RNA, 18 nt, Artificial Sequence
  Description of Artificial Sequence: Synthetic oligonucleotide
accuaccucauagaguug

SEQ ID NO: 137144 - RNA, 18 nt, Artificial Sequence
  Description of Artificial Sequence: Synthetic oligonucleotide
uuaguaccuaccucauag

SEQ ID NO: 137145 - RNA, 18 nt, Artificial Sequence
  Description of Artificial Sequence: Synthetic oligonucleotide
guaccuuaguaccuaccu

SEQ ID NO: 137146 - RNA, 18 nt, Artificial Sequence
  Description of Artificial Sequence: Synthetic oligonucleotide
uaauaguaccuuaguacc

SEQ ID NO: 137147 - RNA, 18 nt, Artificial Sequence
  Description of Artificial Sequence: Synthetic oligonucleotide
aguaauaauaguaccuua

SEQ ID NO: 137148 - RNA, 18 nt, Artificial Sequence
  Description of Artificial Sequence: Synthetic oligonucleotide
auggcaguaauaauagua

SEQ ID NO: 137149 - RNA, 18 nt, Artificial Sequence
  Description of Artificial Sequence: Synthetic oligonucleotide
augagauggcaguaauaa

SEQ ID NO: 137150 - RNA, 18 nt, Artificial Sequence
  Description of Artificial Sequence: Synthetic oligonucleotide
caccuaugagauggcagu

SEQ ID NO: 137151 - RNA, 18 nt, Artificial Sequence
  Description of Artificial Sequence: Synthetic oligonucleotide
cuccucaccuaugagaug

SEQ ID NO: 137152 - RNA, 18 nt, Artificial Sequence
  Description of Artificial Sequence: Synthetic oligonucleotide
ccaaucuccucaccuaug

SEQ ID NO: 137153 - RNA, 18 nt, Artificial Sequence
  Description of Artificial Sequence: Synthetic oligonucleotide
gugccccaaucuccucac

SEQ ID NO: 137154 - RNA, 18 nt, Artificial Sequence
  Description of Artificial Sequence: Synthetic oligonucleotide
ucucugugccccaaucuc

SEQ ID NO: 137155 - RNA, 18 nt, Artificial Sequence
  Description of Artificial Sequence: Synthetic oligonucleotide
uaaccucucugugcccca

SEQ ID NO: 137156 - RNA, 18 nt, Artificial Sequence
  Description of Artificial Sequence: Synthetic oligonucleotide
uuacuuaaccucucugug

SEQ ID NO: 137157 - RNA, 18 nt, Artificial Sequence
  Description of Artificial Sequence: Synthetic oligonucleotide
gcagguuacuuaaccucu

SEQ ID NO: 137158 - RNA, 18 nt, Artificial Sequence
  Description of Artificial Sequence: Synthetic oligonucleotide
cuugagcagguuacuuaa

SEQ ID NO: 137159 - RNA, 18 nt, Artificial Sequence
  Description of Artificial Sequence: Synthetic oligonucleotide
gugaccuugagcagguua

SEQ ID NO: 137160 - RNA, 18 nt, Artificial Sequence
  Description of Artificial Sequence: Synthetic oligonucleotide
gcuaugugaccuugagca

SEQ ID NO: 137161 - RNA, 18 nt, Artificial Sequence
  Description of Artificial Sequence: Synthetic oligonucleotide
uaguagcuaugugaccuu

SEQ ID NO: 137162 - RNA, 18 nt, Artificial Sequence
  Description of Artificial Sequence: Synthetic oligonucleotide
cuggauaguagcuaugug

SEQ ID NO: 137163 - RNA, 18 nt, Artificial Sequence
  Description of Artificial Sequence: Synthetic oligonucleotide
cuaugcuggauaguagcu

SEQ ID NO: 137164 - RNA, 18 nt, Artificial Sequence
  Description of Artificial Sequence: Synthetic oligonucleotide
cccagcuaugcuggauag

SEQ ID NO: 137165 - RNA, 18 nt, Artificial Sequence
  Description of Artificial Sequence: Synthetic oligonucleotide
cuaaucccagcuaugcug

SEQ ID NO: 137166 - RNA, 18 nt, Artificial Sequence
  Description of Artificial Sequence: Synthetic oligonucleotide
agguucuaaucccagcua

SEQ ID NO: 137167 - RNA, 18 nt, Artificial Sequence
  Description of Artificial Sequence: Synthetic oligonucleotide
cugccagguucuaauccc

SEQ ID NO: 137168 - RNA, 18 nt, Artificial Sequence
  Description of Artificial Sequence: Synthetic oligonucleotide
gcuuccugccagguucua

SEQ ID NO: 137169 - RNA, 18 nt, Artificial Sequence
  Description of Artificial Sequence: Synthetic oligonucleotide
uuggagcuuccugccagg

SEQ ID NO: 137170 - RNA, 18 nt, Artificial Sequence
  Description of Artificial Sequence: Synthetic oligonucleotide
ggacuuuggagcuuccug

SEQ ID NO: 137171 - RNA, 18 nt, Artificial Sequence
  Description of Artificial Sequence: Synthetic oligonucleotide
agcuuggacuuuggagcu

SEQ ID NO: 137172 - RNA, 18 nt, Artificial Sequence
  Description of Artificial Sequence: Synthetic oligonucleotide
ucaggagcuuggacuuug

SEQ ID NO: 137173 - RNA, 18 nt, Artificial Sequence
  Description of Artificial Sequence: Synthetic oligonucleotide
aauggucaggagcuugga

SEQ ID NO: 137174 - RNA, 18 nt, Artificial Sequence
  Description of Artificial Sequence: Synthetic oligonucleotide
gguacaauggucaggagc

SEQ ID NO: 137175 - RNA, 18 nt, Artificial Sequence
  Description of Artificial Sequence: Synthetic oligonucleotide
ccucagguacaaugguca

SEQ ID NO: 137176 - RNA, 18 nt, Artificial Sequence
  Description of Artificial Sequence: Synthetic oligonucleotide
gagagccucagguacaau

SEQ ID NO: 137177 - RNA, 18 nt, Artificial Sequence
  Description of Artificial Sequence: Synthetic oligonucleotide
ccugggagagccucaggu

SEQ ID NO: 137178 - RNA, 18 nt, Artificial Sequence
  Description of Artificial Sequence: Synthetic oligonucleotide
aucccccugggagagccu

SEQ ID NO: 137179 - RNA, 18 nt, Artificial Sequence
  Description of Artificial Sequence: Synthetic oligonucleotide
ucaacaucccccugggag

SEQ ID NO: 137180 - RNA, 18 nt, Artificial Sequence
  Description of Artificial Sequence: Synthetic oligonucleotide
cccugucaacaucccccu

SEQ ID NO: 137181 - RNA, 18 nt, Artificial Sequence
  Description of Artificial Sequence: Synthetic oligonucleotide
agggucccugucaacauc

SEQ ID NO: 137182 - RNA, 18 nt, Artificial Sequence
  Description of Artificial Sequence: Synthetic oligonucleotide
guccuagggucccuguca

SEQ ID NO: 137183 - RNA, 18 nt, Artificial Sequence
  Description of Artificial Sequence: Synthetic oligonucleotide
ucccuguccuaggguccc

SEQ ID NO: 137184 - RNA, 18 nt, Artificial Sequence
  Description of Artificial Sequence: Synthetic oligonucleotide
ccugaucccuguccuagg

SEQ ID NO: 137185 - RNA, 18 nt, Artificial Sequence
  Description of Artificial Sequence: Synthetic oligonucleotide
aaucuccugaucccuguc

SEQ ID NO: 137186 - RNA, 18 nt, Artificial Sequence
  Description of Artificial Sequence: Synthetic oligonucleotide
gccaaaaucuccugaucc

SEQ ID NO: 137187 - RNA, 18 nt, Artificial Sequence
  Description of Artificial Sequence: Synthetic oligonucleotide
cuuaagccaaaaucuccu

SEQ ID NO: 137188 - RNA, 18 nt, Artificial Sequence
  Description of Artificial Sequence: Synthetic oligonucleotide
cauagcuuaagccaaaau

SEQ ID NO: 137189 - RNA, 18 nt, Artificial Sequence
  Description of Artificial Sequence: Synthetic oligonucleotide
agagccauagcuuaagcc

SEQ ID NO: 137190 - RNA, 18 nt, Artificial Sequence
  Description of Artificial Sequence: Synthetic oligonucleotide
gucuuagagccauagcuu

SEQ ID NO: 137191 - RNA, 18 nt, Artificial Sequence
  Description of Artificial Sequence: Synthetic oligonucleotide
aaccagucuuagagccau

SEQ ID NO: 137192 - RNA, 18 nt, Artificial Sequence
  Description of Artificial Sequence: Synthetic oligonucleotide
cagacaaccagucuuaga

SEQ ID NO: 137193 - RNA, 18 nt, Artificial Sequence
  Description of Artificial Sequence: Synthetic oligonucleotide
uuaggcagacaaccaguc

SEQ ID NO: 137194 - RNA, 18 nt, Artificial Sequence
  Description of Artificial Sequence: Synthetic oligonucleotide
caggauuaggcagacaac

SEQ ID NO: 137195 - RNA, 18 nt, Artificial Sequence
  Description of Artificial Sequence: Synthetic oligonucleotide
uugcccaggauuaggcag

SEQ ID NO: 137196 - RNA, 18 nt, Artificial Sequence
  Description of Artificial Sequence: Synthetic oligonucleotide
cucauuugcccaggauua

SEQ ID NO: 137197 - RNA, 18 nt, Artificial Sequence
  Description of Artificial Sequence: Synthetic oligonucleotide
aggaacucauuugcccag

SEQ ID NO: 137198 - RNA, 18 nt, Artificial Sequence
  Description of Artificial Sequence: Synthetic oligonucleotide
gagagaggaacucauuug

SEQ ID NO: 137199 - RNA, 18 nt, Artificial Sequence
  Description of Artificial Sequence: Synthetic oligonucleotide
gcucagagagaggaacuc

SEQ ID NO: 137200 - RNA, 18 nt, Artificial Sequence
  Description of Artificial Sequence: Synthetic oligonucleotide
cugaggcucagagagagg

SEQ ID NO: 137201 - RNA, 18 nt, Artificial Sequence
  Description of Artificial Sequence: Synthetic oligonucleotide
gaacacugaggcucagag

SEQ ID NO: 137202 - RNA, 18 nt, Artificial Sequence
  Description of Artificial Sequence: Synthetic oligonucleotide
uaagagaacacugaggcu

SEQ ID NO: 137203 - RNA, 18 nt, Artificial Sequence
  Description of Artificial Sequence: Synthetic oligonucleotide
acagauaagagaacacug

SEQ ID NO: 137204 - RNA, 18 nt, Artificial Sequence
  Description of Artificial Sequence: Synthetic oligonucleotide
acuuuacagauaagagaa

SEQ ID NO: 137205 - RNA, 18 nt, Artificial Sequence
  Description of Artificial Sequence: Synthetic oligonucleotide
uuuccacuuuacagauaa

SEQ ID NO: 137206 - RNA, 18 nt, Artificial Sequence
  Description of Artificial Sequence: Synthetic oligonucleotide
augaucucggcucacugc

SEQ ID NO: 137207 - RNA, 18 nt, Artificial Sequence
  Description of Artificial Sequence: Synthetic oligonucleotide
guggcaugaucucggcuc

SEQ ID NO: 137208 - RNA, 18 nt, Artificial Sequence
  Description of Artificial Sequence: Synthetic oligonucleotide
gugcaguggcaugaucuc

SEQ ID NO: 137209 - RNA, 18 nt, Artificial Sequence
  Description of Artificial Sequence: Synthetic oligonucleotide
cuggagugcaguggcaug

SEQ ID NO: 137210 - RNA, 18 nt, Artificial Sequence
  Description of Artificial Sequence: Synthetic oligonucleotide
ccaggcuggagugcagug

SEQ ID NO: 137211 - RNA, 18 nt, Artificial Sequence
  Description of Artificial Sequence: Synthetic oligonucleotide
gucacccaggcuggagug

SEQ ID NO: 137212 - RNA, 18 nt, Artificial Sequence
  Description of Artificial Sequence: Synthetic oligonucleotide
acucugucacccaggcug

SEQ ID NO: 137213 - RNA, 18 nt, Artificial Sequence
  Description of Artificial Sequence: Synthetic oligonucleotide
gucucacucugucaccca

SEQ ID NO: 137214 - RNA, 18 nt, Artificial Sequence
  Description of Artificial Sequence: Synthetic oligonucleotide
acagagucucacucuguc

SEQ ID NO: 137215 - RNA, 18 nt, Artificial Sequence
  Description of Artificial Sequence: Synthetic oligonucleotide
uugagacagagucucacu

SEQ ID NO: 137216 - RNA, 18 nt, Artificial Sequence
  Description of Artificial Sequence: Synthetic oligonucleotide
uuuuuuugagacagaguc

SEQ ID NO: 137217 - RNA, 18 nt, Artificial Sequence
  Description of Artificial Sequence: Synthetic oligonucleotide
uuuuuuuuuuuugagaca

SEQ ID NO: 137218 - RNA, 18 nt, Artificial Sequence
  Description of Artificial Sequence: Synthetic oligonucleotide
uuuuuuuuuuuuuuuuug

SEQ ID NO: 137219 - RNA, 18 nt, Artificial Sequence
  Description of Artificial Sequence: Synthetic oligonucleotide
uucuauuuuuuuuuuuuu

SEQ ID NO: 137220 - RNA, 18 nt, Artificial Sequence
  Description of Artificial Sequence: Synthetic oligonucleotide
acagauucuauuuuuuuu

SEQ ID NO: 137221 - RNA, 18 nt, Artificial Sequence
  Description of Artificial Sequence: Synthetic oligonucleotide
aaaauacagauucuauuu

SEQ ID NO: 137222 - RNA, 18 nt, Artificial Sequence
  Description of Artificial Sequence: Synthetic oligonucleotide
uuguaaaaauacagauuc

SEQ ID NO: 137223 - RNA, 18 nt, Artificial Sequence
  Description of Artificial Sequence: Synthetic oligonucleotide
gugcuuuguaaaaauaca

SEQ ID NO: 137224 - RNA, 18 nt, Artificial Sequence
  Description of Artificial Sequence: Synthetic oligonucleotide
gaagggugcuuuguaaaa

SEQ ID NO: 137225 - RNA, 18 nt, Artificial Sequence
  Description of Artificial Sequence: Synthetic oligonucleotide
auuaugaagggugcuuug

SEQ ID NO: 137226 - RNA, 18 nt, Artificial Sequence
  Description of Artificial Sequence: Synthetic oligonucleotide
ggagaauuaugaagggug

SEQ ID NO: 137227 - RNA, 18 nt, Artificial Sequence
  Description of Artificial Sequence: Synthetic oligonucleotide
gcuauggagaauuaugaa

SEQ ID NO: 137228 - RNA, 18 nt, Artificial Sequence
  Description of Artificial Sequence: Synthetic oligonucleotide
gaccagcuauggagaauu

SEQ ID NO: 137229 - RNA, 18 nt, Artificial Sequence
  Description of Artificial Sequence: Synthetic oligonucleotide
ccauggaccagcuaugga

SEQ ID NO: 137230 - RNA, 18 nt, Artificial Sequence
  Description of Artificial Sequence: Synthetic oligonucleotide
cccacccauggaccagcu

SEQ ID NO: 137231 - RNA, 18 nt, Artificial Sequence
  Description of Artificial Sequence: Synthetic oligonucleotide
aaauucccacccauggac

SEQ ID NO: 137232 - RNA, 18 nt, Artificial Sequence
  Description of Artificial Sequence: Synthetic oligonucleotide
gucccaaauucccaccca

SEQ ID NO: 137233 - RNA, 18 nt, Artificial Sequence
  Description of Artificial Sequence: Synthetic oligonucleotide
ugugggucccaaauuccc

SEQ ID NO: 137234 - RNA, 18 nt, Artificial Sequence
  Description of Artificial Sequence: Synthetic oligonucleotide
aaaacugugggucccaaa

SEQ ID NO: 137235 - RNA, 18 nt, Artificial Sequence
  Description of Artificial Sequence: Synthetic oligonucleotide
guuccaaaacuguggguc

SEQ ID NO: 137236 - RNA, 18 nt, Artificial Sequence
  Description of Artificial Sequence: Synthetic oligonucleotide
aaaaaguuccaaaacugu

SEQ ID NO: 137237 - RNA, 18 nt, Artificial Sequence
  Description of Artificial Sequence: Synthetic oligonucleotide
aucccaaaaaguuccaaa

SEQ ID NO: 137238 - RNA, 18 nt, Artificial Sequence
  Description of Artificial Sequence: Synthetic oligonucleotide
cuaugaucccaaaaaguu

SEQ ID NO: 137239 - RNA, 18 nt, Artificial Sequence
  Description of Artificial Sequence: Synthetic oligonucleotide
aaggucuaugaucccaaa

SEQ ID NO: 137240 - RNA, 18 nt, Artificial Sequence
  Description of Artificial Sequence: Synthetic oligonucleotide
ucaaaaaggucuaugauc

SEQ ID NO: 137241 - RNA, 18 nt, Artificial Sequence
  Description of Artificial Sequence: Synthetic oligonucleotide
gauucucaaaaaggucua

SEQ ID NO: 137242 - RNA, 18 nt, Artificial Sequence
  Description of Artificial Sequence: Synthetic oligonucleotide
uuugagauucucaaaaag

SEQ ID NO: 137243 - RNA, 18 nt, Artificial Sequence
  Description of Artificial Sequence: Synthetic oligonucleotide
ucuuuuuugagauucuca

SEQ ID NO: 137244 - RNA, 18 nt, Artificial Sequence
  Description of Artificial Sequence: Synthetic oligonucleotide
uuuuuucuuuuuugagau

SEQ ID NO: 137245 - RNA, 18 nt, Artificial Sequence
  Description of Artificial Sequence: Synthetic oligonucleotide
gcuuuuuuuuucuuuuuu

SEQ ID NO: 137246 - RNA, 18 nt, Artificial Sequence
  Description of Artificial Sequence: Synthetic oligonucleotide
ugugugcuuuuuuuuucu

SEQ ID NO: 137247 - RNA, 18 nt, Artificial Sequence
  Description of Artificial Sequence: Synthetic oligonucleotide
cauucugugugcuuuuuu

SEQ ID NO: 137248 - RNA, 18 nt, Artificial Sequence
  Description of Artificial Sequence: Synthetic oligonucleotide
agcaacauucugugugcu

SEQ ID NO: 137249 - RNA, 18 nt, Artificial Sequence
  Description of Artificial Sequence: Synthetic oligonucleotide
cuguaagcaacauucugu

SEQ ID NO: 137250 - RNA, 18 nt, Artificial Sequence
  Description of Artificial Sequence: Synthetic oligonucleotide
ugaaacuguaagcaacau

SEQ ID NO: 137251 - RNA, 18 nt, Artificial Sequence
  Description of Artificial Sequence: Synthetic oligonucleotide
ccugaugaaacuguaagc

SEQ ID NO: 137252 - RNA, 18 nt, Artificial Sequence
  Description of Artificial Sequence: Synthetic oligonucleotide
gugugccugaugaaacug

SEQ ID NO: 137253 - RNA, 18 nt, Artificial Sequence
  Description of Artificial Sequence: Synthetic oligonucleotide
cuucugugugccugauga

SEQ ID NO: 137254 - RNA, 18 nt, Artificial Sequence
  Description of Artificial Sequence: Synthetic oligonucleotide
ggccucuucugugugccu

SEQ ID NO: 137255 - RNA, 18 nt, Artificial Sequence
  Description of Artificial Sequence: Synthetic oligonucleotide
ugcugggccucuucugug

SEQ ID NO: 137256 - RNA, 18 nt, Artificial Sequence
  Description of Artificial Sequence: Synthetic oligonucleotide
cuucgugcugggccucuu

SEQ ID NO: 137257 - RNA, 18 nt, Artificial Sequence
  Description of Artificial Sequence: Synthetic oligonucleotide
aacugcuucgugcugggc

SEQ ID NO: 137258 - RNA, 18 nt, Artificial Sequence
  Description of Artificial Sequence: Synthetic oligonucleotide
caagaaacugcuucgugc

SEQ ID NO: 137259 - RNA, 18 nt, Artificial Sequence
  Description of Artificial Sequence: Synthetic oligonucleotide
uugggcaagaaacugcuu

SEQ ID NO: 137260 - RNA, 18 nt, Artificial Sequence
  Description of Artificial Sequence: Synthetic oligonucleotide
uguccuugggcaagaaac

SEQ ID NO: 137261 - RNA, 18 nt, Artificial Sequence
  Description of Artificial Sequence: Synthetic oligonucleotide
ugcuguguccuugggcaa

SEQ ID NO: 137262 - RNA, 18 nt, Artificial Sequence
  Description of Artificial Sequence: Synthetic oligonucleotide
ugaacugcuguguccuug

SEQ ID NO: 137263 - RNA, 18 nt, Artificial Sequence
  Description of Artificial Sequence: Synthetic oligonucleotide
guccuugaacugcugugu

SEQ ID NO: 137264 - RNA, 18 nt, Artificial Sequence
  Description of Artificial Sequence: Synthetic oligonucleotide
acucuguccuugaacugc

SEQ ID NO: 137265 - RNA, 18 nt, Artificial Sequence
  Description of Artificial Sequence: Synthetic oligonucleotide
cgcugacucuguccuuga

SEQ ID NO: 137266 - RNA, 18 nt, Artificial Sequence
  Description of Artificial Sequence: Synthetic oligonucleotide
ccucgcgcugacucuguc

SEQ ID NO: 137267 - RNA, 18 nt, Artificial Sequence
  Description of Artificial Sequence: Synthetic oligonucleotide
agagaccucgcgcugacu

SEQ ID NO: 137268 - RNA, 18 nt, Artificial Sequence
  Description of Artificial Sequence: Synthetic oligonucleotide
agcugagagaccucgcgc

SEQ ID NO: 137269 - RNA, 18 nt, Artificial Sequence
  Description of Artificial Sequence: Synthetic oligonucleotide
cucagagcugagagaccu

SEQ ID NO: 137270 - RNA, 18 nt, Artificial Sequence
  Description of Artificial Sequence: Synthetic oligonucleotide
augugcucagagcugaga

SEQ ID NO: 137271 - RNA, 18 nt, Artificial Sequence
  Description of Artificial Sequence: Synthetic oligonucleotide
agaacaugugcucagagc

SEQ ID NO: 137272 - RNA, 18 nt, Artificial Sequence
  Description of Artificial Sequence: Synthetic oligonucleotide
gggaaagaacaugugcuc

SEQ ID NO: 137273 - RNA, 18 nt, Artificial Sequence
  Description of Artificial Sequence: Synthetic oligonucleotide
acuagaaaccuggaaggg

SEQ ID NO: 137274 - RNA, 18 nt, Artificial Sequence
  Description of Artificial Sequence: Synthetic oligonucleotide
aaaacuagaaaccuggaa

SEQ ID NO: 137275 - RNA, 18 nt, Artificial Sequence
  Description of Artificial Sequence: Synthetic oligonucleotide
cccauaaaacuagaaacc

SEQ ID NO: 137276 - RNA, 18 nt, Artificial Sequence
  Description of Artificial Sequence: Synthetic oligonucleotide
uacuacccauaaaacuag

SEQ ID NO: 137277 - RNA, 18 nt, Artificial Sequence
  Description of Artificial Sequence: Synthetic oligonucleotide
aaaacuacuacccauaaa

SEQ ID NO: 137278 - RNA, 18 nt, Artificial Sequence
  Description of Artificial Sequence: Synthetic oligonucleotide
aucauaaaacuacuaccc

SEQ ID NO: 137279 - RNA, 18 nt, Artificial Sequence
  Description of Artificial Sequence: Synthetic oligonucleotide
ugggcaucauaaaacuac

SEQ ID NO: 137280 - RNA, 18 nt, Artificial Sequence
  Description of Artificial Sequence: Synthetic oligonucleotide
ugaaaugggcaucauaaa

SEQ ID NO: 137281 - RNA, 18 nt, Artificial Sequence
  Description of Artificial Sequence: Synthetic oligonucleotide
aacugugaaaugggcauc

SEQ ID NO: 137282 - RNA, 18 nt, Artificial Sequence
  Description of Artificial Sequence: Synthetic oligonucleotide
gccugaacugugaaaugg

SEQ ID NO: 137283 - RNA, 18 nt, Artificial Sequence
  Description of Artificial Sequence: Synthetic oligonucleotide
uaccugccugaacuguga

SEQ ID NO: 137284 - RNA, 18 nt, Artificial Sequence
  Description of Artificial Sequence: Synthetic oligonucleotide
gccucuaccugccugaac

SEQ ID NO: 137285 - RNA, 18 nt, Artificial Sequence
  Description of Artificial Sequence: Synthetic oligonucleotide
ccucugccucuaccugcc

SEQ ID NO: 137286 - RNA, 18 nt, Artificial Sequence
  Description of Artificial Sequence: Synthetic oligonucleotide
gcuccccucugccucuac

SEQ ID NO: 137287 - RNA, 18 nt, Artificial Sequence
  Description of Artificial Sequence: Synthetic oligonucleotide
uuaaugcuccccucugcc

SEQ ID NO: 137288 - RNA, 18 nt, Artificial Sequence
  Description of Artificial Sequence: Synthetic oligonucleotide
ucagcuuaaugcuccccu

SEQ ID NO: 137289 - RNA, 18 nt, Artificial Sequence
  Description of Artificial Sequence: Synthetic oligonucleotide
gcaagucagcuuaaugcu

SEQ ID NO: 137290 - RNA, 18 nt, Artificial Sequence
  Description of Artificial Sequence: Synthetic oligonucleotide
gcugggcaagucagcuua

SEQ ID NO: 137291 - RNA, 18 nt, Artificial Sequence
  Description of Artificial Sequence: Synthetic oligonucleotide
gugacgcugggcaaguca

SEQ ID NO: 137292 - RNA, 18 nt, Artificial Sequence
  Description of Artificial Sequence: Synthetic oligonucleotide
acucagugacgcugggca

SEQ ID NO: 137293 - RNA, 18 nt, Artificial Sequence
  Description of Artificial Sequence: Synthetic oligonucleotide
agccaacucagugacgcu

SEQ ID NO: 137294 - RNA, 18 nt, Artificial Sequence
  Description of Artificial Sequence: Synthetic oligonucleotide
cccguagccaacucagug

SEQ ID NO: 137295 - RNA, 18 nt, Artificial Sequence
  Description of Artificial Sequence: Synthetic oligonucleotide
ggcugcccguagccaacu

SEQ ID NO: 137296 - RNA, 18 nt, Artificial Sequence
  Description of Artificial Sequence: Synthetic oligonucleotide
gggaaggcugcccguagc

SEQ ID NO: 137297 - RNA, 18 nt, Artificial Sequence
  Description of Artificial Sequence: Synthetic oligonucleotide
cccuugggaaggcugccc

SEQ ID NO: 137298 - RNA, 18 nt, Artificial Sequence
  Description of Artificial Sequence: Synthetic oligonucleotide
cuguacccuugggaaggc

SEQ ID NO: 137299 - RNA, 18 nt, Artificial Sequence
  Description of Artificial Sequence: Synthetic oligonucleotide
gccaucuguacccuuggg

SEQ ID NO: 137300 - RNA, 18 nt, Artificial Sequence
  Description of Artificial Sequence: Synthetic oligonucleotide
uguuugccaucuguaccc

SEQ ID NO: 137301 - RNA, 18 nt, Artificial Sequence
  Description of Artificial Sequence: Synthetic oligonucleotide
aacaguguuugccaucug

SEQ ID NO: 137302 - RNA, 18 nt, Artificial Sequence
  Description of Artificial Sequence: Synthetic oligonucleotide
gggcucugagcagggcca

SEQ ID NO: 137303 - RNA, 18 nt, Artificial Sequence
  Description of Artificial Sequence: Synthetic oligonucleotide
agcaugggcucugagcag

SEQ ID NO: 137304 - RNA, 18 nt, Artificial Sequence
  Description of Artificial Sequence: Synthetic oligonucleotide
ucgccagcaugggcucug

SEQ ID NO: 137305 - RNA, 18 nt, Artificial Sequence
  Description of Artificial Sequence: Synthetic oligonucleotide
ggugcucgccagcauggg

SEQ ID NO: 137306 - RNA, 18 nt, Artificial Sequence
  Description of Artificial Sequence: Synthetic oligonucleotide
cagcaggugcucgccagc

SEQ ID NO: 137307 - RNA, 18 nt, Artificial Sequence
  Description of Artificial Sequence: Synthetic oligonucleotide
ccgagcagcaggugcucg

SEQ ID NO: 137308 - RNA, 18 nt, Artificial Sequence
  Description of Artificial Sequence: Synthetic oligonucleotide
uggcuccgagcagcaggu

SEQ ID NO: 137309 - RNA, 18 nt, Artificial Sequence
  Description of Artificial Sequence: Synthetic oligonucleotide
cuugguggcuccgagcag

SEQ ID NO: 137310 - RNA, 18 nt, Artificial Sequence
  Description of Artificial Sequence: Synthetic oligonucleotide
gaucucuugguggcuccg

SEQ ID NO: 137311 - RNA, 18 nt, Artificial Sequence
  Description of Artificial Sequence: Synthetic oligonucleotide
ccauggaucucuuggugg

SEQ ID NO: 137312 - RNA, 18 nt, Artificial Sequence
  Description of Artificial Sequence: Synthetic oligonucleotide
gaacaccauggaucucuu

SEQ ID NO: 137313 - RNA, 18 nt, Artificial Sequence
  Description of Artificial Sequence: Synthetic oligonucleotide
uccuugaacaccauggau

SEQ ID NO: 137314 - RNA, 18 nt, Artificial Sequence
  Description of Artificial Sequence: Synthetic oligonucleotide
gcacguccuugaacacca

SEQ ID NO: 137315 - RNA, 18 nt, Artificial Sequence
  Description of Artificial Sequence: Synthetic oligonucleotide
gagcagcacguccuugaa

SEQ ID NO: 137316 - RNA, 18 nt, Artificial Sequence
  Description of Artificial Sequence: Synthetic oligonucleotide
ugggcucugagcagggcc

SEQ ID NO: 137317 - RNA, 18 nt, Artificial Sequence
  Description of Artificial Sequence: Synthetic oligonucleotide
cagcaugggcucugagca

SEQ ID NO: 137318 - RNA, 18 nt, Artificial Sequence
  Description of Artificial Sequence: Synthetic oligonucleotide
cucgccagcaugggcucu

SEQ ID NO: 137319 - RNA, 18 nt, Artificial Sequence
  Description of Artificial Sequence: Synthetic oligonucleotide
aggugcucgccagcaugg

SEQ ID NO: 137320 - RNA, 18 nt, Artificial Sequence
  Description of Artificial Sequence: Synthetic oligonucleotide
gcagcaggugcucgccag

SEQ ID NO: 137321 - RNA, 18 nt, Artificial Sequence
  Description of Artificial Sequence: Synthetic oligonucleotide
uccgagcagcaggugcuc

SEQ ID NO: 137322 - RNA, 18 nt, Artificial Sequence
  Description of Artificial Sequence: Synthetic oligonucleotide
guggcuccgagcagcagg

SEQ ID NO: 137323 - RNA, 18 nt, Artificial Sequence
  Description of Artificial Sequence: Synthetic oligonucleotide
ucuugguggcuccgagca

SEQ ID NO: 137324 - RNA, 18 nt, Artificial Sequence
  Description of Artificial Sequence: Synthetic oligonucleotide
ggaucucuugguggcucc

SEQ ID NO: 137325 - RNA, 18 nt, Artificial Sequence
  Description of Artificial Sequence: Synthetic oligonucleotide
accauggaucucuuggug

SEQ ID NO: 137326 - RNA, 18 nt, Artificial Sequence
  Description of Artificial Sequence: Synthetic oligonucleotide
ugaacaccauggaucucu

SEQ ID NO: 137327 - RNA, 18 nt, Artificial Sequence
  Description of Artificial Sequence: Synthetic oligonucleotide
guccuugaacaccaugga

SEQ ID NO: 137328 - RNA, 18 nt, Artificial Sequence
  Description of Artificial Sequence: Synthetic oligonucleotide
agcacguccuugaacacc

SEQ ID NO: 137329 - RNA, 18 nt, Artificial Sequence
  Description of Artificial Sequence: Synthetic oligonucleotide
ggagcagcacguccuuga

SEQ ID NO: 137330 - RNA, 18 nt, Artificial Sequence
  Description of Artificial Sequence: Synthetic oligonucleotide
gccagggcaggcagccgc

SEQ ID NO: 137331 - RNA, 18 nt, Artificial Sequence
  Description of Artificial Sequence: Synthetic oligonucleotide
cccuggccagggcaggca

SEQ ID NO: 137332 - RNA, 18 nt, Artificial Sequence
  Description of Artificial Sequence: Synthetic oligonucleotide
uggagcccuggccagggc

SEQ ID NO: 137333 - RNA, 18 nt, Artificial Sequence
  Description of Artificial Sequence: Synthetic oligonucleotide
cucccuggagcccuggcc

SEQ ID NO: 137334 - RNA, 18 nt, Artificial Sequence
  Description of Artificial Sequence: Synthetic oligonucleotide
auacccucccuggagccc

SEQ ID NO: 137335 - RNA, 18 nt, Artificial Sequence
  Description of Artificial Sequence: Synthetic oligonucleotide
uaggcauacccucccugg

SEQ ID NO: 137336 - RNA, 18 nt, Artificial Sequence
  Description of Artificial Sequence: Synthetic oligonucleotide
caugcuaggcauacccuc

SEQ ID NO: 137337 - RNA, 18 nt, Artificial Sequence
  Description of Artificial Sequence: Synthetic oligonucleotide
agugccaugcuaggcaua

SEQ ID NO: 137338 - RNA, 18 nt, Artificial Sequence
  Description of Artificial Sequence: Synthetic oligonucleotide
gggugagugccaugcuag

SEQ ID NO: 137339 - RNA, 18 nt, Artificial Sequence
  Description of Artificial Sequence: Synthetic oligonucleotide
ugccugggugagugccau

SEQ ID NO: 137340 - RNA, 18 nt, Artificial Sequence
  Description of Artificial Sequence: Synthetic oligonucleotide
cuccuugccugggugagu

SEQ ID NO: 137341 - RNA, 18 nt, Artificial Sequence
  Description of Artificial Sequence: Synthetic oligonucleotide
ugaaucuccuugccuggg

SEQ ID NO: 137342 - RNA, 18 nt, Artificial Sequence
  Description of Artificial Sequence: Synthetic oligonucleotide
ccaugugaaucuccuugc

SEQ ID NO: 137343 - RNA, 18 nt, Artificial Sequence
  Description of Artificial Sequence: Synthetic oligonucleotide
ugccaccaugugaaucuc

SEQ ID NO: 137344 - RNA, 18 nt, Artificial Sequence
  Description of Artificial Sequence: Synthetic oligonucleotide
uugcaugccaccauguga

SEQ ID NO: 137345 - RNA, 18 nt, Artificial Sequence
  Description of Artificial Sequence: Synthetic oligonucleotide
cacccuugcaugccacca

SEQ ID NO: 137346 - RNA, 18 nt, Artificial Sequence
  Description of Artificial Sequence: Synthetic oligonucleotide
ucccucacccuugcaugc

SEQ ID NO: 137347 - RNA, 18 nt, Artificial Sequence
  Description of Artificial Sequence: Synthetic oligonucleotide
uagucucccucacccuug

SEQ ID NO: 137348 - RNA, 18 nt, Artificial Sequence
  Description of Artificial Sequence: Synthetic oligonucleotide
cugacuagucucccucac

SEQ ID NO: 137349 - RNA, 18 nt, Artificial Sequence
  Description of Artificial Sequence: Synthetic oligonucleotide
cacuccugacuagucucc

SEQ ID NO: 137350 - RNA, 18 nt, Artificial Sequence
  Description of Artificial Sequence: Synthetic oligonucleotide
agggccacuccugacuag

SEQ ID NO: 137351 - RNA, 18 nt, Artificial Sequence
  Description of Artificial Sequence: Synthetic oligonucleotide
aggacagggccacuccug

SEQ ID NO: 137352 - RNA, 18 nt, Artificial Sequence
  Description of Artificial Sequence: Synthetic oligonucleotide
gccugaggacagggccac

SEQ ID NO: 137353 - RNA, 18 nt, Artificial Sequence
  Description of Artificial Sequence: Synthetic oligonucleotide
ugcaagccugaggacagg

SEQ ID NO: 137354 - RNA, 18 nt, Artificial Sequence
  Description of Artificial Sequence: Synthetic oligonucleotide
ucuaaugcaagccugagg

SEQ ID NO: 137355 - RNA, 18 nt, Artificial Sequence
  Description of Artificial Sequence: Synthetic oligonucleotide
agcccucuaaugcaagcc

SEQ ID NO: 137356 - RNA, 18 nt, Artificial Sequence
  Description of Artificial Sequence: Synthetic oligonucleotide
ccuggagcccucuaaugc

SEQ ID NO: 137357 - RNA, 18 nt, Artificial Sequence
  Description of Artificial Sequence: Synthetic oligonucleotide
ugaguccuggagcccucu

SEQ ID NO: 137358 - RNA, 18 nt, Artificial Sequence
  Description of Artificial Sequence: Synthetic oligonucleotide
aaaacugaguccuggagc

SEQ ID NO: 137359 - RNA, 18 nt, Artificial Sequence
  Description of Artificial Sequence: Synthetic oligonucleotide
aguugaaaacugaguccu

SEQ ID NO: 137360 - RNA, 18 nt, Artificial Sequence
  Description of Artificial Sequence: Synthetic oligonucleotide
uacccaguugaaaacuga

SEQ ID NO: 137361 - RNA, 18 nt, Artificial Sequence
  Description of Artificial Sequence: Synthetic oligonucleotide
ggguacccaguugaaaac

SEQ ID NO: 137362 - RNA, 18 nt, Artificial Sequence
  Description of Artificial Sequence: Synthetic oligonucleotide
uccuugcaucugaguggg

SEQ ID NO: 137363 - RNA, 18 nt, Artificial Sequence
  Description of Artificial Sequence: Synthetic oligonucleotide
acauuuccuugcaucuga

SEQ ID NO: 137364 - RNA, 18 nt, Artificial Sequence
  Description of Artificial Sequence: Synthetic oligonucleotide
cauccacauuuccuugca

SEQ ID NO: 137365 - RNA, 18 nt, Artificial Sequence
  Description of Artificial Sequence: Synthetic oligonucleotide
acuugcauccacauuucc

SEQ ID NO: 137366 - RNA, 18 nt, Artificial Sequence
  Description of Artificial Sequence: Synthetic oligonucleotide
uggugacuugcauccaca

SEQ ID NO: 137367 - RNA, 18 nt, Artificial Sequence
  Description of Artificial Sequence: Synthetic oligonucleotide
gaauuuggugacuugcau

SEQ ID NO: 137368 - RNA, 18 nt, Artificial Sequence
  Description of Artificial Sequence: Synthetic oligonucleotide
gcugggaauuuggugacu

SEQ ID NO: 137369 - RNA, 18 nt, Artificial Sequence
  Description of Artificial Sequence: Synthetic oligonucleotide
ucaaugcugggaauuugg

SEQ ID NO: 137370 - RNA, 18 nt, Artificial Sequence
  Description of Artificial Sequence: Synthetic oligonucleotide
ugacuucaaugcugggaa

SEQ ID NO: 137371 - RNA, 18 nt, Artificial Sequence
  Description of Artificial Sequence: Synthetic oligonucleotide
ugcucugacuucaaugcu

SEQ ID NO: 137372 - RNA, 18 nt, Artificial Sequence
  Description of Artificial Sequence: Synthetic oligonucleotide
gaucgugcucugacuuca

SEQ ID NO: 137373 - RNA, 18 nt, Artificial Sequence
  Description of Artificial Sequence: Synthetic oligonucleotide
acccugaucgugcucuga

SEQ ID NO: 137374 - RNA, 18 nt, Artificial Sequence
  Description of Artificial Sequence: Synthetic oligonucleotide
ggauaacccugaucgugc

SEQ ID NO: 137375 - RNA, 18 nt, Artificial Sequence
  Description of Artificial Sequence: Synthetic oligonucleotide
uccagggauaacccugau

SEQ ID NO: 137376 - RNA, 18 nt, Artificial Sequence
  Description of Artificial Sequence: Synthetic oligonucleotide
guaauuccagggauaacc

SEQ ID NO: 137377 - RNA, 18 nt, Artificial Sequence
  Description of Artificial Sequence: Synthetic oligonucleotide
cacagguaauuccaggga

SEQ ID NO: 137378 - RNA, 18 nt, Artificial Sequence
  Description of Artificial Sequence: Synthetic oligonucleotide
ggaugcacagguaauucc

SEQ ID NO: 137379 - RNA, 18 nt, Artificial Sequence
  Description of Artificial Sequence: Synthetic oligonucleotide
aaaaaggaugcacaggua

SEQ ID NO: 137380 - RNA, 18 nt, Artificial Sequence
  Description of Artificial Sequence: Synthetic oligonucleotide
aaagaaaaaaggaugcac

SEQ ID NO: 137381 - RNA, 18 nt, Artificial Sequence
  Description of Artificial Sequence: Synthetic oligonucleotide
ugucaaaagaaaaaagga

SEQ ID NO: 137382 - RNA, 18 nt, Artificial Sequence
  Description of Artificial Sequence: Synthetic oligonucleotide
gacucugucaaaagaaaa

SEQ ID NO: 137383 - RNA, 18 nt, Artificial Sequence
  Description of Artificial Sequence: Synthetic oligonucleotide
agcaagacucugucaaaa

SEQ ID NO: 137384 - RNA, 18 nt, Artificial Sequence
  Description of Artificial Sequence: Synthetic oligonucleotide
gacagagcaagacucugu

SEQ ID NO: 137385 - RNA, 18 nt, Artificial Sequence
  Description of Artificial Sequence: Synthetic oligonucleotide
ugagugacagagcaagac

SEQ ID NO: 137386 - RNA, 18 nt, Artificial Sequence
  Description of Artificial Sequence: Synthetic oligonucleotide
cagccugagugacagagc

SEQ ID NO: 137387 - RNA, 18 nt, Artificial Sequence
  Description of Artificial Sequence: Synthetic oligonucleotide
cacuccagccugagugac

SEQ ID NO: 137388 - RNA, 18 nt, Artificial Sequence
  Description of Artificial Sequence: Synthetic oligonucleotide
cauugcacuccagccuga

SEQ ID NO: 137389 - RNA, 18 nt, Artificial Sequence
  Description of Artificial Sequence: Synthetic oligonucleotide
cacaucauugcacuccag

SEQ ID NO: 137390 - RNA, 18 nt, Artificial Sequence
  Description of Artificial Sequence: Synthetic oligonucleotide
gagaucacaucauugcac

SEQ ID NO: 137391 - RNA, 18 nt, Artificial Sequence
  Description of Artificial Sequence: Synthetic oligonucleotide
gagccgagaucacaucau

SEQ ID NO: 137392 - RNA, 18 nt, Artificial Sequence
  Description of Artificial Sequence: Synthetic oligonucleotide
gaagugagccgagaucac

SEQ ID NO: 137393 - RNA, 18 nt, Artificial Sequence
  Description of Artificial Sequence: Synthetic oligonucleotide
aggcugaagugagccgag

SEQ ID NO: 137394 - RNA, 18 nt, Artificial Sequence
  Description of Artificial Sequence: Synthetic oligonucleotide
gguggaggcugaagugag

SEQ ID NO: 137395 - RNA, 18 nt, Artificial Sequence
  Description of Artificial Sequence: Synthetic oligonucleotide
uggcggguggaggcugaa

SEQ ID NO: 137396 - RNA, 18 nt, Artificial Sequence
  Description of Artificial Sequence: Synthetic oligonucleotide
gaacguggcggguggagg

SEQ ID NO: 137397 - RNA, 18 nt, Artificial Sequence
  Description of Artificial Sequence: Synthetic oligonucleotide
ugcuugaacguggcgggu

SEQ ID NO: 137398 - RNA, 18 nt, Artificial Sequence
  Description of Artificial Sequence: Synthetic oligonucleotide
agaauugcuugaacgugg

SEQ ID NO: 137399 - RNA, 18 nt, Artificial Sequence
  Description of Artificial Sequence: Synthetic oligonucleotide
gcaggagaauugcuugaa

SEQ ID NO: 137400 - RNA, 18 nt, Artificial Sequence
  Description of Artificial Sequence: Synthetic oligonucleotide
gugaggcaggagaauugc

SEQ ID NO: 137401 - RNA, 18 nt, Artificial Sequence
  Description of Artificial Sequence: Synthetic oligonucleotide
ggagggugaggcaggaga

SEQ ID NO: 137402 - RNA, 18 nt, Artificial Sequence
  Description of Artificial Sequence: Synthetic oligonucleotide
acucuggagggugaggca

SEQ ID NO: 137403 - RNA, 18 nt, Artificial Sequence
  Description of Artificial Sequence: Synthetic oligonucleotide
cagcaacucuggagggug

SEQ ID NO: 137404 - RNA, 18 nt, Artificial Sequence
  Description of Artificial Sequence: Synthetic oligonucleotide
ggucccagcaacucugga

SEQ ID NO: 137405 - RNA, 18 nt, Artificial Sequence
  Description of Artificial Sequence: Synthetic oligonucleotide
ccuguggucccagcaacu

SEQ ID NO: 137406 - RNA, 18 nt, Artificial Sequence
  Description of Artificial Sequence: Synthetic oligonucleotide
gcacgccuguggucccag

SEQ ID NO: 137407 - RNA, 18 nt, Artificial Sequence
  Description of Artificial Sequence: Synthetic oligonucleotide
guggugcacgccuguggu

SEQ ID NO: 137408 - RNA, 18 nt, Artificial Sequence
  Description of Artificial Sequence: Synthetic oligonucleotide
gugugguggugcacgccu

SEQ ID NO: 137409 - RNA, 18 nt, Artificial Sequence
  Description of Artificial Sequence: Synthetic oligonucleotide
gcugggugugguggugca

SEQ ID NO: 137410 - RNA, 18 nt, Artificial Sequence
  Description of Artificial Sequence: Synthetic oligonucleotide
aauuagcuggguguggug

SEQ ID NO: 137411 - RNA, 18 nt, Artificial Sequence
  Description of Artificial Sequence: Synthetic oligonucleotide
acaaaaauuagcugggug

SEQ ID NO: 137412 - RNA, 18 nt, Artificial Sequence
  Description of Artificial Sequence: Synthetic oligonucleotide
aaaauacaaaaauuagcu

SEQ ID NO: 137413 - RNA, 18 nt, Artificial Sequence
  Description of Artificial Sequence: Synthetic oligonucleotide
uacuaaaaauacaaaaau

SEQ ID NO: 137414 - RNA, 18 nt, Artificial Sequence
  Description of Artificial Sequence: Synthetic oligonucleotide
gucucuacuaaaaauaca

SEQ ID NO: 137415 - RNA, 18 nt, Artificial Sequence
  Description of Artificial Sequence: Synthetic oligonucleotide
acccugucucuacuaaaa

SEQ ID NO: 137416 - RNA, 18 nt, Artificial Sequence
  Description of Artificial Sequence: Synthetic oligonucleotide
gugaaacccugucucuac

SEQ ID NO: 137417 - RNA, 18 nt, Artificial Sequence
  Description of Artificial Sequence: Synthetic oligonucleotide
acauggugaaacccuguc

SEQ ID NO: 137418 - RNA, 18 nt, Artificial Sequence
  Description of Artificial Sequence: Synthetic oligonucleotide
ggucaacauggugaaacc

SEQ ID NO: 137419 - RNA, 18 nt, Artificial Sequence
  Description of Artificial Sequence: Synthetic oligonucleotide
agccuggucaacauggug

SEQ ID NO: 137420 - RNA, 18 nt, Artificial Sequence
  Description of Artificial Sequence: Synthetic oligonucleotide
agaccagccuggucaaca

SEQ ID NO: 137421 - RNA, 18 nt, Artificial Sequence
  Description of Artificial Sequence: Synthetic oligonucleotide
guuugagaccagccuggu

SEQ ID NO: 137422 - RNA, 18 nt, Artificial Sequence
  Description of Artificial Sequence: Synthetic oligonucleotide
caggaguuugagaccagc

SEQ ID NO: 137423 - RNA, 18 nt, Artificial Sequence
  Description of Artificial Sequence: Synthetic oligonucleotide
gaggccaggaguuugaga

SEQ ID NO: 137424 - RNA, 18 nt, Artificial Sequence
  Description of Artificial Sequence: Synthetic oligonucleotide
uauuugaggccaggaguu

SEQ ID NO: 137425 - RNA, 18 nt, Artificial Sequence
  Description of Artificial Sequence: Synthetic oligonucleotide
uggauuauuugaggccag

SEQ ID NO: 137426 - RNA, 18 nt, Artificial Sequence
  Description of Artificial Sequence: Synthetic oligonucleotide
gcggguggauuauuugag

SEQ ID NO: 137427 - RNA, 18 nt, Artificial Sequence
  Description of Artificial Sequence: Synthetic oligonucleotide
cugaggcggguggauuau

SEQ ID NO: 137428 - RNA, 18 nt, Artificial Sequence
  Description of Artificial Sequence: Synthetic oligonucleotide
gagcacagucccuggcac

SEQ ID NO: 137429 - RNA, 18 nt, Artificial Sequence
  Description of Artificial Sequence: Synthetic oligonucleotide
gcagugagcacagucccu

SEQ ID NO: 137430 - RNA, 18 nt, Artificial Sequence
  Description of Artificial Sequence: Synthetic oligonucleotide
gcaaagcagugagcacag

SEQ ID NO: 137431 - RNA, 18 nt, Artificial Sequence
  Description of Artificial Sequence: Synthetic oligonucleotide
uguuugcaaagcagugag

SEQ ID NO: 137432 - RNA, 18 nt, Artificial Sequence
  Description of Artificial Sequence: Synthetic oligonucleotide
gguaguguuugcaaagca

SEQ ID NO: 137433 - RNA, 18 nt, Artificial Sequence
  Description of Artificial Sequence: Synthetic oligonucleotide
aaauagguaguguuugca

SEQ ID NO: 137434 - RNA, 18 nt, Artificial Sequence
  Description of Artificial Sequence: Synthetic oligonucleotide
uauuaaaauagguagugu

SEQ ID NO: 137435 - RNA, 18 nt, Artificial Sequence
  Description of Artificial Sequence: Synthetic oligonucleotide
uguuauauuaaaauaggu

SEQ ID NO: 137436 - RNA, 18 nt, Artificial Sequence
  Description of Artificial Sequence: Synthetic oligonucleotide
agcauuguuauauuaaaa

SEQ ID NO: 137437 - RNA, 18 nt, Artificial Sequence
  Description of Artificial Sequence: Synthetic oligonucleotide
cucauagcauuguuauau

SEQ ID NO: 137438 - RNA, 18 nt, Artificial Sequence
  Description of Artificial Sequence: Synthetic oligonucleotide
cuucccucauagcauugu

SEQ ID NO: 137439 - RNA, 18 nt, Artificial Sequence
  Description of Artificial Sequence: Synthetic oligonucleotide
ucgagcuucccucauagc

SEQ ID NO: 137440 - RNA, 18 nt, Artificial Sequence
  Description of Artificial Sequence: Synthetic oligonucleotide
aauaaucgagcuucccuc

SEQ ID NO: 137441 - RNA, 18 nt, Artificial Sequence
  Description of Artificial Sequence: Synthetic oligonucleotide
ggauaaauaaucgagcuu

SEQ ID NO: 137442 - RNA, 18 nt, Artificial Sequence
  Description of Artificial Sequence: Synthetic oligonucleotide
gaugaggauaaauaaucg

SEQ ID NO: 137443 - RNA, 18 nt, Artificial Sequence
  Description of Artificial Sequence: Synthetic oligonucleotide
uauaagaugaggauaaau

SEQ ID NO: 137444 - RNA, 18 nt, Artificial Sequence
  Description of Artificial Sequence: Synthetic oligonucleotide
uuaucuauaagaugagga

SEQ ID NO: 137445 - RNA, 18 nt, Artificial Sequence
  Description of Artificial Sequence: Synthetic oligonucleotide
uuuucuuaucuauaagau

SEQ ID NO: 137446 - RNA, 18 nt, Artificial Sequence
  Description of Artificial Sequence: Synthetic oligonucleotide
cucaguuuucuuaucuau

SEQ ID NO: 137447 - RNA, 18 nt, Artificial Sequence
  Description of Artificial Sequence: Synthetic oligonucleotide
ugugccucaguuuucuua

SEQ ID NO: 137448 - RNA, 18 nt, Artificial Sequence
  Description of Artificial Sequence: Synthetic oligonucleotide
cucucugugccucaguuu

SEQ ID NO: 137449 - RNA, 18 nt, Artificial Sequence
  Description of Artificial Sequence: Synthetic oligonucleotide
uuaaccucucugugccuc

SEQ ID NO: 137450 - RNA, 18 nt, Artificial Sequence
  Description of Artificial Sequence: Synthetic oligonucleotide
guuacuuaaccucucugu

SEQ ID NO: 137451 - RNA, 18 nt, Artificial Sequence
  Description of Artificial Sequence: Synthetic oligonucleotide
gauaaguuacuuaaccuc

SEQ ID NO: 137452 - RNA, 18 nt, Artificial Sequence
  Description of Artificial Sequence: Synthetic oligonucleotide
aguuggauaaguuacuua

SEQ ID NO: 137453 - RNA, 18 nt, Artificial Sequence
  Description of Artificial Sequence: Synthetic oligonucleotide
guuauaguuggauaaguu

SEQ ID NO: 137454 - RNA, 18 nt, Artificial Sequence
  Description of Artificial Sequence: Synthetic oligonucleotide
agcugguuauaguuggau

SEQ ID NO: 137455 - RNA, 18 nt, Artificial Sequence
  Description of Artificial Sequence: Synthetic oligonucleotide
cugauagcugguuauagu

SEQ ID NO: 137456 - RNA, 18 nt, Artificial Sequence
  Description of Artificial Sequence: Synthetic oligonucleotide
ugccccugauagcugguu

SEQ ID NO: 137457 - RNA, 18 nt, Artificial Sequence
  Description of Artificial Sequence: Synthetic oligonucleotide
ggcucugccccugauagc

SEQ ID NO: 137458 - RNA, 18 nt, Artificial Sequence
  Description of Artificial Sequence: Synthetic oligonucleotide
uaaauggcucugccccug

SEQ ID NO: 137459 - RNA, 18 nt, Artificial Sequence
  Description of Artificial Sequence: Synthetic oligonucleotide
cugcuuaaauggcucugc

SEQ ID NO: 137460 - RNA, 18 nt, Artificial Sequence
  Description of Artificial Sequence: Synthetic oligonucleotide
cugcccugcuuaaauggc

SEQ ID NO: 137461 - RNA, 18 nt, Artificial Sequence
  Description of Artificial Sequence: Synthetic oligonucleotide
cugcacugcccugcuuaa

SEQ ID NO: 137462 - RNA, 18 nt, Artificial Sequence
  Description of Artificial Sequence: Synthetic oligonucleotide
uggaacugcacugcccug

SEQ ID NO: 137463 - RNA, 18 nt, Artificial Sequence
  Description of Artificial Sequence: Synthetic oligonucleotide
gauucuggaacugcacug

SEQ ID NO: 137464 - RNA, 18 nt, Artificial Sequence
  Description of Artificial Sequence: Synthetic oligonucleotide
gaccagauucuggaacug

SEQ ID NO: 137465 - RNA, 18 nt, Artificial Sequence
  Description of Artificial Sequence: Synthetic oligonucleotide
uaaaggaccagauucugg

SEQ ID NO: 137466 - RNA, 18 nt, Artificial Sequence
  Description of Artificial Sequence: Synthetic oligonucleotide
aagguuaaaggaccagau

SEQ ID NO: 137467 - RNA, 18 nt, Artificial Sequence
  Description of Artificial Sequence: Synthetic oligonucleotide
gcaucaagguuaaaggac

SEQ ID NO: 137468 - RNA, 18 nt, Artificial Sequence
  Description of Artificial Sequence: Synthetic oligonucleotide
ccaaagcaucaagguuaa

SEQ ID NO: 137469 - RNA, 18 nt, Artificial Sequence
  Description of Artificial Sequence: Synthetic oligonucleotide
aggcaccaaagcaucaag

SEQ ID NO: 137470 - RNA, 18 nt, Artificial Sequence
  Description of Artificial Sequence: Synthetic oligonucleotide
cugauaggcaccaaagca

SEQ ID NO: 137471 - RNA, 18 nt, Artificial Sequence
  Description of Artificial Sequence: Synthetic oligonucleotide
gucaccugauaggcacca

SEQ ID NO: 137472 - RNA, 18 nt, Artificial Sequence
  Description of Artificial Sequence: Synthetic oligonucleotide
caaaggucaccugauagg

SEQ ID NO: 137473 - RNA, 18 nt, Artificial Sequence
  Description of Artificial Sequence: Synthetic oligonucleotide
acauucaaaggucaccug

SEQ ID NO: 137474 - RNA, 18 nt, Artificial Sequence
  Description of Artificial Sequence: Synthetic oligonucleotide
cgaugacauucaaagguc

SEQ ID NO: 137475 - RNA, 18 nt, Artificial Sequence
  Description of Artificial Sequence: Synthetic oligonucleotide
aagaucgaugacauucaa

SEQ ID NO: 137476 - RNA, 18 nt, Artificial Sequence
  Description of Artificial Sequence: Synthetic oligonucleotide
cucacaagaucgaugaca

SEQ ID NO: 137477 - RNA, 18 nt, Artificial Sequence
  Description of Artificial Sequence: Synthetic oligonucleotide
caugacucacaagaucga

SEQ ID NO: 137478 - RNA, 18 nt, Artificial Sequence
  Description of Artificial Sequence: Synthetic oligonucleotide
accaacaugacucacaag

SEQ ID NO: 137479 - RNA, 18 nt, Artificial Sequence
  Description of Artificial Sequence: Synthetic oligonucleotide
cauuuaccaacaugacuc

SEQ ID NO: 137480 - RNA, 18 nt, Artificial Sequence
  Description of Artificial Sequence: Synthetic oligonucleotide
agcuccauuuaccaacau

SEQ ID NO: 137481 - RNA, 18 nt, Artificial Sequence
  Description of Artificial Sequence: Synthetic oligonucleotide
acccaagcuccauuuacc

SEQ ID NO: 137482 - RNA, 18 nt, Artificial Sequence
  Description of Artificial Sequence: Synthetic oligonucleotide
acaugacccaagcuccau

SEQ ID NO: 137483 - RNA, 18 nt, Artificial Sequence
  Description of Artificial Sequence: Synthetic oligonucleotide
cuuucacaugacccaagc

SEQ ID NO: 137484 - RNA, 18 nt, Artificial Sequence
  Description of Artificial Sequence: Synthetic oligonucleotide
gaccucuuucacaugacc

SEQ ID NO: 137485 - RNA, 18 nt, Artificial Sequence
  Description of Artificial Sequence: Synthetic oligonucleotide
ucuaggaccucuuucaca

SEQ ID NO: 137486 - RNA, 18 nt, Artificial Sequence
  Description of Artificial Sequence: Synthetic oligonucleotide
ggcuuucuaggaccucuu

SEQ ID NO: 137487 - RNA, 18 nt, Artificial Sequence
  Description of Artificial Sequence: Synthetic oligonucleotide
aacuuggcuuucuaggac

SEQ ID NO: 137488 - RNA, 18 nt, Artificial Sequence
  Description of Artificial Sequence: Synthetic oligonucleotide
cuuggaacuuggcuuucu

SEQ ID NO: 137489 - RNA, 18 nt, Artificial Sequence
  Description of Artificial Sequence: Synthetic oligonucleotide
cugagcuuggaacuuggc

SEQ ID NO: 137490 - RNA, 18 nt, Artificial Sequence
  Description of Artificial Sequence: Synthetic oligonucleotide
uccggcugagcuuggaac

SEQ ID NO: 137491 - RNA, 18 nt, Artificial Sequence
  Description of Artificial Sequence: Synthetic oligonucleotide
agucauccggcugagcuu

SEQ ID NO: 137492 - RNA, 18 nt, Artificial Sequence
  Description of Artificial Sequence: Synthetic oligonucleotide
ccuugagucauccggcug

SEQ ID NO: 137493 - RNA, 18 nt, Artificial Sequence
  Description of Artificial Sequence: Synthetic oligonucleotide
agcugccuugagucaucc

SEQ ID NO: 137494 - RNA, 18 nt, Artificial Sequence
  Description of Artificial Sequence: Synthetic oligonucleotide
agauaagcugccuugagu

SEQ ID NO: 137495 - RNA, 18 nt, Artificial Sequence
  Description of Artificial Sequence: Synthetic oligonucleotide
ucagaagauaagcugccu

SEQ ID NO: 137496 - RNA, 18 nt, Artificial Sequence
  Description of Artificial Sequence: Synthetic oligonucleotide
cagauucagaagauaagc

SEQ ID NO: 137497 - RNA, 18 nt, Artificial Sequence
  Description of Artificial Sequence: Synthetic oligonucleotide
aggcccagauucagaaga

SEQ ID NO: 137498 - RNA, 18 nt, Artificial Sequence
  Description of Artificial Sequence: Synthetic oligonucleotide
agcugaggcccagauuca

SEQ ID NO: 137499 - RNA, 18 nt, Artificial Sequence
  Description of Artificial Sequence: Synthetic oligonucleotide
aaggaagcugaggcccag

SEQ ID NO: 137500 - RNA, 18 nt, Artificial Sequence
  Description of Artificial Sequence: Synthetic oligonucleotide
cagguaaggaagcugagg

SEQ ID NO: 137501 - RNA, 18 nt, Artificial Sequence
  Description of Artificial Sequence: Synthetic oligonucleotide
uuucacagguaaggaagc

SEQ ID NO: 137502 - RNA, 18 nt, Artificial Sequence
  Description of Artificial Sequence: Synthetic oligonucleotide
ucccauuucacagguaag

SEQ ID NO: 137503 - RNA, 18 nt, Artificial Sequence
  Description of Artificial Sequence: Synthetic oligonucleotide
gugacucccauuucacag

SEQ ID NO: 137504 - RNA, 18 nt, Artificial Sequence
  Description of Artificial Sequence: Synthetic oligonucleotide
ggauggugacucccauuu

SEQ ID NO: 137505 - RNA, 18 nt, Artificial Sequence
  Description of Artificial Sequence: Synthetic oligonucleotide
ugcagggauggugacucc

SEQ ID NO: 137506 - RNA, 18 nt, Artificial Sequence
  Description of Artificial Sequence: Synthetic oligonucleotide
ggaccugcagggauggug

SEQ ID NO: 137507 - RNA, 18 nt, Artificial Sequence
  Description of Artificial Sequence: Synthetic oligonucleotide
gaggaggaccugcaggga

SEQ ID NO: 137508 - RNA, 18 nt, Artificial Sequence
  Description of Artificial Sequence: Synthetic oligonucleotide
ugugggaggaggaccugc

SEQ ID NO: 137509 - RNA, 18 nt, Artificial Sequence
  Description of Artificial Sequence: Synthetic oligonucleotide
gugccugugggaggagga

SEQ ID NO: 137510 - RNA, 18 nt, Artificial Sequence
  Description of Artificial Sequence: Synthetic oligonucleotide
agcuggugccugugggag

SEQ ID NO: 137511 - RNA, 18 nt, Artificial Sequence
  Description of Artificial Sequence: Synthetic oligonucleotide
aagauagcuggugccugu

SEQ ID NO: 137512 - RNA, 18 nt, Artificial Sequence
  Description of Artificial Sequence: Synthetic oligonucleotide
uuggcaagauagcuggug

SEQ ID NO: 137513 - RNA, 18 nt, Artificial Sequence
  Description of Artificial Sequence: Synthetic oligonucleotide
uuaaguuggcaagauagc

SEQ ID NO: 137514 - RNA, 18 nt, Artificial Sequence
  Description of Artificial Sequence: Synthetic oligonucleotide
ggcuuuuaaguuggcaag

SEQ ID NO: 137515 - RNA, 18 nt, Artificial Sequence
  Description of Artificial Sequence: Synthetic oligonucleotide
guuuuggcuuuuaaguug

SEQ ID NO: 137516 - RNA, 18 nt, Artificial Sequence
  Description of Artificial Sequence: Synthetic oligonucleotide
cucuaguuuuggcuuuua

SEQ ID NO: 137517 - RNA, 18 nt, Artificial Sequence
  Description of Artificial Sequence: Synthetic oligonucleotide
cucuccucuaguuuuggc

SEQ ID NO: 137518 - RNA, 18 nt, Artificial Sequence
  Description of Artificial Sequence: Synthetic oligonucleotide
gaccccucuccucuaguu

SEQ ID NO: 137519 - RNA, 18 nt, Artificial Sequence
  Description of Artificial Sequence: Synthetic oligonucleotide
ggguugaccccucuccuc

SEQ ID NO: 137520 - RNA, 18 nt, Artificial Sequence
  Description of Artificial Sequence: Synthetic oligonucleotide
accuuggguugaccccuc

SEQ ID NO: 137521 - RNA, 18 nt, Artificial Sequence
  Description of Artificial Sequence: Synthetic oligonucleotide
aagucaccuuggguugac

SEQ ID NO: 137522 - RNA, 18 nt, Artificial Sequence
  Description of Artificial Sequence: Synthetic oligonucleotide
augggaagucaccuuggg

SEQ ID NO: 137523 - RNA, 18 nt, Artificial Sequence
  Description of Artificial Sequence: Synthetic oligonucleotide
ggaggaugggaagucacc

SEQ ID NO: 137524 - RNA, 18 nt, Artificial Sequence
  Description of Artificial Sequence: Synthetic oligonucleotide
gggagggaggaugggaag

SEQ ID NO: 137525 - RNA, 18 nt, Artificial Sequence
  Description of Artificial Sequence: Synthetic oligonucleotide
gggacaauguagucauug

SEQ ID NO: 137526 - RNA, 18 nt, Artificial Sequence
  Description of Artificial Sequence: Synthetic oligonucleotide
gccgagggacaauguagu

SEQ ID NO: 137527 - RNA, 18 nt, Artificial Sequence
  Description of Artificial Sequence: Synthetic oligonucleotide
gcagugccgagggacaau

SEQ ID NO: 137528 - RNA, 18 nt, Artificial Sequence
  Description of Artificial Sequence: Synthetic oligonucleotide
uccgggcagugccgaggg

SEQ ID NO: 137529 - RNA, 18 nt, Artificial Sequence
  Description of Artificial Sequence: Synthetic oligonucleotide
ccagcuccgggcagugcc

SEQ ID NO: 137530 - RNA, 18 nt, Artificial Sequence
  Description of Artificial Sequence: Synthetic oligonucleotide
cuccgccagcuccgggca

SEQ ID NO: 137531 - RNA, 18 nt, Artificial Sequence
  Description of Artificial Sequence: Synthetic oligonucleotide
cucaucuccgccagcucc

SEQ ID NO: 137532 - RNA, 18 nt, Artificial Sequence
  Description of Artificial Sequence: Synthetic oligonucleotide
cccggcucaucuccgcca

SEQ ID NO: 137533 - RNA, 18 nt, Artificial Sequence
  Description of Artificial Sequence: Synthetic oligonucleotide
ggacacccggcucaucuc

SEQ ID NO: 137534 - RNA, 18 nt, Artificial Sequence
  Description of Artificial Sequence: Synthetic oligonucleotide
cguauggacacccggcuc

SEQ ID NO: 137535 - RNA, 18 nt, Artificial Sequence
  Description of Artificial Sequence: Synthetic oligonucleotide
ggaugcguauggacaccc

SEQ ID NO: 137536 - RNA, 18 nt, Artificial Sequence
  Description of Artificial Sequence: Synthetic oligonucleotide
gucaaggaugcguaugga

SEQ ID NO: 137537 - RNA, 18 nt, Artificial Sequence
  Description of Artificial Sequence: Synthetic oligonucleotide
agcucgucaaggaugcgu

SEQ ID NO: 137538 - RNA, 18 nt, Artificial Sequence
  Description of Artificial Sequence: Synthetic oligonucleotide
gcaccagcucgucaagga

SEQ ID NO: 137539 - RNA, 18 nt, Artificial Sequence
  Description of Artificial Sequence: Synthetic oligonucleotide
gggcagcaccagcucguc

SEQ ID NO: 137540 - RNA, 18 nt, Artificial Sequence
  Description of Artificial Sequence: Synthetic oligonucleotide
uggaagggcagcaccagc

SEQ ID NO: 137541 - RNA, 18 nt, Artificial Sequence
  Description of Artificial Sequence: Synthetic oligonucleotide
gcuccuggaagggcagca

SEQ ID NO: 137542 - RNA, 18 nt, Artificial Sequence
  Description of Artificial Sequence: Synthetic oligonucleotide
cugcagcuccuggaaggg

SEQ ID NO: 137543 - RNA, 18 nt, Artificial Sequence
  Description of Artificial Sequence: Synthetic oligonucleotide
ucgaucugcagcuccugg

SEQ ID NO: 137544 - RNA, 18 nt, Artificial Sequence
  Description of Artificial Sequence: Synthetic oligonucleotide
ugucaucgaucugcagcu

SEQ ID NO: 137545 - RNA, 18 nt, Artificial Sequence
  Description of Artificial Sequence: Synthetic oligonucleotide
cucauugucaucgaucug

SEQ ID NO: 137546 - RNA, 18 nt, Artificial Sequence
  Description of Artificial Sequence: Synthetic oligonucleotide
gcauacucauugucaucg

SEQ ID NO: 137547 - RNA, 18 nt, Artificial Sequence
  Description of Artificial Sequence: Synthetic oligonucleotide
gguaggcauacucauugu

SEQ ID NO: 137548 - RNA, 18 nt, Artificial Sequence
  Description of Artificial Sequence: Synthetic oligonucleotide
uuugagguaggcauacuc

SEQ ID NO: 137549 - RNA, 18 nt, Artificial Sequence
  Description of Artificial Sequence: Synthetic oligonucleotide
auggcuuugagguaggca

SEQ ID NO: 137550 - RNA, 18 nt, Artificial Sequence
  Description of Artificial Sequence: Synthetic oligonucleotide
agaugauggcuuugaggu

SEQ ID NO: 137551 - RNA, 18 nt, Artificial Sequence
  Description of Artificial Sequence: Synthetic oligonucleotide
aaagaagaugauggcuuu

SEQ ID NO: 137552 - RNA, 18 nt, Artificial Sequence
  Description of Artificial Sequence: Synthetic oligonucleotide
gggucaaagaagaugaug

SEQ ID NO: 137553 - RNA, 18 nt, Artificial Sequence
  Description of Artificial Sequence: Synthetic oligonucleotide
ggacaauguagucauugc

SEQ ID NO: 137554 - RNA, 18 nt, Artificial Sequence
  Description of Artificial Sequence: Synthetic oligonucleotide
ccgagggacaauguaguc

SEQ ID NO: 137555 - RNA, 18 nt, Artificial Sequence
  Description of Artificial Sequence: Synthetic oligonucleotide
cagugccgagggacaaug

SEQ ID NO: 137556 - RNA, 18 nt, Artificial Sequence
  Description of Artificial Sequence: Synthetic oligonucleotide
ccgggcagugccgaggga

SEQ ID NO: 137557 - RNA, 18 nt, Artificial Sequence
  Description of Artificial Sequence: Synthetic oligonucleotide
cagcuccgggcagugccg

SEQ ID NO: 137558 - RNA, 18 nt, Artificial Sequence
  Description of Artificial Sequence: Synthetic oligonucleotide
uccgccagcuccgggcag

SEQ ID NO: 137559 - RNA, 18 nt, Artificial Sequence
  Description of Artificial Sequence: Synthetic oligonucleotide
ucaucuccgccagcuccg

SEQ ID NO: 137560 - RNA, 18 nt, Artificial Sequence
  Description of Artificial Sequence: Synthetic oligonucleotide
ccggcucaucuccgccag

SEQ ID NO: 137561 - RNA, 18 nt, Artificial Sequence
  Description of Artificial Sequence: Synthetic oligonucleotide
gacacccggcucaucucc

SEQ ID NO: 137562 - RNA, 18 nt, Artificial Sequence
  Description of Artificial Sequence: Synthetic oligonucleotide
guauggacacccggcuca

SEQ ID NO: 137563 - RNA, 18 nt, Artificial Sequence
  Description of Artificial Sequence: Synthetic oligonucleotide
gaugcguauggacacccg

SEQ ID NO: 137564 - RNA, 18 nt, Artificial Sequence
  Description of Artificial Sequence: Synthetic oligonucleotide
ucaaggaugcguauggac

SEQ ID NO: 137565 - RNA, 18 nt, Artificial Sequence
  Description of Artificial Sequence: Synthetic oligonucleotide
gcucgucaaggaugcgua

SEQ ID NO: 137566 - RNA, 18 nt, Artificial Sequence
  Description of Artificial Sequence: Synthetic oligonucleotide
caccagcucgucaaggau

SEQ ID NO: 137567 - RNA, 18 nt, Artificial Sequence
  Description of Artificial Sequence: Synthetic oligonucleotide
ggcagcaccagcucguca

SEQ ID NO: 137568 - RNA, 18 nt, Artificial Sequence
  Description of Artificial Sequence: Synthetic oligonucleotide
ggaagggcagcaccagcu

SEQ ID NO: 137569 - RNA, 18 nt, Artificial Sequence
  Description of Artificial Sequence: Synthetic oligonucleotide
cuccuggaagggcagcac

SEQ ID NO: 137570 - RNA, 18 nt, Artificial Sequence
  Description of Artificial Sequence: Synthetic oligonucleotide
ugcagcuccuggaagggc

SEQ ID NO: 137571 - RNA, 18 nt, Artificial Sequence
  Description of Artificial Sequence: Synthetic oligonucleotide
cgaucugcagcuccugga

SEQ ID NO: 137572 - RNA, 18 nt, Artificial Sequence
  Description of Artificial Sequence: Synthetic oligonucleotide
gucaucgaucugcagcuc

SEQ ID NO: 137573 - RNA, 18 nt, Artificial Sequence
  Description of Artificial Sequence: Synthetic oligonucleotide
ucauugucaucgaucugc

SEQ ID NO: 137574 - RNA, 18 nt, Artificial Sequence
  Description of Artificial Sequence: Synthetic oligonucleotide
cauacucauugucaucga

SEQ ID NO: 137575 - RNA, 18 nt, Artificial Sequence
  Description of Artificial Sequence: Synthetic oligonucleotide
guaggcauacucauuguc

SEQ ID NO: 137576 - RNA, 18 nt, Artificial Sequence
  Description of Artificial Sequence: Synthetic oligonucleotide
uugagguaggcauacuca

SEQ ID NO: 137577 - RNA, 18 nt, Artificial Sequence
  Description of Artificial Sequence: Synthetic oligonucleotide
uggcuuugagguaggcau

SEQ ID NO: 137578 - RNA, 18 nt, Artificial Sequence
  Description of Artificial Sequence: Synthetic oligonucleotide
gaugauggcuuugaggua

SEQ ID NO: 137579 - RNA, 18 nt, Artificial Sequence
  Description of Artificial Sequence: Synthetic oligonucleotide
aagaagaugauggcuuug

SEQ ID NO: 137580 - RNA, 18 nt, Artificial Sequence
  Description of Artificial Sequence: Synthetic oligonucleotide
ggucaaagaagaugaugg

SEQ ID NO: 137581 - RNA, 18 nt, Artificial Sequence
  Description of Artificial Sequence: Synthetic oligonucleotide
ggcuuaggaggugugcac

SEQ ID NO: 137582 - RNA, 18 nt, Artificial Sequence
  Description of Artificial Sequence: Synthetic oligonucleotide
gggauggcuuaggaggug

SEQ ID NO: 137583 - RNA, 18 nt, Artificial Sequence
  Description of Artificial Sequence: Synthetic oligonucleotide
agucagggauggcuuagg

SEQ ID NO: 137584 - RNA, 18 nt, Artificial Sequence
  Description of Artificial Sequence: Synthetic oligonucleotide
gagagagucagggauggc

SEQ ID NO: 137585 - RNA, 18 nt, Artificial Sequence
  Description of Artificial Sequence: Synthetic oligonucleotide
cuggagagagagucaggg

SEQ ID NO: 137586 - RNA, 18 nt, Artificial Sequence
  Description of Artificial Sequence: Synthetic oligonucleotide
gcguucuggagagagagu

SEQ ID NO: 137587 - RNA, 18 nt, Artificial Sequence
  Description of Artificial Sequence: Synthetic oligonucleotide
gcagagcguucuggagag

SEQ ID NO: 137588 - RNA, 18 nt, Artificial Sequence
  Description of Artificial Sequence: Synthetic oligonucleotide
gucuggcagagcguucug

SEQ ID NO: 137589 - RNA, 18 nt, Artificial Sequence
  Description of Artificial Sequence: Synthetic oligonucleotide
gagaagucuggcagagcg

SEQ ID NO: 137590 - RNA, 18 nt, Artificial Sequence
  Description of Artificial Sequence: Synthetic oligonucleotide
aauaggagaagucuggca

SEQ ID NO: 137591 - RNA, 18 nt, Artificial Sequence
  Description of Artificial Sequence: Synthetic oligonucleotide
aacccaauaggagaaguc

SEQ ID NO: 137592 - RNA, 18 nt, Artificial Sequence
  Description of Artificial Sequence: Synthetic oligonucleotide
uacagaacccaauaggag

SEQ ID NO: 137593 - RNA, 18 nt, Artificial Sequence
  Description of Artificial Sequence: Synthetic oligonucleotide
caguguacagaacccaau

SEQ ID NO: 137594 - RNA, 18 nt, Artificial Sequence
  Description of Artificial Sequence: Synthetic oligonucleotide
gaacucaguguacagaac

SEQ ID NO: 137595 - RNA, 18 nt, Artificial Sequence
  Description of Artificial Sequence: Synthetic oligonucleotide
gcugugaacucaguguac

SEQ ID NO: 137596 - RNA, 18 nt, Artificial Sequence
  Description of Artificial Sequence: Synthetic oligonucleotide
augaggcugugaacucag

SEQ ID NO: 137597 - RNA, 18 nt, Artificial Sequence
  Description of Artificial Sequence: Synthetic oligonucleotide
augagaugaggcugugaa

SEQ ID NO: 137598 - RNA, 18 nt, Artificial Sequence
  Description of Artificial Sequence: Synthetic oligonucleotide
uuaacaugagaugaggcu

SEQ ID NO: 137599 - RNA, 18 nt, Artificial Sequence
  Description of Artificial Sequence: Synthetic oligonucleotide
ugucguuaacaugagaug

SEQ ID NO: 137600 - RNA, 18 nt, Artificial Sequence
  Description of Artificial Sequence: Synthetic oligonucleotide
cuggcugucguuaacaug

SEQ ID NO: 137601 - RNA, 18 nt, Artificial Sequence
  Description of Artificial Sequence: Synthetic oligonucleotide
cucuccuggcugucguua

SEQ ID NO: 137602 - RNA, 18 nt, Artificial Sequence
  Description of Artificial Sequence: Synthetic oligonucleotide
acggccucuccuggcugu

SEQ ID NO: 137603 - RNA, 18 nt, Artificial Sequence
  Description of Artificial Sequence: Synthetic oligonucleotide
ugaaaacggccucuccug

SEQ ID NO: 137604 - RNA, 18 nt, Artificial Sequence
  Description of Artificial Sequence: Synthetic oligonucleotide
uuaaaugaaaacggccuc

SEQ ID NO: 137605 - RNA, 18 nt, Artificial Sequence
  Description of Artificial Sequence: Synthetic oligonucleotide
aucuguuaaaugaaaacg

SEQ ID NO: 137606 - RNA, 18 nt, Artificial Sequence
  Description of Artificial Sequence: Synthetic oligonucleotide
gccucaucuguuaaauga

SEQ ID NO: 137607 - RNA, 18 nt, Artificial Sequence
  Description of Artificial Sequence: Synthetic oligonucleotide
gacuugccucaucuguua

SEQ ID NO: 137608 - RNA, 18 nt, Artificial Sequence
  Description of Artificial Sequence: Synthetic oligonucleotide
aucuugacuugccucauc

SEQ ID NO: 137609 - RNA, 18 nt, Artificial Sequence
  Description of Artificial Sequence: Synthetic oligonucleotide
uucaaaucuugacuugcc

SEQ ID NO: 137610 - RNA, 18 nt, Artificial Sequence
  Description of Artificial Sequence: Synthetic oligonucleotide
gucucuucaaaucuugac

SEQ ID NO: 137611 - RNA, 18 nt, Artificial Sequence
  Description of Artificial Sequence: Synthetic oligonucleotide
auauugucucuucaaauc

SEQ ID NO: 137612 - RNA, 18 nt, Artificial Sequence
  Description of Artificial Sequence: Synthetic oligonucleotide
cggccauauugucucuuc

SEQ ID NO: 137613 - RNA, 18 nt, Artificial Sequence
  Description of Artificial Sequence: Synthetic oligonucleotide
gcgcccggccauauuguc

SEQ ID NO: 137614 - RNA, 18 nt, Artificial Sequence
  Description of Artificial Sequence: Synthetic oligonucleotide
ccacugcgcccggccaua

SEQ ID NO: 137615 - RNA, 18 nt, Artificial Sequence
  Description of Artificial Sequence: Synthetic oligonucleotide
gugagccacugcgcccgg

SEQ ID NO: 137616 - RNA, 18 nt, Artificial Sequence
  Description of Artificial Sequence: Synthetic oligonucleotide
caggugugagccacugcg

SEQ ID NO: 137617 - RNA, 18 nt, Artificial Sequence
  Description of Artificial Sequence: Synthetic oligonucleotide
gauuacaggugugagcca

SEQ ID NO: 137618 - RNA, 18 nt, Artificial Sequence
  Description of Artificial Sequence: Synthetic oligonucleotide
gcugggauuacaggugug

SEQ ID NO: 137619 - RNA, 18 nt, Artificial Sequence
  Description of Artificial Sequence: Synthetic oligonucleotide
aaagugcugggauuacag

SEQ ID NO: 137620 - RNA, 18 nt, Artificial Sequence
  Description of Artificial Sequence: Synthetic oligonucleotide
cucccaaagugcugggau

SEQ ID NO: 137621 - RNA, 18 nt, Artificial Sequence
  Description of Artificial Sequence: Synthetic oligonucleotide
ucagccucccaaagugcu

SEQ ID NO: 137622 - RNA, 18 nt, Artificial Sequence
  Description of Artificial Sequence: Synthetic oligonucleotide
ccgccucagccucccaaa

SEQ ID NO: 137623 - RNA, 18 nt, Artificial Sequence
  Description of Artificial Sequence: Synthetic oligonucleotide
uccgcccgccucagccuc

SEQ ID NO: 137624 - RNA, 18 nt, Artificial Sequence
  Description of Artificial Sequence: Synthetic oligonucleotide
ggugauccgcccgccuca

SEQ ID NO: 137625 - RNA, 18 nt, Artificial Sequence
  Description of Artificial Sequence: Synthetic oligonucleotide
ccucaggugauccgcccg

SEQ ID NO: 137626 - RNA, 18 nt, Artificial Sequence
  Description of Artificial Sequence: Synthetic oligonucleotide
ccugaccucaggugaucc

SEQ ID NO: 137627 - RNA, 18 nt, Artificial Sequence
  Description of Artificial Sequence: Synthetic oligonucleotide
gaaccccugaccucaggu

SEQ ID NO: 137628 - RNA, 18 nt, Artificial Sequence
  Description of Artificial Sequence: Synthetic oligonucleotide
aucuugaaccccugaccu

SEQ ID NO: 137629 - RNA, 18 nt, Artificial Sequence
  Description of Artificial Sequence: Synthetic oligonucleotide
ggcucaucuugaaccccu

SEQ ID NO: 137630 - RNA, 18 nt, Artificial Sequence
  Description of Artificial Sequence: Synthetic oligonucleotide
agccaggcucaucuugaa

SEQ ID NO: 137631 - RNA, 18 nt, Artificial Sequence
  Description of Artificial Sequence: Synthetic oligonucleotide
auguuagccaggcucauc

SEQ ID NO: 137632 - RNA, 18 nt, Artificial Sequence
  Description of Artificial Sequence: Synthetic oligonucleotide
ucuccauguuagccaggc

SEQ ID NO: 137633 - RNA, 18 nt, Artificial Sequence
  Description of Artificial Sequence: Synthetic oligonucleotide
ggguuucuccauguuagc

SEQ ID NO: 137634 - RNA, 18 nt, Artificial Sequence
  Description of Artificial Sequence: Synthetic oligonucleotide
uuguauuuuuaguagaga

SEQ ID NO: 137635 - RNA, 18 nt, Artificial Sequence
  Description of Artificial Sequence: Synthetic oligonucleotide
aauuuuuguauuuuuagu

SEQ ID NO: 137636 - RNA, 18 nt, Artificial Sequence
  Description of Artificial Sequence: Synthetic oligonucleotide
uggcuaauuuuuguauuu

SEQ ID NO: 137637 - RNA, 18 nt, Artificial Sequence
  Description of Artificial Sequence: Synthetic oligonucleotide
augccuggcuaauuuuug

SEQ ID NO: 137638 - RNA, 18 nt, Artificial Sequence
  Description of Artificial Sequence: Synthetic oligonucleotide
ccaccaugccuggcuaau

SEQ ID NO: 137639 - RNA, 18 nt, Artificial Sequence
  Description of Artificial Sequence: Synthetic oligonucleotide
gugcaccaccaugccugg

SEQ ID NO: 137640 - RNA, 18 nt, Artificial Sequence
  Description of Artificial Sequence: Synthetic oligonucleotide
caggcgugcaccaccaug

SEQ ID NO: 137641 - RNA, 18 nt, Artificial Sequence
  Description of Artificial Sequence: Synthetic oligonucleotide
gauuacaggcgugcacca

SEQ ID NO: 137642 - RNA, 18 nt, Artificial Sequence
  Description of Artificial Sequence: Synthetic oligonucleotide
gcugggauuacaggcgug

SEQ ID NO: 137643 - RNA, 18 nt, Artificial Sequence
  Description of Artificial Sequence: Synthetic oligonucleotide
gaauagcugggauuacag

SEQ ID NO: 137644 - RNA, 18 nt, Artificial Sequence
  Description of Artificial Sequence: Synthetic oligonucleotide
cucccgaauagcugggau

SEQ ID NO: 137645 - RNA, 18 nt, Artificial Sequence
  Description of Artificial Sequence: Synthetic oligonucleotide
ucagccucccgaauagcu

SEQ ID NO: 137646 - RNA, 18 nt, Artificial Sequence
  Description of Artificial Sequence: Synthetic oligonucleotide
cugccucagccucccgaa

SEQ ID NO: 137647 - RNA, 18 nt, Artificial Sequence
  Description of Artificial Sequence: Synthetic oligonucleotide
uucuccugccucagccuc

SEQ ID NO: 137648 - RNA, 18 nt, Artificial Sequence
  Description of Artificial Sequence: Synthetic oligonucleotide
agcaauucuccugccuca

SEQ ID NO: 137649 - RNA, 18 nt, Artificial Sequence
  Description of Artificial Sequence: Synthetic oligonucleotide
guucaagcaauucuccug

SEQ ID NO: 137650 - RNA, 18 nt, Artificial Sequence
  Description of Artificial Sequence: Synthetic oligonucleotide
cccagguucaagcaauuc

SEQ ID NO: 137651 - RNA, 18 nt, Artificial Sequence
  Description of Artificial Sequence: Synthetic oligonucleotide
cgccucccagguucaagc

SEQ ID NO: 137652 - RNA, 18 nt, Artificial Sequence
  Description of Artificial Sequence: Synthetic oligonucleotide
accuccgccucccagguu

SEQ ID NO: 137653 - RNA, 18 nt, Artificial Sequence
  Description of Artificial Sequence: Synthetic oligonucleotide
cugcaaccuccgccuccc

SEQ ID NO: 137654 - RNA, 18 nt, Artificial Sequence
  Description of Artificial Sequence: Synthetic oligonucleotide
gcucacugcaaccuccgc

SEQ ID NO: 137655 - RNA, 18 nt, Artificial Sequence
  Description of Artificial Sequence: Synthetic oligonucleotide
ucuuggcucacugcaacc

SEQ ID NO: 137656 - RNA, 18 nt, Artificial Sequence
  Description of Artificial Sequence: Synthetic oligonucleotide
cgggaucuuggcucacug

SEQ ID NO: 137657 - RNA, 18 nt, Artificial Sequence
  Description of Artificial Sequence: Synthetic oligonucleotide
aguggcgggaucuuggcu

SEQ ID NO: 137658 - RNA, 18 nt, Artificial Sequence
  Description of Artificial Sequence: Synthetic oligonucleotide
aaugcaguggcgggaucu

SEQ ID NO: 137659 - RNA, 18 nt, Artificial Sequence
  Description of Artificial Sequence: Synthetic oligonucleotide
gcuggaaugcaguggcgg

SEQ ID NO: 137660 - RNA, 18 nt, Artificial Sequence
  Description of Artificial Sequence: Synthetic oligonucleotide
cccaggcuggaaugcagu

SEQ ID NO: 137661 - RNA, 18 nt, Artificial Sequence
  Description of Artificial Sequence: Synthetic oligonucleotide
agucacccaggcuggaau

SEQ ID NO: 137662 - RNA, 18 nt, Artificial Sequence
  Description of Artificial Sequence: Synthetic oligonucleotide
gauggagucacccaggcu

SEQ ID NO: 137663 - RNA, 18 nt, Artificial Sequence
  Description of Artificial Sequence: Synthetic oligonucleotide
uuugagauggagucaccc

SEQ ID NO: 137664 - RNA, 18 nt, Artificial Sequence
  Description of Artificial Sequence: Synthetic oligonucleotide
guuuuuuugagauggagu

SEQ ID NO: 137665 - RNA, 18 nt, Artificial Sequence
  Description of Artificial Sequence: Synthetic oligonucleotide
uuuuuguuuuuuugagau

SEQ ID NO: 137666 - RNA, 18 nt, Artificial Sequence
  Description of Artificial Sequence: Synthetic oligonucleotide
cuuuguuuuuguuuuuuu

SEQ ID NO: 137667 - RNA, 18 nt, Artificial Sequence
  Description of Artificial Sequence: Synthetic oligonucleotide
ccucccuuuguuuuuguu

SEQ ID NO: 137668 - RNA, 18 nt, Artificial Sequence
  Description of Artificial Sequence: Synthetic oligonucleotide
cauauccucccuuuguuu

SEQ ID NO: 137669 - RNA, 18 nt, Artificial Sequence
  Description of Artificial Sequence: Synthetic oligonucleotide
caagucauauccucccuu

SEQ ID NO: 137670 - RNA, 18 nt, Artificial Sequence
  Description of Artificial Sequence: Synthetic oligonucleotide
ccugucaagucauauccu

SEQ ID NO: 137671 - RNA, 18 nt, Artificial Sequence
  Description of Artificial Sequence: Synthetic oligonucleotide
ggugcccugucaagucau

SEQ ID NO: 137672 - RNA, 18 nt, Artificial Sequence
  Description of Artificial Sequence: Synthetic oligonucleotide
gucagggugcccugucaa

SEQ ID NO: 137673 - RNA, 18 nt, Artificial Sequence
  Description of Artificial Sequence: Synthetic oligonucleotide
uuggagucagggugcccu

SEQ ID NO: 137674 - RNA, 18 nt, Artificial Sequence
  Description of Artificial Sequence: Synthetic oligonucleotide
ggccuuuggagucagggu

SEQ ID NO: 137675 - RNA, 18 nt, Artificial Sequence
  Description of Artificial Sequence: Synthetic oligonucleotide
gcccaggccuuuggaguc

SEQ ID NO: 137676 - RNA, 18 nt, Artificial Sequence
  Description of Artificial Sequence: Synthetic oligonucleotide
ggaaagcccaggccuuug

SEQ ID NO: 137677 - RNA, 18 nt, Artificial Sequence
  Description of Artificial Sequence: Synthetic oligonucleotide
acucagguuagguuucac

SEQ ID NO: 137678 - RNA, 18 nt, Artificial Sequence
  Description of Artificial Sequence: Synthetic oligonucleotide
uagggacucagguuaggu

SEQ ID NO: 137679 - RNA, 18 nt, Artificial Sequence
  Description of Artificial Sequence: Synthetic oligonucleotide
caccuuagggacucaggu

SEQ ID NO: 137680 - RNA, 18 nt, Artificial Sequence
  Description of Artificial Sequence: Synthetic oligonucleotide
ccuaucaccuuagggacu

SEQ ID NO: 137681 - RNA, 18 nt, Artificial Sequence
  Description of Artificial Sequence: Synthetic oligonucleotide
ugcuuccuaucaccuuag

SEQ ID NO: 137682 - RNA, 18 nt, Artificial Sequence
  Description of Artificial Sequence: Synthetic oligonucleotide
guuccugcuuccuaucac

SEQ ID NO: 137683 - RNA, 18 nt, Artificial Sequence
  Description of Artificial Sequence: Synthetic oligonucleotide
cccugguuccugcuuccu

SEQ ID NO: 137684 - RNA, 18 nt, Artificial Sequence
  Description of Artificial Sequence: Synthetic oligonucleotide
cccuucccugguuccugc

SEQ ID NO: 137685 - RNA, 18 nt, Artificial Sequence
  Description of Artificial Sequence: Synthetic oligonucleotide
ggcuccccuucccugguu

SEQ ID NO: 137686 - RNA, 18 nt, Artificial Sequence
  Description of Artificial Sequence: Synthetic oligonucleotide
gaauaggcuccccuuccc

SEQ ID NO: 137687 - RNA, 18 nt, Artificial Sequence
  Description of Artificial Sequence: Synthetic oligonucleotide
uguuagaauaggcucccc

SEQ ID NO: 137688 - RNA, 18 nt, Artificial Sequence
  Description of Artificial Sequence: Synthetic oligonucleotide
uacuguguuagaauaggc

SEQ ID NO: 137689 - RNA, 18 nt, Artificial Sequence
  Description of Artificial Sequence: Synthetic oligonucleotide
gcuucuacuguguuagaa

SEQ ID NO: 137690 - RNA, 18 nt, Artificial Sequence
  Description of Artificial Sequence: Synthetic oligonucleotide
uugcugcuucuacugugu

SEQ ID NO: 137691 - RNA, 18 nt, Artificial Sequence
  Description of Artificial Sequence: Synthetic oligonucleotide
agcaguugcugcuucuac

SEQ ID NO: 137692 - RNA, 18 nt, Artificial Sequence
  Description of Artificial Sequence: Synthetic oligonucleotide
accucagcaguugcugcu

SEQ ID NO: 137693 - RNA, 18 nt, Artificial Sequence
  Description of Artificial Sequence: Synthetic oligonucleotide
uccagaccucagcaguug

SEQ ID NO: 137694 - RNA, 18 nt, Artificial Sequence
  Description of Artificial Sequence: Synthetic oligonucleotide
ccucauccagaccucagc

SEQ ID NO: 137695 - RNA, 18 nt, Artificial Sequence
  Description of Artificial Sequence: Synthetic oligonucleotide
gguccccucauccagacc

SEQ ID NO: 137696 - RNA, 18 nt, Artificial Sequence
  Description of Artificial Sequence: Synthetic oligonucleotide
guugagguccccucaucc

SEQ ID NO: 137697 - RNA, 18 nt, Artificial Sequence
  Description of Artificial Sequence: Synthetic oligonucleotide
ccacaguugagguccccu

SEQ ID NO: 137698 - RNA, 18 nt, Artificial Sequence
  Description of Artificial Sequence: Synthetic oligonucleotide
uugggccacaguugaggu

SEQ ID NO: 137699 - RNA, 18 nt, Artificial Sequence
  Description of Artificial Sequence: Synthetic oligonucleotide
ggguuuugggccacaguu

SEQ ID NO: 137700 - RNA, 18 nt, Artificial Sequence
  Description of Artificial Sequence: Synthetic oligonucleotide
ccacaaugggaacuuggg

SEQ ID NO: 137701 - RNA, 18 nt, Artificial Sequence
  Description of Artificial Sequence: Synthetic oligonucleotide
gccacaaugggaacuugg

SEQ ID NO: 137702 - RNA, 18 nt, Artificial Sequence
  Description of Artificial Sequence: Synthetic oligonucleotide
gcagagccacaaugggaa

SEQ ID NO: 137703 - RNA, 18 nt, Artificial Sequence
  Description of Artificial Sequence: Synthetic oligonucleotide
uguuggcagagccacaau

SEQ ID NO: 137704 - RNA, 18 nt, Artificial Sequence
  Description of Artificial Sequence: Synthetic oligonucleotide
ccaguuguuggcagagcc

SEQ ID NO: 137705 - RNA, 18 nt, Artificial Sequence
  Description of Artificial Sequence: Synthetic oligonucleotide
cacagccaguuguuggca

SEQ ID NO: 137706 - RNA, 18 nt, Artificial Sequence
  Description of Artificial Sequence: Synthetic oligonucleotide
ggucgcacagccaguugu

SEQ ID NO: 137707 - RNA, 18 nt, Artificial Sequence
  Description of Artificial Sequence: Synthetic oligonucleotide
uccugggucgcacagcca

SEQ ID NO: 137708 - RNA, 18 nt, Artificial Sequence
  Description of Artificial Sequence: Synthetic oligonucleotide
acuuguccugggucgcac

SEQ ID NO: 137709 - RNA, 18 nt, Artificial Sequence
  Description of Artificial Sequence: Synthetic oligonucleotide
auaggacuuguccugggu

SEQ ID NO: 137710 - RNA, 18 nt, Artificial Sequence
  Description of Artificial Sequence: Synthetic oligonucleotide
caaagauaggacuugucc

SEQ ID NO: 137711 - RNA, 18 nt, Artificial Sequence
  Description of Artificial Sequence: Synthetic oligonucleotide
cagugcaaagauaggacu

SEQ ID NO: 137712 - RNA, 18 nt, Artificial Sequence
  Description of Artificial Sequence: Synthetic oligonucleotide
agacacagugcaaagaua

SEQ ID NO: 137713 - RNA, 18 nt, Artificial Sequence
  Description of Artificial Sequence: Synthetic oligonucleotide
aacccagacacagugcaa

SEQ ID NO: 137714 - RNA, 18 nt, Artificial Sequence
  Description of Artificial Sequence: Synthetic oligonucleotide
ccucaucuuacacacggg

SEQ ID NO: 137715 - RNA, 18 nt, Artificial Sequence
  Description of Artificial Sequence: Synthetic oligonucleotide
aaccgccucaucuuacac

SEQ ID NO: 137716 - RNA, 18 nt, Artificial Sequence
  Description of Artificial Sequence: Synthetic oligonucleotide
cuagcaaccgccucaucu

SEQ ID NO: 137717 - RNA, 18 nt, Artificial Sequence
  Description of Artificial Sequence: Synthetic oligonucleotide
agcaccuagcaaccgccu

SEQ ID NO: 137718 - RNA, 18 nt, Artificial Sequence
  Description of Artificial Sequence: Synthetic oligonucleotide
caauaagcaccuagcaac

SEQ ID NO: 137719 - RNA, 18 nt, Artificial Sequence
  Description of Artificial Sequence: Synthetic oligonucleotide
gcauccaauaagcaccua

SEQ ID NO: 137720 - RNA, 18 nt, Artificial Sequence
  Description of Artificial Sequence: Synthetic oligonucleotide
ggaaugcauccaauaagc

SEQ ID NO: 137721 - RNA, 18 nt, Artificial Sequence
  Description of Artificial Sequence: Synthetic oligonucleotide
cuugaggaaugcauccaa

SEQ ID NO: 137722 - RNA, 18 nt, Artificial Sequence
  Description of Artificial Sequence: Synthetic oligonucleotide
cgggacuugaggaaugca

SEQ ID NO: 137723 - RNA, 18 nt, Artificial Sequence
  Description of Artificial Sequence: Synthetic oligonucleotide
gagggcgggacuugagga

SEQ ID NO: 137724 - RNA, 18 nt, Artificial Sequence
  Description of Artificial Sequence: Synthetic oligonucleotide
agauggagggcgggacuu

SEQ ID NO: 137725 - RNA, 18 nt, Artificial Sequence
  Description of Artificial Sequence: Synthetic oligonucleotide
auaggagauggagggcgg

SEQ ID NO: 137726 - RNA, 18 nt, Artificial Sequence
  Description of Artificial Sequence: Synthetic oligonucleotide
cuaaaccagaagagaggg

SEQ ID NO: 137727 - RNA, 18 nt, Artificial Sequence
  Description of Artificial Sequence: Synthetic oligonucleotide
aagcacuaaaccagaaga

SEQ ID NO: 137728 - RNA, 18 nt, Artificial Sequence
  Description of Artificial Sequence: Synthetic oligonucleotide
uccuaaagcacuaaacca

SEQ ID NO: 137729 - RNA, 18 nt, Artificial Sequence
  Description of Artificial Sequence: Synthetic oligonucleotide
acauuuccuaaagcacua

SEQ ID NO: 137730 - RNA, 18 nt, Artificial Sequence
  Description of Artificial Sequence: Synthetic oligonucleotide
cugccacauuuccuaaag

SEQ ID NO: 137731 - RNA, 18 nt, Artificial Sequence
  Description of Artificial Sequence: Synthetic oligonucleotide
gauuucugccacauuucc

SEQ ID NO: 137732 - RNA, 18 nt, Artificial Sequence
  Description of Artificial Sequence: Synthetic oligonucleotide
aaaaagauuucugccaca

SEQ ID NO: 137733 - RNA, 18 nt, Artificial Sequence
  Description of Artificial Sequence: Synthetic oligonucleotide
ggcagaaaaagauuucug

SEQ ID NO: 137734 - RNA, 18 nt, Artificial Sequence
  Description of Artificial Sequence: Synthetic oligonucleotide
acacaggcagaaaaagau

SEQ ID NO: 137735 - RNA, 18 nt, Artificial Sequence
  Description of Artificial Sequence: Synthetic oligonucleotide
ccuagacacaggcagaaa

SEQ ID NO: 137736 - RNA, 18 nt, Artificial Sequence
  Description of Artificial Sequence: Synthetic oligonucleotide
gauuuccuagacacaggc

SEQ ID NO: 137737 - RNA, 18 nt, Artificial Sequence
  Description of Artificial Sequence: Synthetic oligonucleotide
auuaugauuuccuagaca

SEQ ID NO: 137738 - RNA, 18 nt, Artificial Sequence
  Description of Artificial Sequence: Synthetic oligonucleotide
caugaauuaugauuuccu

SEQ ID NO: 137739 - RNA, 18 nt, Artificial Sequence
  Description of Artificial Sequence: Synthetic oligonucleotide
gccagcaugaauuaugau

SEQ ID NO: 137740 - RNA, 18 nt, Artificial Sequence
  Description of Artificial Sequence: Synthetic oligonucleotide
gguacgccagcaugaauu

SEQ ID NO: 137741 - RNA, 18 nt, Artificial Sequence
  Description of Artificial Sequence: Synthetic oligonucleotide
accaggguacgccagcau

SEQ ID NO: 137742 - RNA, 18 nt, Artificial Sequence
  Description of Artificial Sequence: Synthetic oligonucleotide
caacaaccaggguacgcc

SEQ ID NO: 137743 - RNA, 18 nt, Artificial Sequence
  Description of Artificial Sequence: Synthetic oligonucleotide
gaccucaacaaccagggu

SEQ ID NO: 137744 - RNA, 18 nt, Artificial Sequence
  Description of Artificial Sequence: Synthetic oligonucleotide
ucagggaccucaacaacc

SEQ ID NO: 137745 - RNA, 18 nt, Artificial Sequence
  Description of Artificial Sequence: Synthetic oligonucleotide
aggauucagggaccucaa

SEQ ID NO: 137746 - RNA, 18 nt, Artificial Sequence
  Description of Artificial Sequence: Synthetic oligonucleotide
gcacaaggauucagggac

SEQ ID NO: 137747 - RNA, 18 nt, Artificial Sequence
  Description of Artificial Sequence: Synthetic oligonucleotide
ugugggcacaaggauuca

SEQ ID NO: 137748 - RNA, 18 nt, Artificial Sequence
  Description of Artificial Sequence: Synthetic oligonucleotide
agcagugugggcacaagg

SEQ ID NO: 137749 - RNA, 18 nt, Artificial Sequence
  Description of Artificial Sequence: Synthetic oligonucleotide
ucuucagcagugugggca

SEQ ID NO: 137750 - RNA, 18 nt, Artificial Sequence
  Description of Artificial Sequence: Synthetic oligonucleotide
aggagucuucagcagugu

SEQ ID NO: 137751 - RNA, 18 nt, Artificial Sequence
  Description of Artificial Sequence: Synthetic oligonucleotide
acacaaggagucuucagc

SEQ ID NO: 137752 - RNA, 18 nt, Artificial Sequence
  Description of Artificial Sequence: Synthetic oligonucleotide
guaucacacaaggagucu

SEQ ID NO: 137753 - RNA, 18 nt, Artificial Sequence
  Description of Artificial Sequence: Synthetic oligonucleotide
gacuuguaucacacaagg

SEQ ID NO: 137754 - RNA, 18 nt, Artificial Sequence
  Description of Artificial Sequence: Synthetic oligonucleotide
ccccugacuuguaucaca

SEQ ID NO: 137755 - RNA, 18 nt, Artificial Sequence
  Description of Artificial Sequence: Synthetic oligonucleotide
gauguccccugacuugua

SEQ ID NO: 137756 - RNA, 18 nt, Artificial Sequence
  Description of Artificial Sequence: Synthetic oligonucleotide
acccagauguccccugac

SEQ ID NO: 137757 - RNA, 18 nt, Artificial Sequence
  Description of Artificial Sequence: Synthetic oligonucleotide
ucaagacccagauguccc

SEQ ID NO: 137758 - RNA, 18 nt, Artificial Sequence
  Description of Artificial Sequence: Synthetic oligonucleotide
gggagucaagacccagau

SEQ ID NO: 137759 - RNA, 18 nt, Artificial Sequence
  Description of Artificial Sequence: Synthetic oligonucleotide
ccagcuggagcaucuggg

SEQ ID NO: 137760 - RNA, 18 nt, Artificial Sequence
  Description of Artificial Sequence: Synthetic oligonucleotide
ggguccagcuggagcauc

SEQ ID NO: 137761 - RNA, 18 nt, Artificial Sequence
  Description of Artificial Sequence: Synthetic oligonucleotide
cagcaggguccagcugga

SEQ ID NO: 137762 - RNA, 18 nt, Artificial Sequence
  Description of Artificial Sequence: Synthetic oligonucleotide
gagggcagcaggguccag

SEQ ID NO: 137763 - RNA, 18 nt, Artificial Sequence
  Description of Artificial Sequence: Synthetic oligonucleotide
caagggagggcagcaggg

SEQ ID NO: 137764 - RNA, 18 nt, Artificial Sequence
  Description of Artificial Sequence: Synthetic oligonucleotide
gugggcaagggagggcag

SEQ ID NO: 137765 - RNA, 18 nt, Artificial Sequence
  Description of Artificial Sequence: Synthetic oligonucleotide
ucgcucagccccuuggca

SEQ ID NO: 137766 - RNA, 18 nt, Artificial Sequence
  Description of Artificial Sequence: Synthetic oligonucleotide
cuggaucgcucagccccu

SEQ ID NO: 137767 - RNA, 18 nt, Artificial Sequence
  Description of Artificial Sequence: Synthetic oligonucleotide
cuucccuggaucgcucag

SEQ ID NO: 137768 - RNA, 18 nt, Artificial Sequence
  Description of Artificial Sequence: Synthetic oligonucleotide
uugaucuucccuggaucg

SEQ ID NO: 137769 - RNA, 18 nt, Artificial Sequence
  Description of Artificial Sequence: Synthetic oligonucleotide
gccgcuugaucuucccug

SEQ ID NO: 137770 - RNA, 18 nt, Artificial Sequence
  Description of Artificial Sequence: Synthetic oligonucleotide
acgcagccgcuugaucuu

SEQ ID NO: 137771 - RNA, 18 nt, Artificial Sequence
  Description of Artificial Sequence: Synthetic oligonucleotide
ugggaacgcagccgcuug

SEQ ID NO: 137772 - RNA, 18 nt, Artificial Sequence
  Description of Artificial Sequence: Synthetic oligonucleotide
gcaccugggaacgcagcc

SEQ ID NO: 137773 - RNA, 18 nt, Artificial Sequence
  Description of Artificial Sequence: Synthetic oligonucleotide
caccugcaccugggaacg

SEQ ID NO: 137774 - RNA, 18 nt, Artificial Sequence
  Description of Artificial Sequence: Synthetic oligonucleotide
aagcucaccugcaccugg

SEQ ID NO: 137775 - RNA, 18 nt, Artificial Sequence
  Description of Artificial Sequence: Synthetic oligonucleotide
ccuccaagcucaccugca

SEQ ID NO: 137776 - RNA, 18 nt, Artificial Sequence
  Description of Artificial Sequence: Synthetic oligonucleotide
guaguccuccaagcucac

SEQ ID NO: 137777 - RNA, 18 nt, Artificial Sequence
  Description of Artificial Sequence: Synthetic oligonucleotide
uugauguaguccuccaag

SEQ ID NO: 137778 - RNA, 18 nt, Artificial Sequence
  Description of Artificial Sequence: Synthetic oligonucleotide
ggucguugauguaguccu

SEQ ID NO: 137779 - RNA, 18 nt, Artificial Sequence
  Description of Artificial Sequence: Synthetic oligonucleotide
cuggcggucguugaugua

SEQ ID NO: 137780 - RNA, 18 nt, Artificial Sequence
  Description of Artificial Sequence: Synthetic oligonucleotide
ucauacuggcggucguug

SEQ ID NO: 137781 - RNA, 18 nt, Artificial Sequence
  Description of Artificial Sequence: Synthetic oligonucleotide
gcgagucauacuggcggu

SEQ ID NO: 137782 - RNA, 18 nt, Artificial Sequence
  Description of Artificial Sequence: Synthetic oligonucleotide
gccacgcgagucauacug

SEQ ID NO: 137783 - RNA, 18 nt, Artificial Sequence
  Description of Artificial Sequence: Synthetic oligonucleotide
aagcggccacgcgaguca

SEQ ID NO: 137784 - RNA, 18 nt, Artificial Sequence
  Description of Artificial Sequence: Synthetic oligonucleotide
cuccaaagcggccacgcg

SEQ ID NO: 137785 - RNA, 18 nt, Artificial Sequence
  Description of Artificial Sequence: Synthetic oligonucleotide
cagcucuccaaagcggcc

SEQ ID NO: 137786 - RNA, 18 nt, Artificial Sequence
  Description of Artificial Sequence: Synthetic oligonucleotide
agcagcagcucuccaaag

SEQ ID NO: 137787 - RNA, 18 nt, Artificial Sequence
  Description of Artificial Sequence: Synthetic oligonucleotide
gcagcagcagcagcucuc

SEQ ID NO: 137788 - RNA, 18 nt, Artificial Sequence
  Description of Artificial Sequence: Synthetic oligonucleotide
gggcagcagcagcagcag

SEQ ID NO: 137789 - RNA, 18 nt, Artificial Sequence
  Description of Artificial Sequence: Synthetic oligonucleotide
aaggugggcagcagcagc

SEQ ID NO: 137790 - RNA, 18 nt, Artificial Sequence
  Description of Artificial Sequence: Synthetic oligonucleotide
ucugcaaggugggcagca

SEQ ID NO: 137791 - RNA, 18 nt, Artificial Sequence
  Description of Artificial Sequence: Synthetic oligonucleotide
gaugcucugcaagguggg

SEQ ID NO: 137792 - RNA, 18 nt, Artificial Sequence
  Description of Artificial Sequence: Synthetic oligonucleotide
caggugaugcucugcaag

SEQ ID NO: 137793 - RNA, 18 nt, Artificial Sequence
  Description of Artificial Sequence: Synthetic oligonucleotide
ucugccaggugaugcucu

SEQ ID NO: 137794 - RNA, 18 nt, Artificial Sequence
  Description of Artificial Sequence: Synthetic oligonucleotide
gaucaucugccaggugau

SEQ ID NO: 137795 - RNA, 18 nt, Artificial Sequence
  Description of Artificial Sequence: Synthetic oligonucleotide
ugcucgaucaucugccag

SEQ ID NO: 137796 - RNA, 18 nt, Artificial Sequence
  Description of Artificial Sequence: Synthetic oligonucleotide
ggaucugcucgaucaucu

SEQ ID NO: 137797 - RNA, 18 nt, Artificial Sequence
  Description of Artificial Sequence: Synthetic oligonucleotide
gaacuggaucugcucgau

SEQ ID NO: 137798 - RNA, 18 nt, Artificial Sequence
  Description of Artificial Sequence: Synthetic oligonucleotide
uugaugaacuggaucugc

SEQ ID NO: 137799 - RNA, 18 nt, Artificial Sequence
  Description of Artificial Sequence: Synthetic oligonucleotide
agagcuugaugaacugga

SEQ ID NO: 137800 - RNA, 18 nt, Artificial Sequence
  Description of Artificial Sequence: Synthetic oligonucleotide
gccgaagagcuugaugaa

SEQ ID NO: 137801 - RNA, 18 nt, Artificial Sequence
  Description of Artificial Sequence: Synthetic oligonucleotide
gccaugccgaagagcuug

SEQ ID NO: 137802 - RNA, 18 nt, Artificial Sequence
  Description of Artificial Sequence: Synthetic oligonucleotide
ucuuggccaugccgaaga

SEQ ID NO: 137803 - RNA, 18 nt, Artificial Sequence
  Description of Artificial Sequence: Synthetic oligonucleotide
gucaaucuuggccaugcc

SEQ ID NO: 137804 - RNA, 18 nt, Artificial Sequence
  Description of Artificial Sequence: Synthetic oligonucleotide
agguugucaaucuuggcc

SEQ ID NO: 137805 - RNA, 18 nt, Artificial Sequence
  Description of Artificial Sequence: Synthetic oligonucleotide
gcaacagguugucaaucu

SEQ ID NO: 137806 - RNA, 18 nt, Artificial Sequence
  Description of Artificial Sequence: Synthetic oligonucleotide
cuccugcaacagguuguc

SEQ ID NO: 137807 - RNA, 18 nt, Artificial Sequence
  Description of Artificial Sequence: Synthetic oligonucleotide
agcaucuccugcaacagg

SEQ ID NO: 137808 - RNA, 18 nt, Artificial Sequence
  Description of Artificial Sequence: Synthetic oligonucleotide
ccagcagcaucuccugca

SEQ ID NO: 137809 - RNA, 18 nt, Artificial Sequence
  Description of Artificial Sequence: Synthetic oligonucleotide
ucgcucagccccuuggca

SEQ ID NO: 137810 - RNA, 18 nt, Artificial Sequence
  Description of Artificial Sequence: Synthetic oligonucleotide
cuggaucgcucagccccu

SEQ ID NO: 137811 - RNA, 18 nt, Artificial Sequence
  Description of Artificial Sequence: Synthetic oligonucleotide
cuucccuggaucgcucag

SEQ ID NO: 137812 - RNA, 18 nt, Artificial Sequence
  Description of Artificial Sequence: Synthetic oligonucleotide
uugaucuucccuggaucg

SEQ ID NO: 137813 - RNA, 18 nt, Artificial Sequence
  Description of Artificial Sequence: Synthetic oligonucleotide
gccgcuugaucuucccug

SEQ ID NO: 137814 - RNA, 18 nt, Artificial Sequence
  Description of Artificial Sequence: Synthetic oligonucleotide
acgcagccgcuugaucuu

SEQ ID NO: 137815 - RNA, 18 nt, Artificial Sequence
  Description of Artificial Sequence: Synthetic oligonucleotide
ugggaacgcagccgcuug

SEQ ID NO: 137816 - RNA, 18 nt, Artificial Sequence
  Description of Artificial Sequence: Synthetic oligonucleotide
gcaccugggaacgcagcc

SEQ ID NO: 137817 - RNA, 18 nt, Artificial Sequence
  Description of Artificial Sequence: Synthetic oligonucleotide
caccugcaccugggaacg

SEQ ID NO: 137818 - RNA, 18 nt, Artificial Sequence
  Description of Artificial Sequence: Synthetic oligonucleotide
aagcucaccugcaccugg

SEQ ID NO: 137819 - RNA, 18 nt, Artificial Sequence
  Description of Artificial Sequence: Synthetic oligonucleotide
ccuccaagcucaccugca

SEQ ID NO: 137820 - RNA, 18 nt, Artificial Sequence
  Description of Artificial Sequence: Synthetic oligonucleotide
guaguccuccaagcucac

SEQ ID NO: 137821 - RNA, 18 nt, Artificial Sequence
  Description of Artificial Sequence: Synthetic oligonucleotide
uugauguaguccuccaag

SEQ ID NO: 137822 - RNA, 18 nt, Artificial Sequence
  Description of Artificial Sequence: Synthetic oligonucleotide
ggucguugauguaguccu

SEQ ID NO: 137823 - RNA, 18 nt, Artificial Sequence
  Description of Artificial Sequence: Synthetic oligonucleotide
cuggcggucguugaugua

SEQ ID NO: 137824 - RNA, 18 nt, Artificial Sequence
  Description of Artificial Sequence: Synthetic oligonucleotide
ucauacuggcggucguug

SEQ ID NO: 137825 - RNA, 18 nt, Artificial Sequence
  Description of Artificial Sequence: Synthetic oligonucleotide
gcgagucauacuggcggu

SEQ ID NO: 137826 - RNA, 18 nt, Artificial Sequence
  Description of Artificial Sequence: Synthetic oligonucleotide
gccacgcgagucauacug

SEQ ID NO: 137827 - RNA, 18 nt, Artificial Sequence
  Description of Artificial Sequence: Synthetic oligonucleotide
aagcggccacgcgaguca

SEQ ID NO: 137828 - RNA, 18 nt, Artificial Sequence
  Description of Artificial Sequence: Synthetic oligonucleotide
cuccaaagcggccacgcg

SEQ ID NO: 137829 - RNA, 18 nt, Artificial Sequence
  Description of Artificial Sequence: Synthetic oligonucleotide
cagcucuccaaagcggcc

SEQ ID NO: 137830 - RNA, 18 nt, Artificial Sequence
  Description of Artificial Sequence: Synthetic oligonucleotide
agcagcagcucuccaaag

SEQ ID NO: 137831 - RNA, 18 nt, Artificial Sequence
  Description of Artificial Sequence: Synthetic oligonucleotide
gcagcagcagcagcucuc

SEQ ID NO: 137832 - RNA, 18 nt, Artificial Sequence
  Description of Artificial Sequence: Synthetic oligonucleotide
gggcagcagcagcagcag

SEQ ID NO: 137833 - RNA, 18 nt, Artificial Sequence
  Description of Artificial Sequence: Synthetic oligonucleotide
aaggugggcagcagcagc

SEQ ID NO: 137834 - RNA, 18 nt, Artificial Sequence
  Description of Artificial Sequence: Synthetic oligonucleotide
ucugcaaggugggcagca

SEQ ID NO: 137835 - RNA, 18 nt, Artificial Sequence
  Description of Artificial Sequence: Synthetic oligonucleotide
gaugcucugcaagguggg

SEQ ID NO: 137836 - RNA, 18 nt, Artificial Sequence
  Description of Artificial Sequence: Synthetic oligonucleotide
caggugaugcucugcaag

SEQ ID NO: 137837 - RNA, 18 nt, Artificial Sequence
  Description of Artificial Sequence: Synthetic oligonucleotide
ucugccaggugaugcucu

SEQ ID NO: 137838 - RNA, 18 nt, Artificial Sequence
  Description of Artificial Sequence: Synthetic oligonucleotide
gaucaucugccaggugau

SEQ ID NO: 137839 - RNA, 18 nt, Artificial Sequence
  Description of Artificial Sequence: Synthetic oligonucleotide
ugcucgaucaucugccag

SEQ ID NO: 137840 - RNA, 18 nt, Artificial Sequence
  Description of Artificial Sequence: Synthetic oligonucleotide
ggaucugcucgaucaucu

SEQ ID NO: 137841 - RNA, 18 nt, Artificial Sequence
  Description of Artificial Sequence: Synthetic oligonucleotide
gaacuggaucugcucgau

SEQ ID NO: 137842 - RNA, 18 nt, Artificial Sequence
  Description of Artificial Sequence: Synthetic oligonucleotide
uugaugaacuggaucugc

SEQ ID NO: 137843 - RNA, 18 nt, Artificial Sequence
  Description of Artificial Sequence: Synthetic oligonucleotide
agagcuugaugaacugga

SEQ ID NO: 137844 - RNA, 18 nt, Artificial Sequence
  Description of Artificial Sequence: Synthetic oligonucleotide
gccgaagagcuugaugaa

SEQ ID NO: 137845 - RNA, 18 nt, Artificial Sequence
  Description of Artificial Sequence: Synthetic oligonucleotide
gccaugccgaagagcuug

SEQ ID NO: 137846 - RNA, 18 nt, Artificial Sequence
  Description of Artificial Sequence: Synthetic oligonucleotide
ucuuggccaugccgaaga

SEQ ID NO: 137847 - RNA, 18 nt, Artificial Sequence
  Description of Artificial Sequence: Synthetic oligonucleotide
gucaaucuuggccaugcc

SEQ ID NO: 137848 - RNA, 18 nt, Artificial Sequence
  Description of Artificial Sequence: Synthetic oligonucleotide
agguugucaaucuuggcc

SEQ ID NO: 137849 - RNA, 18 nt, Artificial Sequence
  Description of Artificial Sequence: Synthetic oligonucleotide
gcaacagguugucaaucu

SEQ ID NO: 137850 - RNA, 18 nt, Artificial Sequence
  Description of Artificial Sequence: Synthetic oligonucleotide
cuccugcaacagguuguc

SEQ ID NO: 137851 - RNA, 18 nt, Artificial Sequence
  Description of Artificial Sequence: Synthetic oligonucleotide
agcaucuccugcaacagg

SEQ ID NO: 137852 - RNA, 18 nt, Artificial Sequence
  Description of Artificial Sequence: Synthetic oligonucleotide
ccagcagcaucuccugca

SEQ ID NO: 137853 - RNA, 18 nt, Artificial Sequence
  Description of Artificial Sequence: Synthetic oligonucleotide
ccccuccugggcuuggca

SEQ ID NO: 137854 - RNA, 18 nt, Artificial Sequence
  Description of Artificial Sequence: Synthetic oligonucleotide
ccccgccccuccugggcu

SEQ ID NO: 137855 - RNA, 18 nt, Artificial Sequence
  Description of Artificial Sequence: Synthetic oligonucleotide
uccaaccccgccccuccu

SEQ ID NO: 137856 - RNA, 18 nt, Artificial Sequence
  Description of Artificial Sequence: Synthetic oligonucleotide
cccacuccaaccccgccc

SEQ ID NO: 137857 - RNA, 18 nt, Artificial Sequence
  Description of Artificial Sequence: Synthetic oligonucleotide
gaguccccacuccaaccc

SEQ ID NO: 137858 - RNA, 18 nt, Artificial Sequence
  Description of Artificial Sequence: Synthetic oligonucleotide
gggaguccccacuccaac

SEQ ID NO: 137859 - RNA, 18 nt, Artificial Sequence
  Description of Artificial Sequence: Synthetic oligonucleotide
ugaggccugucuccuggg

SEQ ID NO: 137860 - RNA, 18 nt, Artificial Sequence
  Description of Artificial Sequence: Synthetic oligonucleotide
cugugugaggccugucuc

SEQ ID NO: 137861 - RNA, 18 nt, Artificial Sequence
  Description of Artificial Sequence: Synthetic oligonucleotide
gcucacugugugaggccu

SEQ ID NO: 137862 - RNA, 18 nt, Artificial Sequence
  Description of Artificial Sequence: Synthetic oligonucleotide
ggugagcucacuguguga

SEQ ID NO: 137863 - RNA, 18 nt, Artificial Sequence
  Description of Artificial Sequence: Synthetic oligonucleotide
gggugagcucacugugug

SEQ ID NO: 137864 - RNA, 18 nt, Artificial Sequence
  Description of Artificial Sequence: Synthetic oligonucleotide
aagccaaggagcugaggg

SEQ ID NO: 137865 - RNA, 18 nt, Artificial Sequence
  Description of Artificial Sequence: Synthetic oligonucleotide
gggaagccaaggagcuga

SEQ ID NO: 137866 - RNA, 18 nt, Artificial Sequence
  Description of Artificial Sequence: Synthetic oligonucleotide
ccaaagcggcacaguggg

SEQ ID NO: 137867 - RNA, 18 nt, Artificial Sequence
  Description of Artificial Sequence: Synthetic oligonucleotide
cuugcccaaagcggcaca

SEQ ID NO: 137868 - RNA, 18 nt, Artificial Sequence
  Description of Artificial Sequence: Synthetic oligonucleotide
agcaacuugcccaaagcg

SEQ ID NO: 137869 - RNA, 18 nt, Artificial Sequence
  Description of Artificial Sequence: Synthetic oligonucleotide
gguuaagcaacuugccca

SEQ ID NO: 137870 - RNA, 18 nt, Artificial Sequence
  Description of Artificial Sequence: Synthetic oligonucleotide
agacagguuaagcaacuu

SEQ ID NO: 137871 - RNA, 18 nt, Artificial Sequence
  Description of Artificial Sequence: Synthetic oligonucleotide
ggcacagacagguuaagc

SEQ ID NO: 137872 - RNA, 18 nt, Artificial Sequence
  Description of Artificial Sequence: Synthetic oligonucleotide
acugaggcacagacaggu

SEQ ID NO: 137873 - RNA, 18 nt, Artificial Sequence
  Description of Artificial Sequence: Synthetic oligonucleotide
aggaaacugaggcacaga

SEQ ID NO: 137874 - RNA, 18 nt, Artificial Sequence
  Description of Artificial Sequence: Synthetic oligonucleotide
uggugaggaaacugaggc

SEQ ID NO: 137875 - RNA, 18 nt, Artificial Sequence
  Description of Artificial Sequence: Synthetic oligonucleotide
uuuucuggugaggaaacu

SEQ ID NO: 137876 - RNA, 18 nt, Artificial Sequence
  Description of Artificial Sequence: Synthetic oligonucleotide
cccauuuuucuggugagg

SEQ ID NO: 137877 - RNA, 18 nt, Artificial Sequence
  Description of Artificial Sequence: Synthetic oligonucleotide
uuguucccauuuuucugg

SEQ ID NO: 137878 - RNA, 18 nt, Artificial Sequence
  Description of Artificial Sequence: Synthetic oligonucleotide
uugccuuguucccauuuu

SEQ ID NO: 137879 - RNA, 18 nt, Artificial Sequence
  Description of Artificial Sequence: Synthetic oligonucleotide
gaccauugccuuguuccc

SEQ ID NO: 137880 - RNA, 18 nt, Artificial Sequence
  Description of Artificial Sequence: Synthetic oligonucleotide
aaauagaccauugccuug

SEQ ID NO: 137881 - RNA, 18 nt, Artificial Sequence
  Description of Artificial Sequence: Synthetic oligonucleotide
ugaacaaauagaccauug

SEQ ID NO: 137882 - RNA, 18 nt, Artificial Sequence
  Description of Artificial Sequence: Synthetic oligonucleotide
gugccugaacaaauagac

SEQ ID NO: 137883 - RNA, 18 nt, Artificial Sequence
  Description of Artificial Sequence: Synthetic oligonucleotide
ucucggugccugaacaaa

SEQ ID NO: 137884 - RNA, 18 nt, Artificial Sequence
  Description of Artificial Sequence: Synthetic oligonucleotide
uagguucucggugccuga

SEQ ID NO: 137885 - RNA, 18 nt, Artificial Sequence
  Description of Artificial Sequence: Synthetic oligonucleotide
cgugcuagguucucggug

SEQ ID NO: 137886 - RNA, 18 nt, Artificial Sequence
  Description of Artificial Sequence: Synthetic oligonucleotide
uggcacgugcuagguucu

SEQ ID NO: 137887 - RNA, 18 nt, Artificial Sequence
  Description of Artificial Sequence: Synthetic oligonucleotide
gugacuggcacgugcuag

SEQ ID NO: 137888 - RNA, 18 nt, Artificial Sequence
  Description of Artificial Sequence: Synthetic oligonucleotide
gaacagugacuggcacgu

SEQ ID NO: 137889 - RNA, 18 nt, Artificial Sequence
  Description of Artificial Sequence: Synthetic oligonucleotide
acuuagaacagugacugg

SEQ ID NO: 137890 - RNA, 18 nt, Artificial Sequence
  Description of Artificial Sequence: Synthetic oligonucleotide
ccagcacuuagaacagug

SEQ ID NO: 137891 - RNA, 18 nt, Artificial Sequence
  Description of Artificial Sequence: Synthetic oligonucleotide
aauugccagcacuuagaa

SEQ ID NO: 137892 - RNA, 18 nt, Artificial Sequence
  Description of Artificial Sequence: Synthetic oligonucleotide
ugcugaauugccagcacu

SEQ ID NO: 137893 - RNA, 18 nt, Artificial Sequence
  Description of Artificial Sequence: Synthetic oligonucleotide
uucuuugcugaauugcca

SEQ ID NO: 137894 - RNA, 18 nt, Artificial Sequence
  Description of Artificial Sequence: Synthetic oligonucleotide
ucuuguucuuugcugaau

SEQ ID NO: 137895 - RNA, 18 nt, Artificial Sequence
  Description of Artificial Sequence: Synthetic oligonucleotide
aaagaucuuguucuuugc

SEQ ID NO: 137896 - RNA, 18 nt, Artificial Sequence
  Description of Artificial Sequence: Synthetic oligonucleotide
agggcaaagaucuuguuc

SEQ ID NO: 137897 - RNA, 18 nt, Artificial Sequence
  Description of Artificial Sequence: Synthetic oligonucleotide
ccccgagggcaaagaucu

SEQ ID NO: 137898 - RNA, 18 nt, Artificial Sequence
  Description of Artificial Sequence: Synthetic oligonucleotide
agccuccccgagggcaaa

SEQ ID NO: 137899 - RNA, 18 nt, Artificial Sequence
  Description of Artificial Sequence: Synthetic oligonucleotide
cacacagccuccccgagg

SEQ ID NO: 137900 - RNA, 18 nt, Artificial Sequence
  Description of Artificial Sequence: Synthetic oligonucleotide
acacacacacagccuccc

SEQ ID NO: 137901 - RNA, 18 nt, Artificial Sequence
  Description of Artificial Sequence: Synthetic oligonucleotide
uacucacacacacacagc

SEQ ID NO: 137902 - RNA, 18 nt, Artificial Sequence
  Description of Artificial Sequence: Synthetic oligonucleotide
auacauacucacacacac

SEQ ID NO: 137903 - RNA, 18 nt, Artificial Sequence
  Description of Artificial Sequence: Synthetic oligonucleotide
cauccauacauacucaca

SEQ ID NO: 137904 - RNA, 18 nt, Artificial Sequence
  Description of Artificial Sequence: Synthetic oligonucleotide
ccacgcauccauacauac

SEQ ID NO: 137905 - RNA, 18 nt, Artificial Sequence
  Description of Artificial Sequence: Synthetic oligonucleotide
gauauccacgcauccaua

SEQ ID NO: 137906 - RNA, 18 nt, Artificial Sequence
  Description of Artificial Sequence: Synthetic oligonucleotide
acacagauauccacgcau

SEQ ID NO: 137907 - RNA, 18 nt, Artificial Sequence
  Description of Artificial Sequence: Synthetic oligonucleotide
cauauacacagauaucca

SEQ ID NO: 137908 - RNA, 18 nt, Artificial Sequence
  Description of Artificial Sequence: Synthetic oligonucleotide
acgggcauauacacagau

SEQ ID NO: 137909 - RNA, 18 nt, Artificial Sequence
  Description of Artificial Sequence: Synthetic oligonucleotide
cacauacgggcauauaca

SEQ ID NO: 137910 - RNA, 18 nt, Artificial Sequence
  Description of Artificial Sequence: Synthetic oligonucleotide
gcacgcacauacgggcau

SEQ ID NO: 137911 - RNA, 18 nt, Artificial Sequence
  Description of Artificial Sequence: Synthetic oligonucleotide
cacaugcacgcacauacg

SEQ ID NO: 137912 - RNA, 18 nt, Artificial Sequence
  Description of Artificial Sequence: Synthetic oligonucleotide
auauacacaugcacgcac

SEQ ID NO: 137913 - RNA, 18 nt, Artificial Sequence
  Description of Artificial Sequence: Synthetic oligonucleotide
gcuuuauauacacaugca

SEQ ID NO: 137914 - RNA, 18 nt, Artificial Sequence
  Description of Artificial Sequence: Synthetic oligonucleotide
gugaggcuuuauauacac

SEQ ID NO: 137915 - RNA, 18 nt, Artificial Sequence
  Description of Artificial Sequence: Synthetic oligonucleotide
aaaaugugaggcuuuaua

SEQ ID NO: 137916 - RNA, 18 nt, Artificial Sequence
  Description of Artificial Sequence: Synthetic oligonucleotide
aucauaaaaugugaggcu

SEQ ID NO: 137917 - RNA, 18 nt, Artificial Sequence
  Description of Artificial Sequence: Synthetic oligonucleotide
ucaaaaucauaaaaugug

SEQ ID NO: 137918 - RNA, 18 nt, Artificial Sequence
  Description of Artificial Sequence: Synthetic oligonucleotide
uuauuucaaaaucauaaa

SEQ ID NO: 137919 - RNA, 18 nt, Artificial Sequence
  Description of Artificial Sequence: Synthetic oligonucleotide
ccuguuuauuucaaaauc

SEQ ID NO: 137920 - RNA, 18 nt, Artificial Sequence
  Description of Artificial Sequence: Synthetic oligonucleotide
uauuaccuguuuauuuca

SEQ ID NO: 137921 - RNA, 18 nt, Artificial Sequence
  Description of Artificial Sequence: Synthetic oligonucleotide
uaucauauuaccuguuua

SEQ ID NO: 137922 - RNA, 18 nt, Artificial Sequence
  Description of Artificial Sequence: Synthetic oligonucleotide
aacucuaucauauuaccu

SEQ ID NO: 137923 - RNA, 18 nt, Artificial Sequence
  Description of Artificial Sequence: Synthetic oligonucleotide
aguuaaacucuaucauau

SEQ ID NO: 137924 - RNA, 18 nt, Artificial Sequence
  Description of Artificial Sequence: Synthetic oligonucleotide
uuuucaguuaaacucuau

SEQ ID NO: 137925 - RNA, 18 nt, Artificial Sequence
  Description of Artificial Sequence: Synthetic oligonucleotide
auuccuuuucaguuaaac

SEQ ID NO: 137926 - RNA, 18 nt, Artificial Sequence
  Description of Artificial Sequence: Synthetic oligonucleotide
agaggauuccuuuucagu

SEQ ID NO: 137927 - RNA, 18 nt, Artificial Sequence
  Description of Artificial Sequence: Synthetic oligonucleotide
ucuaaagaggauuccuuu

SEQ ID NO: 137928 - RNA, 18 nt, Artificial Sequence
  Description of Artificial Sequence: Synthetic oligonucleotide
cccuaucuaaagaggauu

SEQ ID NO: 137929 - RNA, 18 nt, Artificial Sequence
  Description of Artificial Sequence: Synthetic oligonucleotide
gccuccccuaucuaaaga

SEQ ID NO: 137930 - RNA, 18 nt, Artificial Sequence
  Description of Artificial Sequence: Synthetic oligonucleotide
cuguggccuccccuaucu

SEQ ID NO: 137931 - RNA, 18 nt, Artificial Sequence
  Description of Artificial Sequence: Synthetic oligonucleotide
gucuccuguggccucccc

SEQ ID NO: 137932 - RNA, 18 nt, Artificial Sequence
  Description of Artificial Sequence: Synthetic oligonucleotide
gagaggucuccuguggcc

SEQ ID NO: 137933 - RNA, 18 nt, Artificial Sequence
  Description of Artificial Sequence: Synthetic oligonucleotide
cuucagagaggucuccug

SEQ ID NO: 137934 - RNA, 18 nt, Artificial Sequence
  Description of Artificial Sequence: Synthetic oligonucleotide
caccacuucagagagguc

SEQ ID NO: 137935 - RNA, 18 nt, Artificial Sequence
  Description of Artificial Sequence: Synthetic oligonucleotide
agagucaccacuucagag

SEQ ID NO: 137936 - RNA, 18 nt, Artificial Sequence
  Description of Artificial Sequence: Synthetic oligonucleotide
gcacaagagucaccacuu

SEQ ID NO: 137937 - RNA, 18 nt, Artificial Sequence
  Description of Artificial Sequence: Synthetic oligonucleotide
ucuuagcacaagagucac

SEQ ID NO: 137938 - RNA, 18 nt, Artificial Sequence
  Description of Artificial Sequence: Synthetic oligonucleotide
uagggucuuagcacaaga

SEQ ID NO: 137939 - RNA, 18 nt, Artificial Sequence
  Description of Artificial Sequence: Synthetic oligonucleotide
gccguuagggucuuagca

SEQ ID NO: 137940 - RNA, 18 nt, Artificial Sequence
  Description of Artificial Sequence: Synthetic oligonucleotide
uuucagccguuagggucu

SEQ ID NO: 137941 - RNA, 18 nt, Artificial Sequence
  Description of Artificial Sequence: Synthetic oligonucleotide
uuuccuuucagccguuag

SEQ ID NO: 137942 - RNA, 18 nt, Artificial Sequence
  Description of Artificial Sequence: Synthetic oligonucleotide
uuccauuuccuuucagcc

SEQ ID NO: 137943 - RNA, 18 nt, Artificial Sequence
  Description of Artificial Sequence: Synthetic oligonucleotide
aagccuuccauuuccuuu

SEQ ID NO: 137944 - RNA, 18 nt, Artificial Sequence
  Description of Artificial Sequence: Synthetic oligonucleotide
cuuuuaagccuuccauuu

SEQ ID NO: 137945 - RNA, 18 nt, Artificial Sequence
  Description of Artificial Sequence: Synthetic oligonucleotide
cuugucuuuuaagccuuc

SEQ ID NO: 137946 - RNA, 18 nt, Artificial Sequence
  Description of Artificial Sequence: Synthetic oligonucleotide
ccucucuugucuuuuaag

SEQ ID NO: 137947 - RNA, 18 nt, Artificial Sequence
  Description of Artificial Sequence: Synthetic oligonucleotide
auauuccucucuugucuu

SEQ ID NO: 137948 - RNA, 18 nt, Artificial Sequence
  Description of Artificial Sequence: Synthetic oligonucleotide
guuuuuccaccccaaacc

SEQ ID NO: 137949 - RNA, 18 nt, Artificial Sequence
  Description of Artificial Sequence: Synthetic oligonucleotide
gagauguuuuuccacccc

SEQ ID NO: 137950 - RNA, 18 nt, Artificial Sequence
  Description of Artificial Sequence: Synthetic oligonucleotide
ugucagagauguuuuucc

SEQ ID NO: 137951 - RNA, 18 nt, Artificial Sequence
  Description of Artificial Sequence: Synthetic oligonucleotide
gcuucugucagagauguu

SEQ ID NO: 137952 - RNA, 18 nt, Artificial Sequence
  Description of Artificial Sequence: Synthetic oligonucleotide
uuguugcuucugucagag

SEQ ID NO: 137953 - RNA, 18 nt, Artificial Sequence
  Description of Artificial Sequence: Synthetic oligonucleotide
ucacguuguugcuucugu

SEQ ID NO: 137954 - RNA, 18 nt, Artificial Sequence
  Description of Artificial Sequence: Synthetic oligonucleotide
ucugcucacguuguugcu

SEQ ID NO: 137955 - RNA, 18 nt, Artificial Sequence
  Description of Artificial Sequence: Synthetic oligonucleotide
augcuucugcucacguug

SEQ ID NO: 137956 - RNA, 18 nt, Artificial Sequence
  Description of Artificial Sequence: Synthetic oligonucleotide
ucucuaugcuucugcuca

SEQ ID NO: 137957 - RNA, 18 nt, Artificial Sequence
  Description of Artificial Sequence: Synthetic oligonucleotide
uucuaucucuaugcuucu

SEQ ID NO: 137958 - RNA, 18 nt, Artificial Sequence
  Description of Artificial Sequence: Synthetic oligonucleotide
uguuuuucuaucucuaug

SEQ ID NO: 137959 - RNA, 18 nt, Artificial Sequence
  Description of Artificial Sequence: Synthetic oligonucleotide
cccuguguuuuucuaucu

SEQ ID NO: 137960 - RNA, 18 nt, Artificial Sequence
  Description of Artificial Sequence: Synthetic oligonucleotide
guguccccuguguuuuuc

SEQ ID NO: 137961 - RNA, 18 nt, Artificial Sequence
  Description of Artificial Sequence: Synthetic oligonucleotide
ucuauguguccccugugu

SEQ ID NO: 137962 - RNA, 18 nt, Artificial Sequence
  Description of Artificial Sequence: Synthetic oligonucleotide
uagcaucuaugugucccc

SEQ ID NO: 137963 - RNA, 18 nt, Artificial Sequence
  Description of Artificial Sequence: Synthetic oligonucleotide
acuuauagcaucuaugug

SEQ ID NO: 137964 - RNA, 18 nt, Artificial Sequence
  Description of Artificial Sequence: Synthetic oligonucleotide
gaccuacuuauagcaucu

SEQ ID NO: 137965 - RNA, 18 nt, Artificial Sequence
  Description of Artificial Sequence: Synthetic oligonucleotide
caacugaccuacuuauag

SEQ ID NO: 137966 - RNA, 18 nt, Artificial Sequence
  Description of Artificial Sequence: Synthetic oligonucleotide
gcagccaacugaccuacu

SEQ ID NO: 137967 - RNA, 18 nt, Artificial Sequence
  Description of Artificial Sequence: Synthetic oligonucleotide
cugcugcagccaacugac

SEQ ID NO: 137968 - RNA, 18 nt, Artificial Sequence
  Description of Artificial Sequence: Synthetic oligonucleotide
caucucugcugcagccaa

SEQ ID NO: 137969 - RNA, 18 nt, Artificial Sequence
  Description of Artificial Sequence: Synthetic oligonucleotide
ccccacaucucugcugca

SEQ ID NO: 137970 - RNA, 18 nt, Artificial Sequence
  Description of Artificial Sequence: Synthetic oligonucleotide
ucaucccccacaucucug

SEQ ID NO: 137971 - RNA, 18 nt, Artificial Sequence
  Description of Artificial Sequence: Synthetic oligonucleotide
cagccucaucccccacau

SEQ ID NO: 137972 - RNA, 18 nt, Artificial Sequence
  Description of Artificial Sequence: Synthetic oligonucleotide
ccuuucagccucaucccc

SEQ ID NO: 137973 - RNA, 18 nt, Artificial Sequence
  Description of Artificial Sequence: Synthetic oligonucleotide
ccucaccuuucagccuca

SEQ ID NO: 137974 - RNA, 18 nt, Artificial Sequence
  Description of Artificial Sequence: Synthetic oligonucleotide
ucccgccucaccuuucag

SEQ ID NO: 137975 - RNA, 18 nt, Artificial Sequence
  Description of Artificial Sequence: Synthetic oligonucleotide
uuuggucccgccucaccu

SEQ ID NO: 137976 - RNA, 18 nt, Artificial Sequence
  Description of Artificial Sequence: Synthetic oligonucleotide
aaccauuuggucccgccu

SEQ ID NO: 137977 - RNA, 18 nt, Artificial Sequence
  Description of Artificial Sequence: Synthetic oligonucleotide
ccuucaaccauuuggucc

SEQ ID NO: 137978 - RNA, 18 nt, Artificial Sequence
  Description of Artificial Sequence: Synthetic oligonucleotide
caaguccuucaaccauuu

SEQ ID NO: 137979 - RNA, 18 nt, Artificial Sequence
  Description of Artificial Sequence: Synthetic oligonucleotide
gagugcaaguccuucaac

SEQ ID NO: 137980 - RNA, 18 nt, Artificial Sequence
  Description of Artificial Sequence: Synthetic oligonucleotide
ccuuggagugcaaguccu

SEQ ID NO: 137981 - RNA, 18 nt, Artificial Sequence
  Description of Artificial Sequence: Synthetic oligonucleotide
aagcuccuuggagugcaa

SEQ ID NO: 137982 - RNA, 18 nt, Artificial Sequence
  Description of Artificial Sequence: Synthetic oligonucleotide
ucucaaagcuccuuggag

SEQ ID NO: 137983 - RNA, 18 nt, Artificial Sequence
  Description of Artificial Sequence: Synthetic oligonucleotide
auggcucucaaagcuccu

SEQ ID NO: 137984 - RNA, 18 nt, Artificial Sequence
  Description of Artificial Sequence: Synthetic oligonucleotide
aaucaauggcucucaaag

SEQ ID NO: 137985 - RNA, 18 nt, Artificial Sequence
  Description of Artificial Sequence: Synthetic oligonucleotide
gauguaaucaauggcucu

SEQ ID NO: 137986 - RNA, 18 nt, Artificial Sequence
  Description of Artificial Sequence: Synthetic oligonucleotide
uaauggauguaaucaaug

SEQ ID NO: 137987 - RNA, 18 nt, Artificial Sequence
  Description of Artificial Sequence: Synthetic oligonucleotide
uaacauaauggauguaau

SEQ ID NO: 137988 - RNA, 18 nt, Artificial Sequence
  Description of Artificial Sequence: Synthetic oligonucleotide
cauaguaacauaauggau

SEQ ID NO: 137989 - RNA, 18 nt, Artificial Sequence
  Description of Artificial Sequence: Synthetic oligonucleotide
ggucacauaguaacauaa

SEQ ID NO: 137990 - RNA, 18 nt, Artificial Sequence
  Description of Artificial Sequence: Synthetic oligonucleotide
guauuggucacauaguaa

SEQ ID NO: 137991 - RNA, 18 nt, Artificial Sequence
  Description of Artificial Sequence: Synthetic oligonucleotide
guaguguauuggucacau

SEQ ID NO: 137992 - RNA, 18 nt, Artificial Sequence
  Description of Artificial Sequence: Synthetic oligonucleotide
aaugaguaguguauuggu

SEQ ID NO: 137993 - RNA, 18 nt, Artificial Sequence
  Description of Artificial Sequence: Synthetic oligonucleotide
guucuaaugaguagugua

SEQ ID NO: 137994 - RNA, 18 nt, Artificial Sequence
  Description of Artificial Sequence: Synthetic oligonucleotide
uaaauguucuaaugagua

SEQ ID NO: 137995 - RNA, 18 nt, Artificial Sequence
  Description of Artificial Sequence: Synthetic oligonucleotide
ucacguaaauguucuaau

SEQ ID NO: 137996 - RNA, 18 nt, Artificial Sequence
  Description of Artificial Sequence: Synthetic oligonucleotide
ugagaucacguaaauguu

SEQ ID NO: 137997 - RNA, 18 nt, Artificial Sequence
  Description of Artificial Sequence: Synthetic oligonucleotide
agcucugagaucacguaa

SEQ ID NO: 137998 - RNA, 18 nt, Artificial Sequence
  Description of Artificial Sequence: Synthetic oligonucleotide
aaggaagcucugagauca

SEQ ID NO: 137999 - RNA, 18 nt, Artificial Sequence
  Description of Artificial Sequence: Synthetic oligonucleotide
cauauaaggaagcucuga

SEQ ID NO: 138000 - RNA, 18 nt, Artificial Sequence
  Description of Artificial Sequence: Synthetic oligonucleotide
aggugcauauaaggaagc

SEQ ID NO: 138001 - RNA, 18 nt, Artificial Sequence
  Description of Artificial Sequence: Synthetic oligonucleotide
gaacaaggugcauauaag

SEQ ID NO: 138002 - RNA, 18 nt, Artificial Sequence
  Description of Artificial Sequence: Synthetic oligonucleotide
gaaaggaacaaggugcau

SEQ ID NO: 138003 - RNA, 18 nt, Artificial Sequence
  Description of Artificial Sequence: Synthetic oligonucleotide
gaguugaaaggaacaagg

SEQ ID NO: 138004 - RNA, 18 nt, Artificial Sequence
  Description of Artificial Sequence: Synthetic oligonucleotide
aaagugaguugaaaggaa

SEQ ID NO: 138005 - RNA, 18 nt, Artificial Sequence
  Description of Artificial Sequence: Synthetic oligonucleotide
gaacaaaagugaguugaa

SEQ ID NO: 138006 - RNA, 18 nt, Artificial Sequence
  Description of Artificial Sequence: Synthetic oligonucleotide
caagagaacaaaagugag

SEQ ID NO: 138007 - RNA, 18 nt, Artificial Sequence
  Description of Artificial Sequence: Synthetic oligonucleotide
aaaaccaagagaacaaaa

SEQ ID NO: 138008 - RNA, 18 nt, Artificial Sequence
  Description of Artificial Sequence: Synthetic oligonucleotide
cccaaaaaaccaagagaa

SEQ ID NO: 138009 - RNA, 18 nt, Artificial Sequence
  Description of Artificial Sequence: Synthetic oligonucleotide
aggaccccaaaaaaccaa

SEQ ID NO: 138010 - RNA, 18 nt, Artificial Sequence
  Description of Artificial Sequence: Synthetic oligonucleotide
uuaagaggaccccaaaaa

SEQ ID NO: 138011 - RNA, 18 nt, Artificial Sequence
  Description of Artificial Sequence: Synthetic oligonucleotide
ggguguuaagaggacccc

SEQ ID NO: 138012 - RNA, 18 nt, Artificial Sequence
  Description of Artificial Sequence: Synthetic oligonucleotide
caugaggguguuaagagg

SEQ ID NO: 138013 - RNA, 18 nt, Artificial Sequence
  Description of Artificial Sequence: Synthetic oligonucleotide
gacuucaugaggguguua

SEQ ID NO: 138014 - RNA, 18 nt, Artificial Sequence
  Description of Artificial Sequence: Synthetic oligonucleotide
cuauagacuucaugaggg

SEQ ID NO: 138015 - RNA, 18 nt, Artificial Sequence
  Description of Artificial Sequence: Synthetic oligonucleotide
cccaucuauagacuucau

SEQ ID NO: 138016 - RNA, 18 nt, Artificial Sequence
  Description of Artificial Sequence: Synthetic oligonucleotide
ccauucccaucuauagac

SEQ ID NO: 138017 - RNA, 18 nt, Artificial Sequence
  Description of Artificial Sequence: Synthetic oligonucleotide
guguaccauucccaucua

SEQ ID NO: 138018 - RNA, 18 nt, Artificial Sequence
  Description of Artificial Sequence: Synthetic oligonucleotide
cuaggguguaccauuccc

SEQ ID NO: 138019 - RNA, 18 nt, Artificial Sequence
  Description of Artificial Sequence: Synthetic oligonucleotide
guaaacuaggguguacca

SEQ ID NO: 138020 - RNA, 18 nt, Artificial Sequence
  Description of Artificial Sequence: Synthetic oligonucleotide
gguuaguaaacuagggug

SEQ ID NO: 138021 - RNA, 18 nt, Artificial Sequence
  Description of Artificial Sequence: Synthetic oligonucleotide
uccuggguuaguaaacua

SEQ ID NO: 138022 - RNA, 18 nt, Artificial Sequence
  Description of Artificial Sequence: Synthetic oligonucleotide
ccuauuccuggguuagua

SEQ ID NO: 138023 - RNA, 18 nt, Artificial Sequence
  Description of Artificial Sequence: Synthetic oligonucleotide
ggguaccuauuccugggu

SEQ ID NO: 138024 - RNA, 18 nt, Artificial Sequence
  Description of Artificial Sequence: Synthetic oligonucleotide
cuguuggguaccuauucc

SEQ ID NO: 138025 - RNA, 18 nt, Artificial Sequence
  Description of Artificial Sequence: Synthetic oligonucleotide
agugccuguuggguaccu

SEQ ID NO: 138026 - RNA, 18 nt, Artificial Sequence
  Description of Artificial Sequence: Synthetic oligonucleotide
uuggcagugccuguuggg

SEQ ID NO: 138027 - RNA, 18 nt, Artificial Sequence
  Description of Artificial Sequence: Synthetic oligonucleotide
caauauuggcagugccug

SEQ ID NO: 138028 - RNA, 18 nt, Artificial Sequence
  Description of Artificial Sequence: Synthetic oligonucleotide
ccauccaauauuggcagu

SEQ ID NO: 138029 - RNA, 18 nt, Artificial Sequence
  Description of Artificial Sequence: Synthetic oligonucleotide
ccagcccauccaauauug

SEQ ID NO: 138030 - RNA, 18 nt, Artificial Sequence
  Description of Artificial Sequence: Synthetic oligonucleotide
aucaaccagcccauccaa

SEQ ID NO: 138031 - RNA, 18 nt, Artificial Sequence
  Description of Artificial Sequence: Synthetic oligonucleotide
ggccaaucaaccagccca

SEQ ID NO: 138032 - RNA, 18 nt, Artificial Sequence
  Description of Artificial Sequence: Synthetic oligonucleotide
ggcguggccaaucaacca

SEQ ID NO: 138033 - RNA, 18 nt, Artificial Sequence
  Description of Artificial Sequence: Synthetic oligonucleotide
ccucaggcguggccaauc

SEQ ID NO: 138034 - RNA, 18 nt, Artificial Sequence
  Description of Artificial Sequence: Synthetic oligonucleotide
aucuuccucaggcguggc

SEQ ID NO: 138035 - RNA, 18 nt, Artificial Sequence
  Description of Artificial Sequence: Synthetic oligonucleotide
acgccaucuuccucaggc

SEQ ID NO: 138036 - RNA, 18 nt, Artificial Sequence
  Description of Artificial Sequence: Synthetic oligonucleotide
uugggacgccaucuuccu

SEQ ID NO: 138037 - RNA, 18 nt, Artificial Sequence
  Description of Artificial Sequence: Synthetic oligonucleotide
aggccuugggacgccauc

SEQ ID NO: 138038 - RNA, 18 nt, Artificial Sequence
  Description of Artificial Sequence: Synthetic oligonucleotide
accucaggccuugggacg

SEQ ID NO: 138039 - RNA, 18 nt, Artificial Sequence
  Description of Artificial Sequence: Synthetic oligonucleotide
ugcagaccucaggccuug

SEQ ID NO: 138040 - RNA, 18 nt, Artificial Sequence
  Description of Artificial Sequence: Synthetic oligonucleotide
ugggaugcagaccucagg

SEQ ID NO: 138041 - RNA, 18 nt, Artificial Sequence
  Description of Artificial Sequence: Synthetic oligonucleotide
gagucugggaugcagacc

SEQ ID NO: 138042 - RNA, 18 nt, Artificial Sequence
  Description of Artificial Sequence: Synthetic oligonucleotide
auggagagucugggaugc

SEQ ID NO: 138043 - RNA, 18 nt, Artificial Sequence
  Description of Artificial Sequence: Synthetic oligonucleotide
ucaggauggagagucugg

SEQ ID NO: 138044 - RNA, 18 nt, Artificial Sequence
  Description of Artificial Sequence: Synthetic oligonucleotide
gucgaucaggauggagag

SEQ ID NO: 138045 - RNA, 18 nt, Artificial Sequence
  Description of Artificial Sequence: Synthetic oligonucleotide
gcaucaggugagggugca

SEQ ID NO: 138046 - RNA, 18 nt, Artificial Sequence
  Description of Artificial Sequence: Synthetic oligonucleotide
uuccugcaucaggugagg

SEQ ID NO: 138047 - RNA, 18 nt, Artificial Sequence
  Description of Artificial Sequence: Synthetic oligonucleotide
auauguuccugcaucagg

SEQ ID NO: 138048 - RNA, 18 nt, Artificial Sequence
  Description of Artificial Sequence: Synthetic oligonucleotide
uucccauauguuccugca

SEQ ID NO: 138049 - RNA, 18 nt, Artificial Sequence
  Description of Artificial Sequence: Synthetic oligonucleotide
guugguucccauauguuc

SEQ ID NO: 138050 - RNA, 18 nt, Artificial Sequence
  Description of Artificial Sequence: Synthetic oligonucleotide
augacguugguucccaua

SEQ ID NO: 138051 - RNA, 18 nt, Artificial Sequence
  Description of Artificial Sequence: Synthetic oligonucleotide
caacgaugacguugguuc

SEQ ID NO: 138052 - RNA, 18 nt, Artificial Sequence
  Description of Artificial Sequence: Synthetic oligonucleotide
guuggcaacgaugacguu

SEQ ID NO: 138053 - RNA, 18 nt, Artificial Sequence
  Description of Artificial Sequence: Synthetic oligonucleotide
auuguguuggcaacgaug

SEQ ID NO: 138054 - RNA, 18 nt, Artificial Sequence
  Description of Artificial Sequence: Synthetic oligonucleotide
ugggcauuguguuggcaa

SEQ ID NO: 138055 - RNA, 18 nt, Artificial Sequence
  Description of Artificial Sequence: Synthetic oligonucleotide
gugagugggcauuguguu

SEQ ID NO: 138056 - RNA, 18 nt, Artificial Sequence
  Description of Artificial Sequence: Synthetic oligonucleotide
cugaggugagugggcauu

SEQ ID NO: 138057 - RNA, 18 nt, Artificial Sequence
  Description of Artificial Sequence: Synthetic oligonucleotide
cguugcugaggugagugg

SEQ ID NO: 138058 - RNA, 18 nt, Artificial Sequence
  Description of Artificial Sequence: Synthetic oligonucleotide
cuguccguugcugaggug

SEQ ID NO: 138059 - RNA, 18 nt, Artificial Sequence
  Description of Artificial Sequence: Synthetic oligonucleotide
ucaggugagggugcaggg

SEQ ID NO: 138060 - RNA, 18 nt, Artificial Sequence
  Description of Artificial Sequence: Synthetic oligonucleotide
ugcaucaggugagggugc

SEQ ID NO: 138061 - RNA, 18 nt, Artificial Sequence
  Description of Artificial Sequence: Synthetic oligonucleotide
guuccugcaucaggugag

SEQ ID NO: 138062 - RNA, 18 nt, Artificial Sequence
  Description of Artificial Sequence: Synthetic oligonucleotide
cauauguuccugcaucag

SEQ ID NO: 138063 - RNA, 18 nt, Artificial Sequence
  Description of Artificial Sequence: Synthetic oligonucleotide
guucccauauguuccugc

SEQ ID NO: 138064 - RNA, 18 nt, Artificial Sequence
  Description of Artificial Sequence: Synthetic oligonucleotide
cguugguucccauauguu

SEQ ID NO: 138065 - RNA, 18 nt, Artificial Sequence
  Description of Artificial Sequence: Synthetic oligonucleotide
gaugacguugguucccau

SEQ ID NO: 138066 - RNA, 18 nt, Artificial Sequence
  Description of Artificial Sequence: Synthetic oligonucleotide
gcaacgaugacguugguu

SEQ ID NO: 138067 - RNA, 18 nt, Artificial Sequence
  Description of Artificial Sequence: Synthetic oligonucleotide
uguuggcaacgaugacgu

SEQ ID NO: 138068 - RNA, 18 nt, Artificial Sequence
  Description of Artificial Sequence: Synthetic oligonucleotide
cauuguguuggcaacgau

SEQ ID NO: 138069 - RNA, 18 nt, Artificial Sequence
  Description of Artificial Sequence: Synthetic oligonucleotide
gugggcauuguguuggca

SEQ ID NO: 138070 - RNA, 18 nt, Artificial Sequence
  Description of Artificial Sequence: Synthetic oligonucleotide
ggugagugggcauugugu

SEQ ID NO: 138071 - RNA, 18 nt, Artificial Sequence
  Description of Artificial Sequence: Synthetic oligonucleotide
gcugaggugagugggcau

SEQ ID NO: 138072 - RNA, 18 nt, Artificial Sequence
  Description of Artificial Sequence: Synthetic oligonucleotide
ccguugcugaggugagug

SEQ ID NO: 138073 - RNA, 18 nt, Artificial Sequence
  Description of Artificial Sequence: Synthetic oligonucleotide
ucuguccguugcugaggu

SEQ ID NO: 138074 - RNA, 18 nt, Artificial Sequence
  Description of Artificial Sequence: Synthetic oligonucleotide
gccuguccccugggucgg

SEQ ID NO: 138075 - RNA, 18 nt, Artificial Sequence
  Description of Artificial Sequence: Synthetic oligonucleotide
caccugccuguccccugg

SEQ ID NO: 138076 - RNA, 18 nt, Artificial Sequence
  Description of Artificial Sequence: Synthetic oligonucleotide
uugcccaccugccugucc

SEQ ID NO: 138077 - RNA, 18 nt, Artificial Sequence
  Description of Artificial Sequence: Synthetic oligonucleotide
agaguuugcccaccugcc

SEQ ID NO: 138078 - RNA, 18 nt, Artificial Sequence
  Description of Artificial Sequence: Synthetic oligonucleotide
aucccagaguuugcccac

SEQ ID NO: 138079 - RNA, 18 nt, Artificial Sequence
  Description of Artificial Sequence: Synthetic oligonucleotide
guaaaaucccagaguuug

SEQ ID NO: 138080 - RNA, 18 nt, Artificial Sequence
  Description of Artificial Sequence: Synthetic oligonucleotide
gcaagguaaaaucccaga

SEQ ID NO: 138081 - RNA, 18 nt, Artificial Sequence
  Description of Artificial Sequence: Synthetic oligonucleotide
ccuuugcaagguaaaauc

SEQ ID NO: 138082 - RNA, 18 nt, Artificial Sequence
  Description of Artificial Sequence: Synthetic oligonucleotide
cucacccuuugcaaggua

SEQ ID NO: 138083 - RNA, 18 nt, Artificial Sequence
  Description of Artificial Sequence: Synthetic oligonucleotide
ccauccucacccuuugca

SEQ ID NO: 138084 - RNA, 18 nt, Artificial Sequence
  Description of Artificial Sequence: Synthetic oligonucleotide
aagccccauccucacccu

SEQ ID NO: 138085 - RNA, 18 nt, Artificial Sequence
  Description of Artificial Sequence: Synthetic oligonucleotide
gucuuaagccccauccuc

SEQ ID NO: 138086 - RNA, 18 nt, Artificial Sequence
  Description of Artificial Sequence: Synthetic oligonucleotide
cuccugucuuaagcccca

SEQ ID NO: 138087 - RNA, 18 nt, Artificial Sequence
  Description of Artificial Sequence: Synthetic oligonucleotide
ccugccuccugucuuaag

SEQ ID NO: 138088 - RNA, 18 nt, Artificial Sequence
  Description of Artificial Sequence: Synthetic oligonucleotide
uuucuccugccuccuguc

SEQ ID NO: 138089 - RNA, 18 nt, Artificial Sequence
  Description of Artificial Sequence: Synthetic oligonucleotide
uccacuuucuccugccuc

SEQ ID NO: 138090 - RNA, 18 nt, Artificial Sequence
  Description of Artificial Sequence: Synthetic oligonucleotide
uagacuccacuuucuccu

SEQ ID NO: 138091 - RNA, 18 nt, Artificial Sequence
  Description of Artificial Sequence: Synthetic oligonucleotide
ccuucuagacuccacuuu

SEQ ID NO: 138092 - RNA, 18 nt, Artificial Sequence
  Description of Artificial Sequence: Synthetic oligonucleotide
uucuaccuucuagacucc

SEQ ID NO: 138093 - RNA, 18 nt, Artificial Sequence
  Description of Artificial Sequence: Synthetic oligonucleotide
ccugguucuaccuucuag

SEQ ID NO: 138094 - RNA, 18 nt, Artificial Sequence
  Description of Artificial Sequence: Synthetic oligonucleotide
ugcauccugguucuaccu

SEQ ID NO: 138095 - RNA, 18 nt, Artificial Sequence
  Description of Artificial Sequence: Synthetic oligonucleotide
acuguugcauccugguuc

SEQ ID NO: 138096 - RNA, 18 nt, Artificial Sequence
  Description of Artificial Sequence: Synthetic oligonucleotide
agaaaacuguugcauccu

SEQ ID NO: 138097 - RNA, 18 nt, Artificial Sequence
  Description of Artificial Sequence: Synthetic oligonucleotide
aacccagaaaacuguugc

SEQ ID NO: 138098 - RNA, 18 nt, Artificial Sequence
  Description of Artificial Sequence: Synthetic oligonucleotide
ccuggaacccagaaaacu

SEQ ID NO: 138099 - RNA, 18 nt, Artificial Sequence
  Description of Artificial Sequence: Synthetic oligonucleotide
ccuacccuggaacccaga

SEQ ID NO: 138100 - RNA, 18 nt, Artificial Sequence
  Description of Artificial Sequence: Synthetic oligonucleotide
uauucccuacccuggaac

SEQ ID NO: 138101 - RNA, 18 nt, Artificial Sequence
  Description of Artificial Sequence: Synthetic oligonucleotide
cccuuuauucccuacccu

SEQ ID NO: 138102 - RNA, 18 nt, Artificial Sequence
  Description of Artificial Sequence: Synthetic oligonucleotide
ucuugcccuuuauucccu

SEQ ID NO: 138103 - RNA, 18 nt, Artificial Sequence
  Description of Artificial Sequence: Synthetic oligonucleotide
gacaaucuugcccuuuau

SEQ ID NO: 138104 - RNA, 18 nt, Artificial Sequence
  Description of Artificial Sequence: Synthetic oligonucleotide
aaauggacaaucuugccc

SEQ ID NO: 138105 - RNA, 18 nt, Artificial Sequence
  Description of Artificial Sequence: Synthetic oligonucleotide
ucaacaaauggacaaucu

SEQ ID NO: 138106 - RNA, 18 nt, Artificial Sequence
  Description of Artificial Sequence: Synthetic oligonucleotide
cagccucaacaaauggac

SEQ ID NO: 138107 - RNA, 18 nt, Artificial Sequence
  Description of Artificial Sequence: Synthetic oligonucleotide
auaaacagccucaacaaa

SEQ ID NO: 138108 - RNA, 18 nt, Artificial Sequence
  Description of Artificial Sequence: Synthetic oligonucleotide
acugaauaaacagccuca

SEQ ID NO: 138109 - RNA, 18 nt, Artificial Sequence
  Description of Artificial Sequence: Synthetic oligonucleotide
accuuacugaauaaacag

SEQ ID NO: 138110 - RNA, 18 nt, Artificial Sequence
  Description of Artificial Sequence: Synthetic oligonucleotide
cagucaccuuacugaaua

SEQ ID NO: 138111 - RNA, 18 nt, Artificial Sequence
  Description of Artificial Sequence: Synthetic oligonucleotide
gcugucagucaccuuacu

SEQ ID NO: 138112 - RNA, 18 nt, Artificial Sequence
  Description of Artificial Sequence: Synthetic oligonucleotide
uaaaggcugucagucacc

SEQ ID NO: 138113 - RNA, 18 nt, Artificial Sequence
  Description of Artificial Sequence: Synthetic oligonucleotide
uucaguaaaggcugucag

SEQ ID NO: 138114 - RNA, 18 nt, Artificial Sequence
  Description of Artificial Sequence: Synthetic oligonucleotide
cuucauucaguaaaggcu

SEQ ID NO: 138115 - RNA, 18 nt, Artificial Sequence
  Description of Artificial Sequence: Synthetic oligonucleotide
aauggcuucauucaguaa

SEQ ID NO: 138116 - RNA, 18 nt, Artificial Sequence
  Description of Artificial Sequence: Synthetic oligonucleotide
ccaacaauggcuucauuc

SEQ ID NO: 138117 - RNA, 18 nt, Artificial Sequence
  Description of Artificial Sequence: Synthetic oligonucleotide
ucaucccaacaauggcuu

SEQ ID NO: 138118 - RNA, 18 nt, Artificial Sequence
  Description of Artificial Sequence: Synthetic oligonucleotide
uugccucaucccaacaau

SEQ ID NO: 138119 - RNA, 18 nt, Artificial Sequence
  Description of Artificial Sequence: Synthetic oligonucleotide
guggauugccucauccca

SEQ ID NO: 138120 - RNA, 18 nt, Artificial Sequence
  Description of Artificial Sequence: Synthetic oligonucleotide
auccaguggauugccuca

SEQ ID NO: 138121 - RNA, 18 nt, Artificial Sequence
  Description of Artificial Sequence: Synthetic oligonucleotide
accucauccaguggauug

SEQ ID NO: 138122 - RNA, 18 nt, Artificial Sequence
  Description of Artificial Sequence: Synthetic oligonucleotide
ggguuaccucauccagug

SEQ ID NO: 138123 - RNA, 18 nt, Artificial Sequence
  Description of Artificial Sequence: Synthetic oligonucleotide
ccaauggguuaccucauc

SEQ ID NO: 138124 - RNA, 18 nt, Artificial Sequence
  Description of Artificial Sequence: Synthetic oligonucleotide
uucacccaauggguuacc

SEQ ID NO: 138125 - RNA, 18 nt, Artificial Sequence
  Description of Artificial Sequence: Synthetic oligonucleotide
acaucuucacccaauggg

SEQ ID NO: 138126 - RNA, 18 nt, Artificial Sequence
  Description of Artificial Sequence: Synthetic oligonucleotide
caagaacaucuucaccca

SEQ ID NO: 138127 - RNA, 18 nt, Artificial Sequence
  Description of Artificial Sequence: Synthetic oligonucleotide
ucacccaagaacaucuuc

SEQ ID NO: 138128 - RNA, 18 nt, Artificial Sequence
  Description of Artificial Sequence: Synthetic oligonucleotide
aauucucacccaagaaca

SEQ ID NO: 138129 - RNA, 18 nt, Artificial Sequence
  Description of Artificial Sequence: Synthetic oligonucleotide
aauggaauucucacccaa

SEQ ID NO: 138130 - RNA, 18 nt, Artificial Sequence
  Description of Artificial Sequence: Synthetic oligonucleotide
caacuaauggaauucuca

SEQ ID NO: 138131 - RNA, 18 nt, Artificial Sequence
  Description of Artificial Sequence: Synthetic oligonucleotide
aaugucaacuaauggaau

SEQ ID NO: 138132 - RNA, 18 nt, Artificial Sequence
  Description of Artificial Sequence: Synthetic oligonucleotide
uggacaaugucaacuaau

SEQ ID NO: 138133 - RNA, 18 nt, Artificial Sequence
  Description of Artificial Sequence: Synthetic oligonucleotide
cuuaauggacaaugucaa

SEQ ID NO: 138134 - RNA, 18 nt, Artificial Sequence
  Description of Artificial Sequence: Synthetic oligonucleotide
uuuuacuuaauggacaau

SEQ ID NO: 138135 - RNA, 18 nt, Artificial Sequence
  Description of Artificial Sequence: Synthetic oligonucleotide
accacuuuuacuuaaugg

SEQ ID NO: 138136 - RNA, 18 nt, Artificial Sequence
  Description of Artificial Sequence: Synthetic oligonucleotide
caaugaccacuuuuacuu

SEQ ID NO: 138137 - RNA, 18 nt, Artificial Sequence
  Description of Artificial Sequence: Synthetic oligonucleotide
uacuucaaugaccacuuu

SEQ ID NO: 138138 - RNA, 18 nt, Artificial Sequence
  Description of Artificial Sequence: Synthetic oligonucleotide
agccuuacuucaaugacc

SEQ ID NO: 138139 - RNA, 18 nt, Artificial Sequence
  Description of Artificial Sequence: Synthetic oligonucleotide
ugugcagccuuacuucaa

SEQ ID NO: 138140 - RNA, 18 nt, Artificial Sequence
  Description of Artificial Sequence: Synthetic oligonucleotide
ccaacugugcagccuuac

SEQ ID NO: 138141 - RNA, 18 nt, Artificial Sequence
  Description of Artificial Sequence: Synthetic oligonucleotide
cuuacccaacugugcagc

SEQ ID NO: 138142 - RNA, 18 nt, Artificial Sequence
  Description of Artificial Sequence: Synthetic oligonucleotide
auagccuuacccaacugu

SEQ ID NO: 138143 - RNA, 18 nt, Artificial Sequence
  Description of Artificial Sequence: Synthetic oligonucleotide
aauggauagccuuaccca

SEQ ID NO: 138144 - RNA, 18 nt, Artificial Sequence
  Description of Artificial Sequence: Synthetic oligonucleotide
ugucuaauggauagccuu

SEQ ID NO: 138145 - RNA, 18 nt, Artificial Sequence
  Description of Artificial Sequence: Synthetic oligonucleotide
cuaauugucuaauggaua

SEQ ID NO: 138146 - RNA, 18 nt, Artificial Sequence
  Description of Artificial Sequence: Synthetic oligonucleotide
cucaucuaauugucuaau

SEQ ID NO: 138147 - RNA, 18 nt, Artificial Sequence
  Description of Artificial Sequence: Synthetic oligonucleotide
guagucucaucuaauugu

SEQ ID NO: 138148 - RNA, 18 nt, Artificial Sequence
  Description of Artificial Sequence: Synthetic oligonucleotide
aauggguagucucaucua

SEQ ID NO: 138149 - RNA, 18 nt, Artificial Sequence
  Description of Artificial Sequence: Synthetic oligonucleotide
gacccaauggguagucuc

SEQ ID NO: 138150 - RNA, 18 nt, Artificial Sequence
  Description of Artificial Sequence: Synthetic oligonucleotide
auccugacccaaugggua

SEQ ID NO: 138151 - RNA, 18 nt, Artificial Sequence
  Description of Artificial Sequence: Synthetic oligonucleotide
cagacauccugacccaau

SEQ ID NO: 138152 - RNA, 18 nt, Artificial Sequence
  Description of Artificial Sequence: Synthetic oligonucleotide
cccagcagacauccugac

SEQ ID NO: 138153 - RNA, 18 nt, Artificial Sequence
  Description of Artificial Sequence: Synthetic oligonucleotide
ucuagcccagcagacauc

SEQ ID NO: 138154 - RNA, 18 nt, Artificial Sequence
  Description of Artificial Sequence: Synthetic oligonucleotide
gauggucuagcccagcag

SEQ ID NO: 138155 - RNA, 18 nt, Artificial Sequence
  Description of Artificial Sequence: Synthetic oligonucleotide
cagaggauggucuagccc

SEQ ID NO: 138156 - RNA, 18 nt, Artificial Sequence
  Description of Artificial Sequence: Synthetic oligonucleotide
gguuucagaggauggucu

SEQ ID NO: 138157 - RNA, 18 nt, Artificial Sequence
  Description of Artificial Sequence: Synthetic oligonucleotide
uuggagguuucagaggau

SEQ ID NO: 138158 - RNA, 18 nt, Artificial Sequence
  Description of Artificial Sequence: Synthetic oligonucleotide
auacuuuggagguuucag

SEQ ID NO: 138159 - RNA, 18 nt, Artificial Sequence
  Description of Artificial Sequence: Synthetic oligonucleotide
aguuuauacuuuggaggu

SEQ ID NO: 138160 - RNA, 18 nt, Artificial Sequence
  Description of Artificial Sequence: Synthetic oligonucleotide
ugacaaguuuauacuuug

SEQ ID NO: 138161 - RNA, 18 nt, Artificial Sequence
  Description of Artificial Sequence: Synthetic oligonucleotide
cccaaugacaaguuuaua

SEQ ID NO: 138162 - RNA, 18 nt, Artificial Sequence
  Description of Artificial Sequence: Synthetic oligonucleotide
cuuugcccaaugacaagu

SEQ ID NO: 138163 - RNA, 18 nt, Artificial Sequence
  Description of Artificial Sequence: Synthetic oligonucleotide
aagagcuuugcccaauga

SEQ ID NO: 138164 - RNA, 18 nt, Artificial Sequence
  Description of Artificial Sequence: Synthetic oligonucleotide
cuuugaagagcuuugccc

SEQ ID NO: 138165 - RNA, 18 nt, Artificial Sequence
  Description of Artificial Sequence: Synthetic oligonucleotide
uuauccuuugaagagcuu

SEQ ID NO: 138166 - RNA, 18 nt, Artificial Sequence
  Description of Artificial Sequence: Synthetic oligonucleotide
uaaucuuauccuuugaag

SEQ ID NO: 138167 - RNA, 18 nt, Artificial Sequence
  Description of Artificial Sequence: Synthetic oligonucleotide
auugauaaucuuauccuu

SEQ ID NO: 138168 - RNA, 18 nt, Artificial Sequence
  Description of Artificial Sequence: Synthetic oligonucleotide
aucccauugauaaucuua

SEQ ID NO: 138169 - RNA, 18 nt, Artificial Sequence
  Description of Artificial Sequence: Synthetic oligonucleotide
acuucaucccauugauaa

SEQ ID NO: 138170 - RNA, 18 nt, Artificial Sequence
  Description of Artificial Sequence: Synthetic oligonucleotide
ggaucacuucaucccauu

SEQ ID NO: 138171 - RNA, 18 nt, Artificial Sequence
  Description of Artificial Sequence: Synthetic oligonucleotide
ucaguggaucacuucauc

SEQ ID NO: 138172 - RNA, 18 nt, Artificial Sequence
  Description of Artificial Sequence: Synthetic oligonucleotide
ucuuuguucaauggaaaa

SEQ ID NO: 138173 - RNA, 18 nt, Artificial Sequence
  Description of Artificial Sequence: Synthetic oligonucleotide
ggccaucuuuguucaaug

SEQ ID NO: 138174 - RNA, 18 nt, Artificial Sequence
  Description of Artificial Sequence: Synthetic oligonucleotide
caauuggccaucuuuguu

SEQ ID NO: 138175 - RNA, 18 nt, Artificial Sequence
  Description of Artificial Sequence: Synthetic oligonucleotide
ugacccaauuggccaucu

SEQ ID NO: 138176 - RNA, 18 nt, Artificial Sequence
  Description of Artificial Sequence: Synthetic oligonucleotide
aaauuugacccaauuggc

SEQ ID NO: 138177 - RNA, 18 nt, Artificial Sequence
  Description of Artificial Sequence: Synthetic oligonucleotide
agagcaaauuugacccaa

SEQ ID NO: 138178 - RNA, 18 nt, Artificial Sequence
  Description of Artificial Sequence: Synthetic oligonucleotide
uuuggagagcaaauuuga

SEQ ID NO: 138179 - RNA, 18 nt, Artificial Sequence
  Description of Artificial Sequence: Synthetic oligonucleotide
gcagguuuggagagcaaa

SEQ ID NO: 138180 - RNA, 18 nt, Artificial Sequence
  Description of Artificial Sequence: Synthetic oligonucleotide
ucauggcagguuuggaga

SEQ ID NO: 138181 - RNA, 18 nt, Artificial Sequence
  Description of Artificial Sequence: Synthetic oligonucleotide
cacucucauggcagguuu

SEQ ID NO: 138182 - RNA, 18 nt, Artificial Sequence
  Description of Artificial Sequence: Synthetic oligonucleotide
ggccucacucucauggca

SEQ ID NO: 138183 - RNA, 18 nt, Artificial Sequence
  Description of Artificial Sequence: Synthetic oligonucleotide
uaauuggccucacucuca

SEQ ID NO: 138184 - RNA, 18 nt, Artificial Sequence
  Description of Artificial Sequence: Synthetic oligonucleotide
gaaacuaauuggccucac

SEQ ID NO: 138185 - RNA, 18 nt, Artificial Sequence
  Description of Artificial Sequence: Synthetic oligonucleotide
uaauagaaacuaauuggc

SEQ ID NO: 138186 - RNA, 18 nt, Artificial Sequence
  Description of Artificial Sequence: Synthetic oligonucleotide
augaguaauagaaacuaa

SEQ ID NO: 138187 - RNA, 18 nt, Artificial Sequence
  Description of Artificial Sequence: Synthetic oligonucleotide
aggagaugaguaauagaa

SEQ ID NO: 138188 - RNA, 18 nt, Artificial Sequence
  Description of Artificial Sequence: Synthetic oligonucleotide
uauuuaggagaugaguaa

SEQ ID NO: 138189 - RNA, 18 nt, Artificial Sequence
  Description of Artificial Sequence: Synthetic oligonucleotide
uuggauauuuaggagaug

SEQ ID NO: 138190 - RNA, 18 nt, Artificial Sequence
  Description of Artificial Sequence: Synthetic oligonucleotide
auuucuuggauauuuagg

SEQ ID NO: 138191 - RNA, 18 nt, Artificial Sequence
  Description of Artificial Sequence: Synthetic oligonucleotide
auaccauuucuuggauau

SEQ ID NO: 138192 - RNA, 18 nt, Artificial Sequence
  Description of Artificial Sequence: Synthetic oligonucleotide
aaaaaauaccauuucuug

SEQ ID NO: 138193 - RNA, 18 nt, Artificial Sequence
  Description of Artificial Sequence: Synthetic oligonucleotide
ggcucaaaaaauaccauu

SEQ ID NO: 138194 - RNA, 18 nt, Artificial Sequence
  Description of Artificial Sequence: Synthetic oligonucleotide
cagcuggcucaaaaaaua

SEQ ID NO: 138195 - RNA, 18 nt, Artificial Sequence
  Description of Artificial Sequence: Synthetic oligonucleotide
cggaccagcuggcucaaa

SEQ ID NO: 138196 - RNA, 18 nt, Artificial Sequence
  Description of Artificial Sequence: Synthetic oligonucleotide
aaccccggaccagcuggc

SEQ ID NO: 138197 - RNA, 18 nt, Artificial Sequence
  Description of Artificial Sequence: Synthetic oligonucleotide
gaugaaaccccggaccag

SEQ ID NO: 138198 - RNA, 18 nt, Artificial Sequence
  Description of Artificial Sequence: Synthetic oligonucleotide
caguugaugaaaccccgg

SEQ ID NO: 138199 - RNA, 18 nt, Artificial Sequence
  Description of Artificial Sequence: Synthetic oligonucleotide
agcagcaguugaugaaac

SEQ ID NO: 138200 - RNA, 18 nt, Artificial Sequence
  Description of Artificial Sequence: Synthetic oligonucleotide
gaaggagcagcaguugau

SEQ ID NO: 138201 - RNA, 18 nt, Artificial Sequence
  Description of Artificial Sequence: Synthetic oligonucleotide
ugggagaaggagcagcag

SEQ ID NO: 138202 - RNA, 18 nt, Artificial Sequence
  Description of Artificial Sequence: Synthetic oligonucleotide
uuuccugggagaaggagc

SEQ ID NO: 138203 - RNA, 18 nt, Artificial Sequence
  Description of Artificial Sequence: Synthetic oligonucleotide
uagucuuuccugggagaa

SEQ ID NO: 138204 - RNA, 18 nt, Artificial Sequence
  Description of Artificial Sequence: Synthetic oligonucleotide
agggauagucuuuccugg

SEQ ID NO: 138205 - RNA, 18 nt, Artificial Sequence
  Description of Artificial Sequence: Synthetic oligonucleotide
gugacagggauagucuuu

SEQ ID NO: 138206 - RNA, 18 nt, Artificial Sequence
  Description of Artificial Sequence: Synthetic oligonucleotide
gaugggugacagggauag

SEQ ID NO: 138207 - RNA, 18 nt, Artificial Sequence
  Description of Artificial Sequence: Synthetic oligonucleotide
aaugggaugggugacagg

SEQ ID NO: 138208 - RNA, 18 nt, Artificial Sequence
  Description of Artificial Sequence: Synthetic oligonucleotide
gcggcaaugggaugggug

SEQ ID NO: 138209 - RNA, 18 nt, Artificial Sequence
  Description of Artificial Sequence: Synthetic oligonucleotide
ccccagcggcaaugggau

SEQ ID NO: 138210 - RNA, 18 nt, Artificial Sequence
  Description of Artificial Sequence: Synthetic oligonucleotide
gcuguccccagcggcaau

SEQ ID NO: 138211 - RNA, 18 nt, Artificial Sequence
  Description of Artificial Sequence: Synthetic oligonucleotide
gccuggcuguccccagcg

SEQ ID NO: 138212 - RNA, 18 nt, Artificial Sequence
  Description of Artificial Sequence: Synthetic oligonucleotide
cccaggccuggcuguccc

SEQ ID NO: 138213 - RNA, 18 nt, Artificial Sequence
  Description of Artificial Sequence: Synthetic oligonucleotide
caaggcccaggccuggcu

SEQ ID NO: 138214 - RNA, 18 nt, Artificial Sequence
  Description of Artificial Sequence: Synthetic oligonucleotide
caaaccaaggcccaggcc

SEQ ID NO: 138215 - RNA, 18 nt, Artificial Sequence
  Description of Artificial Sequence: Synthetic oligonucleotide
ucucccaaaccaaggccc

SEQ ID NO: 138216 - RNA, 18 nt, Artificial Sequence
  Description of Artificial Sequence: Synthetic oligonucleotide
cugcuucucccaaaccaa

SEQ ID NO: 138217 - RNA, 18 nt, Artificial Sequence
  Description of Artificial Sequence: Synthetic oligonucleotide
uuggacugcuucucccaa

SEQ ID NO: 138218 - RNA, 18 nt, Artificial Sequence
  Description of Artificial Sequence: Synthetic oligonucleotide
cagacuuggacugcuucu

SEQ ID NO: 138219 - RNA, 18 nt, Artificial Sequence
  Description of Artificial Sequence: Synthetic oligonucleotide
auaugcagacuuggacug

SEQ ID NO: 138220 - RNA, 18 nt, Artificial Sequence
  Description of Artificial Sequence: Synthetic oligonucleotide
auuugauaugcagacuug

SEQ ID NO: 138221 - RNA, 18 nt, Artificial Sequence
  Description of Artificial Sequence: Synthetic oligonucleotide
cauuuauuugauaugcag

SEQ ID NO: 138222 - RNA, 18 nt, Artificial Sequence
  Description of Artificial Sequence: Synthetic oligonucleotide
uccaucauuuauuugaua

SEQ ID NO: 138223 - RNA, 18 nt, Artificial Sequence
  Description of Artificial Sequence: Synthetic oligonucleotide
ucuccuccaucauuuauu

SEQ ID NO: 138224 - RNA, 18 nt, Artificial Sequence
  Description of Artificial Sequence: Synthetic oligonucleotide
acccaucuccuccaucau

SEQ ID NO: 138225 - RNA, 18 nt, Artificial Sequence
  Description of Artificial Sequence: Synthetic oligonucleotide
cuaccacccaucuccucc

SEQ ID NO: 138226 - RNA, 18 nt, Artificial Sequence
  Description of Artificial Sequence: Synthetic oligonucleotide
agguccuaccacccaucu

SEQ ID NO: 138227 - RNA, 18 nt, Artificial Sequence
  Description of Artificial Sequence: Synthetic oligonucleotide
cuggaagguccuaccacc

SEQ ID NO: 138228 - RNA, 18 nt, Artificial Sequence
  Description of Artificial Sequence: Synthetic oligonucleotide
gaggucuggaagguccua

SEQ ID NO: 138229 - RNA, 18 nt, Artificial Sequence
  Description of Artificial Sequence: Synthetic oligonucleotide
uuuaugaggucuggaagg

SEQ ID NO: 138230 - RNA, 18 nt, Artificial Sequence
  Description of Artificial Sequence: Synthetic oligonucleotide
uaaguuuuaugaggucug

SEQ ID NO: 138231 - RNA, 18 nt, Artificial Sequence
  Description of Artificial Sequence: Synthetic oligonucleotide
aagccuaaguuuuaugag

SEQ ID NO: 138232 - RNA, 18 nt, Artificial Sequence
  Description of Artificial Sequence: Synthetic oligonucleotide
ucauaaagccuaaguuuu

SEQ ID NO: 138233 - RNA, 18 nt, Artificial Sequence
  Description of Artificial Sequence: Synthetic oligonucleotide
ccagaucauaaagccuaa

SEQ ID NO: 138234 - RNA, 18 nt, Artificial Sequence
  Description of Artificial Sequence: Synthetic oligonucleotide
gagucccagaucauaaag

SEQ ID NO: 138235 - RNA, 18 nt, Artificial Sequence
  Description of Artificial Sequence: Synthetic oligonucleotide
ucugugagucccagauca

SEQ ID NO: 138236 - RNA, 18 nt, Artificial Sequence
  Description of Artificial Sequence: Synthetic oligonucleotide
aaccuucugugaguccca

SEQ ID NO: 138237 - RNA, 18 nt, Artificial Sequence
  Description of Artificial Sequence: Synthetic oligonucleotide
ugcucaaccuucugugag

SEQ ID NO: 138238 - RNA, 18 nt, Artificial Sequence
  Description of Artificial Sequence: Synthetic oligonucleotide
uuuauugcucaaccuucu

SEQ ID NO: 138239 - RNA, 18 nt, Artificial Sequence
  Description of Artificial Sequence: Synthetic oligonucleotide
ggucuuuuauugcucaac

SEQ ID NO: 138240 - RNA, 18 nt, Artificial Sequence
  Description of Artificial Sequence: Synthetic oligonucleotide
ccuaaggucuuuuauugc

SEQ ID NO: 138241 - RNA, 18 nt, Artificial Sequence
  Description of Artificial Sequence: Synthetic oligonucleotide
uaaucccuaaggucuuuu

SEQ ID NO: 138242 - RNA, 18 nt, Artificial Sequence
  Description of Artificial Sequence: Synthetic oligonucleotide
ccagauaaucccuaaggu

SEQ ID NO: 138243 - RNA, 18 nt, Artificial Sequence
  Description of Artificial Sequence: Synthetic oligonucleotide
uuaaaccagauaaucccu

SEQ ID NO: 138244 - RNA, 18 nt, Artificial Sequence
  Description of Artificial Sequence: Synthetic oligonucleotide
auuaauuaaaccagauaa

SEQ ID NO: 138245 - RNA, 18 nt, Artificial Sequence
  Description of Artificial Sequence: Synthetic oligonucleotide
agagaauuaauuaaacca

SEQ ID NO: 138246 - RNA, 18 nt, Artificial Sequence
  Description of Artificial Sequence: Synthetic oligonucleotide
aaaugagagaauuaauua

SEQ ID NO: 138247 - RNA, 18 nt, Artificial Sequence
  Description of Artificial Sequence: Synthetic oligonucleotide
cuauaaaaugagagaauu

SEQ ID NO: 138248 - RNA, 18 nt, Artificial Sequence
  Description of Artificial Sequence: Synthetic oligonucleotide
uuccucuauaaaaugaga

SEQ ID NO: 138249 - RNA, 18 nt, Artificial Sequence
  Description of Artificial Sequence: Synthetic oligonucleotide
auuucuuccucuauaaaa

SEQ ID NO: 138250 - RNA, 18 nt, Artificial Sequence
  Description of Artificial Sequence: Synthetic oligonucleotide
acuuaauuucuuccucua

SEQ ID NO: 138251 - RNA, 18 nt, Artificial Sequence
  Description of Artificial Sequence: Synthetic oligonucleotide
ccuugacuuaauuucuuc

SEQ ID NO: 138252 - RNA, 18 nt, Artificial Sequence
  Description of Artificial Sequence: Synthetic oligonucleotide
ccccaccuugacuuaauu

SEQ ID NO: 138253 - RNA, 18 nt, Artificial Sequence
  Description of Artificial Sequence: Synthetic oligonucleotide
cccugccccaccuugacu

SEQ ID NO: 138254 - RNA, 18 nt, Artificial Sequence
  Description of Artificial Sequence: Synthetic oligonucleotide
ucccacccugccccaccu

SEQ ID NO: 138255 - RNA, 18 nt, Artificial Sequence
  Description of Artificial Sequence: Synthetic oligonucleotide
uccccucccacccugccc

SEQ ID NO: 138256 - RNA, 18 nt, Artificial Sequence
  Description of Artificial Sequence: Synthetic oligonucleotide
aguucuccccucccaccc

SEQ ID NO: 138257 - RNA, 18 nt, Artificial Sequence
  Description of Artificial Sequence: Synthetic oligonucleotide
gggaaaguucuccccucc

SEQ ID NO: 138258 - RNA, 18 nt, Artificial Sequence
  Description of Artificial Sequence: Synthetic oligonucleotide
ggcccgggaaaguucucc

SEQ ID NO: 138259 - RNA, 18 nt, Artificial Sequence
  Description of Artificial Sequence: Synthetic oligonucleotide
gaagaggcccgggaaagu

SEQ ID NO: 138260 - RNA, 18 nt, Artificial Sequence
  Description of Artificial Sequence: Synthetic oligonucleotide
uaaaugaagaggcccggg

SEQ ID NO: 138261 - RNA, 18 nt, Artificial Sequence
  Description of Artificial Sequence: Synthetic oligonucleotide
gggaguaaaugaagaggc

SEQ ID NO: 138262 - RNA, 18 nt, Artificial Sequence
  Description of Artificial Sequence: Synthetic oligonucleotide
uuugugggaguaaaugaa

SEQ ID NO: 138263 - RNA, 18 nt, Artificial Sequence
  Description of Artificial Sequence: Synthetic oligonucleotide
cagccuuugugggaguaa

SEQ ID NO: 138264 - RNA, 18 nt, Artificial Sequence
  Description of Artificial Sequence: Synthetic oligonucleotide
aauuccagccuuuguggg

SEQ ID NO: 138265 - RNA, 18 nt, Artificial Sequence
  Description of Artificial Sequence: Synthetic oligonucleotide
cucaaaauuccagccuuu

SEQ ID NO: 138266 - RNA, 18 nt, Artificial Sequence
  Description of Artificial Sequence: Synthetic oligonucleotide
ggcugcucaaaauuccag

SEQ ID NO: 138267 - RNA, 18 nt, Artificial Sequence
  Description of Artificial Sequence: Synthetic oligonucleotide
ccuggcggugagggcugu

SEQ ID NO: 138268 - RNA, 18 nt, Artificial Sequence
  Description of Artificial Sequence: Synthetic oligonucleotide
agccaccuggcggugagg

SEQ ID NO: 138269 - RNA, 18 nt, Artificial Sequence
  Description of Artificial Sequence: Synthetic oligonucleotide
cccugagccaccuggcgg

SEQ ID NO: 138270 - RNA, 18 nt, Artificial Sequence
  Description of Artificial Sequence: Synthetic oligonucleotide
ucagacccugagccaccu

SEQ ID NO: 138271 - RNA, 18 nt, Artificial Sequence
  Description of Artificial Sequence: Synthetic oligonucleotide
agggcucagacccugagc

SEQ ID NO: 138272 - RNA, 18 nt, Artificial Sequence
  Description of Artificial Sequence: Synthetic oligonucleotide
cuuauagggcucagaccc

SEQ ID NO: 138273 - RNA, 18 nt, Artificial Sequence
  Description of Artificial Sequence: Synthetic oligonucleotide
aggagcuuauagggcuca

SEQ ID NO: 138274 - RNA, 18 nt, Artificial Sequence
  Description of Artificial Sequence: Synthetic oligonucleotide
ccggcaggagcuuauagg

SEQ ID NO: 138275 - RNA, 18 nt, Artificial Sequence
  Description of Artificial Sequence: Synthetic oligonucleotide
ggcucccggcaggagcuu

SEQ ID NO: 138276 - RNA, 18 nt, Artificial Sequence
  Description of Artificial Sequence: Synthetic oligonucleotide
gcgacggcucccggcagg

SEQ ID NO: 138277 - RNA, 18 nt, Artificial Sequence
  Description of Artificial Sequence: Synthetic oligonucleotide
uuguggcgacggcucccg

SEQ ID NO: 138278 - RNA, 18 nt, Artificial Sequence
  Description of Artificial Sequence: Synthetic oligonucleotide
gacgauuguggcgacggc

SEQ ID NO: 138279 - RNA, 18 nt, Artificial Sequence
  Description of Artificial Sequence: Synthetic oligonucleotide
ggcuugacgauuguggcg

SEQ ID NO: 138280 - RNA, 18 nt, Artificial Sequence
  Description of Artificial Sequence: Synthetic oligonucleotide
gggcuugacgauuguggc

SEQ ID NO: 138281 - RNA, 18 nt, Artificial Sequence
  Description of Artificial Sequence: Synthetic oligonucleotide
uggugauggucggcuggg

SEQ ID NO: 138282 - RNA, 18 nt, Artificial Sequence
  Description of Artificial Sequence: Synthetic oligonucleotide
cugcuuggugauggucgg

SEQ ID NO: 138283 - RNA, 18 nt, Artificial Sequence
  Description of Artificial Sequence: Synthetic oligonucleotide
acuuccugcuuggugaug

SEQ ID NO: 138284 - RNA, 18 nt, Artificial Sequence
  Description of Artificial Sequence: Synthetic oligonucleotide
agauaacuuccugcuugg

SEQ ID NO: 138285 - RNA, 18 nt, Artificial Sequence
  Description of Artificial Sequence: Synthetic oligonucleotide
uugcuagauaacuuccug

SEQ ID NO: 138286 - RNA, 18 nt, Artificial Sequence
  Description of Artificial Sequence: Synthetic oligonucleotide
gcggcuugcuagauaacu

SEQ ID NO: 138287 - RNA, 18 nt, Artificial Sequence
  Description of Artificial Sequence: Synthetic oligonucleotide
ccccagcggcuugcuaga

SEQ ID NO: 138288 - RNA, 18 nt, Artificial Sequence
  Description of Artificial Sequence: Synthetic oligonucleotide
ccaagccccagcggcuug

SEQ ID NO: 138289 - RNA, 18 nt, Artificial Sequence
  Description of Artificial Sequence: Synthetic oligonucleotide
agcccccaagccccagcg

SEQ ID NO: 138290 - RNA, 18 nt, Artificial Sequence
  Description of Artificial Sequence: Synthetic oligonucleotide
aguggagcccccaagccc

SEQ ID NO: 138291 - RNA, 18 nt, Artificial Sequence
  Description of Artificial Sequence: Synthetic oligonucleotide
gagccaguggagccccca

SEQ ID NO: 138292 - RNA, 18 nt, Artificial Sequence
  Description of Artificial Sequence: Synthetic oligonucleotide
gggagccaguggagcccc

SEQ ID NO: 138293 - RNA, 18 nt, Artificial Sequence
  Description of Artificial Sequence: Synthetic oligonucleotide
ccaggugcucucuuaggg

SEQ ID NO: 138294 - RNA, 18 nt, Artificial Sequence
  Description of Artificial Sequence: Synthetic oligonucleotide
gaucaccaggugcucucu

SEQ ID NO: 138295 - RNA, 18 nt, Artificial Sequence
  Description of Artificial Sequence: Synthetic oligonucleotide
cacgugaucaccaggugc

SEQ ID NO: 138296 - RNA, 18 nt, Artificial Sequence
  Description of Artificial Sequence: Synthetic oligonucleotide
gugaccacgugaucacca

SEQ ID NO: 138297 - RNA, 18 nt, Artificial Sequence
  Description of Artificial Sequence: Synthetic oligonucleotide
uugccgugaccacgugau

SEQ ID NO: 138298 - RNA, 18 nt, Artificial Sequence
  Description of Artificial Sequence: Synthetic oligonucleotide
uuccuuugccgugaccac

SEQ ID NO: 138299 - RNA, 18 nt, Artificial Sequence
  Description of Artificial Sequence: Synthetic oligonucleotide
acgucuuccuuugccgug

SEQ ID NO: 138300 - RNA, 18 nt, Artificial Sequence
  Description of Artificial Sequence: Synthetic oligonucleotide
gcaucacgucuuccuuug

SEQ ID NO: 138301 - RNA, 18 nt, Artificial Sequence
  Description of Artificial Sequence: Synthetic oligonucleotide
uccuggcaucacgucuuc

SEQ ID NO: 138302 - RNA, 18 nt, Artificial Sequence
  Description of Artificial Sequence: Synthetic oligonucleotide
acugguccuggcaucacg

SEQ ID NO: 138303 - RNA, 18 nt, Artificial Sequence
  Description of Artificial Sequence: Synthetic oligonucleotide
cugggacugguccuggca

SEQ ID NO: 138304 - RNA, 18 nt, Artificial Sequence
  Description of Artificial Sequence: Synthetic oligonucleotide
cugcucugggacuggucc

SEQ ID NO: 138305 - RNA, 18 nt, Artificial Sequence
  Description of Artificial Sequence: Synthetic oligonucleotide
cauuccugcucugggacu

SEQ ID NO: 138306 - RNA, 18 nt, Artificial Sequence
  Description of Artificial Sequence: Synthetic oligonucleotide
cuucccauuccugcucug

SEQ ID NO: 138307 - RNA, 18 nt, Artificial Sequence
  Description of Artificial Sequence: Synthetic oligonucleotide
ucauccuucccauuccug

SEQ ID NO: 138308 - RNA, 18 nt, Artificial Sequence
  Description of Artificial Sequence: Synthetic oligonucleotide
gcccuucauccuucccau

SEQ ID NO: 138309 - RNA, 18 nt, Artificial Sequence
  Description of Artificial Sequence: Synthetic oligonucleotide
cucgggcccuucauccuu

SEQ ID NO: 138310 - RNA, 18 nt, Artificial Sequence
  Description of Artificial Sequence: Synthetic oligonucleotide
auguucucgggcccuuca

SEQ ID NO: 138311 - RNA, 18 nt, Artificial Sequence
  Description of Artificial Sequence: Synthetic oligonucleotide
aggccauguucucgggcc

SEQ ID NO: 138312 - RNA, 18 nt, Artificial Sequence
  Description of Artificial Sequence: Synthetic oligonucleotide
cccuuaggccauguucuc

SEQ ID NO: 138313 - RNA, 18 nt, Artificial Sequence
  Description of Artificial Sequence: Synthetic oligonucleotide
uguggcccuuaggccaug

SEQ ID NO: 138314 - RNA, 18 nt, Artificial Sequence
  Description of Artificial Sequence: Synthetic oligonucleotide
ugggauguggcccuuagg

SEQ ID NO: 138315 - RNA, 18 nt, Artificial Sequence
  Description of Artificial Sequence: Synthetic oligonucleotide
ggcagugggauguggccc

SEQ ID NO: 138316 - RNA, 18 nt, Artificial Sequence
  Description of Artificial Sequence: Synthetic oligonucleotide
aggguggcagugggaugu

SEQ ID NO: 138317 - RNA, 18 nt, Artificial Sequence
  Description of Artificial Sequence: Synthetic oligonucleotide
cgucaaggguggcagugg

SEQ ID NO: 138318 - RNA, 18 nt, Artificial Sequence
  Description of Artificial Sequence: Synthetic oligonucleotide
cagggcgucaaggguggc

SEQ ID NO: 138319 - RNA, 18 nt, Artificial Sequence
  Description of Artificial Sequence: Synthetic oligonucleotide
cagagcagggcgucaagg

SEQ ID NO: 138320 - RNA, 18 nt, Artificial Sequence
  Description of Artificial Sequence: Synthetic oligonucleotide
uuauccagagcagggcgu

SEQ ID NO: 138321 - RNA, 18 nt, Artificial Sequence
  Description of Artificial Sequence: Synthetic oligonucleotide
ucuuguuauccagagcag

SEQ ID NO: 138322 - RNA, 18 nt, Artificial Sequence
  Description of Artificial Sequence: Synthetic oligonucleotide
caaagucuuguuauccag

SEQ ID NO: 138323 - RNA, 18 nt, Artificial Sequence
  Description of Artificial Sequence: Synthetic oligonucleotide
caagucaaagucuuguua

SEQ ID NO: 138324 - RNA, 18 nt, Artificial Sequence
  Description of Artificial Sequence: Synthetic oligonucleotide
cuccccaagucaaagucu

SEQ ID NO: 138325 - RNA, 18 nt, Artificial Sequence
  Description of Artificial Sequence: Synthetic oligonucleotide
gaggucuccccaagucaa

SEQ ID NO: 138326 - RNA, 18 nt, Artificial Sequence
  Description of Artificial Sequence: Synthetic oligonucleotide
caguagaggucuccccaa

SEQ ID NO: 138327 - RNA, 18 nt, Artificial Sequence
  Description of Artificial Sequence: Synthetic oligonucleotide
caaggcaguagaggucuc

SEQ ID NO: 138328 - RNA, 18 nt, Artificial Sequence
  Description of Artificial Sequence: Synthetic oligonucleotide
uuguccaaggcaguagag

SEQ ID NO: 138329 - RNA, 18 nt, Artificial Sequence
  Description of Artificial Sequence: Synthetic oligonucleotide
aaaaguuguccaaggcag

SEQ ID NO: 138330 - RNA, 18 nt, Artificial Sequence
  Description of Artificial Sequence: Synthetic oligonucleotide
augagaaaaguuguccaa

SEQ ID NO: 138331 - RNA, 18 nt, Artificial Sequence
  Description of Artificial Sequence: Synthetic oligonucleotide
ucaacaugagaaaaguug

SEQ ID NO: 138332 - RNA, 18 nt, Artificial Sequence
  Description of Artificial Sequence: Synthetic oligonucleotide
uggcuucaacaugagaaa

SEQ ID NO: 138333 - RNA, 18 nt, Artificial Sequence
  Description of Artificial Sequence: Synthetic oligonucleotide
ggcaguggcuucaacaug

SEQ ID NO: 138334 - RNA, 18 nt, Artificial Sequence
  Description of Artificial Sequence: Synthetic oligonucleotide
gugaaggcaguggcuuca

SEQ ID NO: 138335 - RNA, 18 nt, Artificial Sequence
  Description of Artificial Sequence: Synthetic oligonucleotide
ugaaggugaaggcagugg

SEQ ID NO: 138336 - RNA, 18 nt, Artificial Sequence
  Description of Artificial Sequence: Synthetic oligonucleotide
gaaggugaaggugaaggc

SEQ ID NO: 138337 - RNA, 18 nt, Artificial Sequence
  Description of Artificial Sequence: Synthetic oligonucleotide
uggaugaaggugaaggug

SEQ ID NO: 138338 - RNA, 18 nt, Artificial Sequence
  Description of Artificial Sequence: Synthetic oligonucleotide
ggacauggaugaagguga

SEQ ID NO: 138339 - RNA, 18 nt, Artificial Sequence
  Description of Artificial Sequence: Synthetic oligonucleotide
ggguuggacauggaugaa

SEQ ID NO: 138340 - RNA, 18 nt, Artificial Sequence
  Description of Artificial Sequence: Synthetic oligonucleotide
guccuuugggaugaaguc

SEQ ID NO: 138341 - RNA, 18 nt, Artificial Sequence
  Description of Artificial Sequence: Synthetic oligonucleotide
cggcuguccuuugggaug

SEQ ID NO: 138342 - RNA, 18 nt, Artificial Sequence
  Description of Artificial Sequence: Synthetic oligonucleotide
ccaggcggcuguccuuug

SEQ ID NO: 138343 - RNA, 18 nt, Artificial Sequence
  Description of Artificial Sequence: Synthetic oligonucleotide
caucuccaggcggcuguc

SEQ ID NO: 138344 - RNA, 18 nt, Artificial Sequence
  Description of Artificial Sequence: Synthetic oligonucleotide
caagucaucuccaggcgg

SEQ ID NO: 138345 - RNA, 18 nt, Artificial Sequence
  Description of Artificial Sequence: Synthetic oligonucleotide
ggccucaagucaucucca

SEQ ID NO: 138346 - RNA, 18 nt, Artificial Sequence
  Description of Artificial Sequence: Synthetic oligonucleotide
aguaaggccucaagucau

SEQ ID NO: 138347 - RNA, 18 nt, Artificial Sequence
  Description of Artificial Sequence: Synthetic oligonucleotide
guuuaaguaaggccucaa

SEQ ID NO: 138348 - RNA, 18 nt, Artificial Sequence
  Description of Artificial Sequence: Synthetic oligonucleotide
gcuggguuuaaguaaggc

SEQ ID NO: 138349 - RNA, 18 nt, Artificial Sequence
  Description of Artificial Sequence: Synthetic oligonucleotide
agggagcuggguuuaagu

SEQ ID NO: 138350 - RNA, 18 nt, Artificial Sequence
  Description of Artificial Sequence: Synthetic oligonucleotide
gaagaagggagcuggguu

SEQ ID NO: 138351 - RNA, 18 nt, Artificial Sequence
  Description of Artificial Sequence: Synthetic oligonucleotide
cuagggaagaagggagcu

SEQ ID NO: 138352 - RNA, 18 nt, Artificial Sequence
  Description of Artificial Sequence: Synthetic oligonucleotide
ccaggcuagggaagaagg

SEQ ID NO: 138353 - RNA, 18 nt, Artificial Sequence
  Description of Artificial Sequence: Synthetic oligonucleotide
aagcaccaggcuagggaa

SEQ ID NO: 138354 - RNA, 18 nt, Artificial Sequence
  Description of Artificial Sequence: Synthetic oligonucleotide
aggagaagcaccaggcua

SEQ ID NO: 138355 - RNA, 18 nt, Artificial Sequence
  Description of Artificial Sequence: Synthetic oligonucleotide
aggagaggagaagcacca

SEQ ID NO: 138356 - RNA, 18 nt, Artificial Sequence
  Description of Artificial Sequence: Synthetic oligonucleotide
gggcuaggagaggagaag

SEQ ID NO: 138357 - RNA, 18 nt, Artificial Sequence
  Description of Artificial Sequence: Synthetic oligonucleotide
cugucuggacaccaugac

SEQ ID NO: 138358 - RNA, 18 nt, Artificial Sequence
  Description of Artificial Sequence: Synthetic oligonucleotide
gggcucugucuggacacc

SEQ ID NO: 138359 - RNA, 18 nt, Artificial Sequence
  Description of Artificial Sequence: Synthetic oligonucleotide
ucacagggcucugucugg

SEQ ID NO: 138360 - RNA, 18 nt, Artificial Sequence
  Description of Artificial Sequence: Synthetic oligonucleotide
cagccucacagggcucug

SEQ ID NO: 138361 - RNA, 18 nt, Artificial Sequence
  Description of Artificial Sequence: Synthetic oligonucleotide
ggacccagccucacaggg

SEQ ID NO: 138362 - RNA, 18 nt, Artificial Sequence
  Description of Artificial Sequence: Synthetic oligonucleotide
caauuggacccagccuca

SEQ ID NO: 138363 - RNA, 18 nt, Artificial Sequence
  Description of Artificial Sequence: Synthetic oligonucleotide
ugccacaauuggacccag

SEQ ID NO: 138364 - RNA, 18 nt, Artificial Sequence
  Description of Artificial Sequence: Synthetic oligonucleotide
ccaagugccacaauugga

SEQ ID NO: 138365 - RNA, 18 nt, Artificial Sequence
  Description of Artificial Sequence: Synthetic oligonucleotide
gugccccaagugccacaa

SEQ ID NO: 138366 - RNA, 18 nt, Artificial Sequence
  Description of Artificial Sequence: Synthetic oligonucleotide
gcaaggugccccaagugc

SEQ ID NO: 138367 - RNA, 18 nt, Artificial Sequence
  Description of Artificial Sequence: Synthetic oligonucleotide
gaggagcaaggugcccca

SEQ ID NO: 138368 - RNA, 18 nt, Artificial Sequence
  Description of Artificial Sequence: Synthetic oligonucleotide
agaaggaggagcaaggug

SEQ ID NO: 138369 - RNA, 18 nt, Artificial Sequence
  Description of Artificial Sequence: Synthetic oligonucleotide
gcagcagaaggaggagca

SEQ ID NO: 138370 - RNA, 18 nt, Artificial Sequence
  Description of Artificial Sequence: Synthetic oligonucleotide
gggcagcagcagaaggag

SEQ ID NO: 138371 - RNA, 18 nt, Artificial Sequence
  Description of Artificial Sequence: Synthetic oligonucleotide
gagggaggcagcagaggu

SEQ ID NO: 138372 - RNA, 18 nt, Artificial Sequence
  Description of Artificial Sequence: Synthetic oligonucleotide
cagcagagggaggcagca

SEQ ID NO: 138373 - RNA, 18 nt, Artificial Sequence
  Description of Artificial Sequence: Synthetic oligonucleotide
ggugacagcagagggagg

SEQ ID NO: 138374 - RNA, 18 nt, Artificial Sequence
  Description of Artificial Sequence: Synthetic oligonucleotide
agcaaggugacagcagag

SEQ ID NO: 138375 - RNA, 18 nt, Artificial Sequence
  Description of Artificial Sequence: Synthetic oligonucleotide
ggcugagcaaggugacag

SEQ ID NO: 138376 - RNA, 18 nt, Artificial Sequence
  Description of Artificial Sequence: Synthetic oligonucleotide
gggauggcugagcaaggu

SEQ ID NO: 138377 - RNA, 18 nt, Artificial Sequence
  Description of Artificial Sequence: Synthetic oligonucleotide
aagacgggauggcugagc

SEQ ID NO: 138378 - RNA, 18 nt, Artificial Sequence
  Description of Artificial Sequence: Synthetic oligonucleotide
uggagaagacgggauggc

SEQ ID NO: 138379 - RNA, 18 nt, Artificial Sequence
  Description of Artificial Sequence: Synthetic oligonucleotide
gguguuggagaagacggg

SEQ ID NO: 138380 - RNA, 18 nt, Artificial Sequence
  Description of Artificial Sequence: Synthetic oligonucleotide
gaggugguguuggagaag

SEQ ID NO: 138381 - RNA, 18 nt, Artificial Sequence
  Description of Artificial Sequence: Synthetic oligonucleotide
cuggagaggugguguugg

SEQ ID NO: 138382 - RNA, 18 nt, Artificial Sequence
  Description of Artificial Sequence: Synthetic oligonucleotide
ggccucuggagagguggu

SEQ ID NO: 138383 - RNA, 18 nt, Artificial Sequence
  Description of Artificial Sequence: Synthetic oligonucleotide
uccuuggccucuggagag

SEQ ID NO: 138384 - RNA, 18 nt, Artificial Sequence
  Description of Artificial Sequence: Synthetic oligonucleotide
aggccuccuuggccucug

SEQ ID NO: 138385 - RNA, 18 nt, Artificial Sequence
  Description of Artificial Sequence: Synthetic oligonucleotide
uuccaaggccuccuuggc

SEQ ID NO: 138386 - RNA, 18 nt, Artificial Sequence
  Description of Artificial Sequence: Synthetic oligonucleotide
aucguuuccaaggccucc

SEQ ID NO: 138387 - RNA, 18 nt, Artificial Sequence
  Description of Artificial Sequence: Synthetic oligonucleotide
gggaaucguuuccaaggc

SEQ ID NO: 138388 - RNA, 18 nt, Artificial Sequence
  Description of Artificial Sequence: Synthetic oligonucleotide
guucccagaaugacuggg

SEQ ID NO: 138389 - RNA, 18 nt, Artificial Sequence
  Description of Artificial Sequence: Synthetic oligonucleotide
aacauguucccagaauga

SEQ ID NO: 138390 - RNA, 18 nt, Artificial Sequence
  Description of Artificial Sequence: Synthetic oligonucleotide
cuuacaacauguucccag

SEQ ID NO: 138391 - RNA, 18 nt, Artificial Sequence
  Description of Artificial Sequence: Synthetic oligonucleotide
cagugcuuacaacauguu

SEQ ID NO: 138392 - RNA, 18 nt, Artificial Sequence
  Description of Artificial Sequence: Synthetic oligonucleotide
ccagucagugcuuacaac

SEQ ID NO: 138393 - RNA, 18 nt, Artificial Sequence
  Description of Artificial Sequence: Synthetic oligonucleotide
uggucccagucagugcuu

SEQ ID NO: 138394 - RNA, 18 nt, Artificial Sequence
  Description of Artificial Sequence: Synthetic oligonucleotide
gugccuggucccagucag

SEQ ID NO: 138395 - RNA, 18 nt, Artificial Sequence
  Description of Artificial Sequence: Synthetic oligonucleotide
gccuggugccugguccca

SEQ ID NO: 138396 - RNA, 18 nt, Artificial Sequence
  Description of Artificial Sequence: Synthetic oligonucleotide
acccugccuggugccugg

SEQ ID NO: 138397 - RNA, 18 nt, Artificial Sequence
  Description of Artificial Sequence: Synthetic oligonucleotide
ucuagacccugccuggug

SEQ ID NO: 138398 - RNA, 18 nt, Artificial Sequence
  Description of Artificial Sequence: Synthetic oligonucleotide
agccuucuagacccugcc

SEQ ID NO: 138399 - RNA, 18 nt, Artificial Sequence
  Description of Artificial Sequence: Synthetic oligonucleotide
accacagccuucuagacc

SEQ ID NO: 138400 - RNA, 18 nt, Artificial Sequence
  Description of Artificial Sequence: Synthetic oligonucleotide
cccucaccacagccuucu

SEQ ID NO: 138401 - RNA, 18 nt, Artificial Sequence
  Description of Artificial Sequence: Synthetic oligonucleotide
gucuucccucaccacagc

SEQ ID NO: 138402 - RNA, 18 nt, Artificial Sequence
  Description of Artificial Sequence: Synthetic oligonucleotide
aaggcgucuucccucacc

SEQ ID NO: 138403 - RNA, 18 nt, Artificial Sequence
  Description of Artificial Sequence: Synthetic oligonucleotide
ggagaaaggcgucuuccc

SEQ ID NO: 138404 - RNA, 18 nt, Artificial Sequence
  Description of Artificial Sequence: Synthetic oligonucleotide
uuggaggagaaaggcguc

SEQ ID NO: 138405 - RNA, 18 nt, Artificial Sequence
  Description of Artificial Sequence: Synthetic oligonucleotide
uuggguuggaggagaaag

SEQ ID NO: 138406 - RNA, 18 nt, Artificial Sequence
  Description of Artificial Sequence: Synthetic oligonucleotide
ugagguuggguuggagga

SEQ ID NO: 138407 - RNA, 18 nt, Artificial Sequence
  Description of Artificial Sequence: Synthetic oligonucleotide
gaggaugagguuggguug

SEQ ID NO: 138408 - RNA, 18 nt, Artificial Sequence
  Description of Artificial Sequence: Synthetic oligonucleotide
agaaggaggaugagguug

SEQ ID NO: 138409 - RNA, 18 nt, Artificial Sequence
  Description of Artificial Sequence: Synthetic oligonucleotide
ccugaagaaggaggauga

SEQ ID NO: 138410 - RNA, 18 nt, Artificial Sequence
  Description of Artificial Sequence: Synthetic oligonucleotide
aagucccugaagaaggag

SEQ ID NO: 138411 - RNA, 18 nt, Artificial Sequence
  Description of Artificial Sequence: Synthetic oligonucleotide
cacccaagucccugaaga

SEQ ID NO: 138412 - RNA, 18 nt, Artificial Sequence
  Description of Artificial Sequence: Synthetic oligonucleotide
guacccacccaagucccu

SEQ ID NO: 138413 - RNA, 18 nt, Artificial Sequence
  Description of Artificial Sequence: Synthetic oligonucleotide
cccaaguacccacccaag

SEQ ID NO: 138414 - RNA, 18 nt, Artificial Sequence
  Description of Artificial Sequence: Synthetic oligonucleotide
ccucacccaaguacccac

SEQ ID NO: 138415 - RNA, 18 nt, Artificial Sequence
  Description of Artificial Sequence: Synthetic oligonucleotide
gggauccucacccaagua

SEQ ID NO: 138416 - RNA, 18 nt, Artificial Sequence
  Description of Artificial Sequence: Synthetic oligonucleotide
cuucagggauccucaccc

SEQ ID NO: 138417 - RNA, 18 nt, Artificial Sequence
  Description of Artificial Sequence: Synthetic oligonucleotide
aaggccuucagggauccu

SEQ ID NO: 138418 - RNA, 18 nt, Artificial Sequence
  Description of Artificial Sequence: Synthetic oligonucleotide
gguugaaggccuucaggg

SEQ ID NO: 138419 - RNA, 18 nt, Artificial Sequence
  Description of Artificial Sequence: Synthetic oligonucleotide
ucucggguugaaggccuu

SEQ ID NO: 138420 - RNA, 18 nt, Artificial Sequence
  Description of Artificial Sequence: Synthetic oligonucleotide
uguuuucucggguugaag

SEQ ID NO: 138421 - RNA, 18 nt, Artificial Sequence
  Description of Artificial Sequence: Synthetic oligonucleotide
ggguuuguuuucucgggu

SEQ ID NO: 138422 - RNA, 18 nt, Artificial Sequence
  Description of Artificial Sequence: Synthetic oligonucleotide
aaccuggguuuguuuucu

SEQ ID NO: 138423 - RNA, 18 nt, Artificial Sequence
  Description of Artificial Sequence: Synthetic oligonucleotide
ucgccaaccuggguuugu

SEQ ID NO: 138424 - RNA, 18 nt, Artificial Sequence
  Description of Artificial Sequence: Synthetic oligonucleotide
ugcagucgccaaccuggg

SEQ ID NO: 138425 - RNA, 18 nt, Artificial Sequence
  Description of Artificial Sequence: Synthetic oligonucleotide
ccuguugcagucgccaac

SEQ ID NO: 138426 - RNA, 18 nt, Artificial Sequence
  Description of Artificial Sequence: Synthetic oligonucleotide
aaguuccuguugcagucg

SEQ ID NO: 138427 - RNA, 18 nt, Artificial Sequence
  Description of Artificial Sequence: Synthetic oligonucleotide
acuccaaguuccuguugc

SEQ ID NO: 138428 - RNA, 18 nt, Artificial Sequence
  Description of Artificial Sequence: Synthetic oligonucleotide
ucuccacuccaaguuccu

SEQ ID NO: 138429 - RNA, 18 nt, Artificial Sequence
  Description of Artificial Sequence: Synthetic oligonucleotide
uuuccucuccacuccaag

SEQ ID NO: 138430 - RNA, 18 nt, Artificial Sequence
  Description of Artificial Sequence: Synthetic oligonucleotide
augcuuuuccucuccacu

SEQ ID NO: 138431 - RNA, 18 nt, Artificial Sequence
  Description of Artificial Sequence: Synthetic oligonucleotide
uucugaugcuuuuccucu

SEQ ID NO: 138432 - RNA, 18 nt, Artificial Sequence
  Description of Artificial Sequence: Synthetic oligonucleotide
ccucuuucugaugcuuuu

SEQ ID NO: 138433 - RNA, 18 nt, Artificial Sequence
  Description of Artificial Sequence: Synthetic oligonucleotide
gucugccucuuucugaug

SEQ ID NO: 138434 - RNA, 18 nt, Artificial Sequence
  Description of Artificial Sequence: Synthetic oligonucleotide
ggauggucugccucuuuc

SEQ ID NO: 138435 - RNA, 18 nt, Artificial Sequence
  Description of Artificial Sequence: Synthetic oligonucleotide
cugguggauggucugccu

SEQ ID NO: 138436 - RNA, 18 nt, Artificial Sequence
  Description of Artificial Sequence: Synthetic oligonucleotide
aaggccugguggaugguc

SEQ ID NO: 138437 - RNA, 18 nt, Artificial Sequence
  Description of Artificial Sequence: Synthetic oligonucleotide
ucucaaaggccuggugga

SEQ ID NO: 138438 - RNA, 18 nt, Artificial Sequence
  Description of Artificial Sequence: Synthetic oligonucleotide
cccuuucucaaaggccug

SEQ ID NO: 138439 - RNA, 18 nt, Artificial Sequence
  Description of Artificial Sequence: Synthetic oligonucleotide
uucuacccuuucucaaag

SEQ ID NO: 138440 - RNA, 18 nt, Artificial Sequence
  Description of Artificial Sequence: Synthetic oligonucleotide
cagaauucuacccuuucu

SEQ ID NO: 138441 - RNA, 18 nt, Artificial Sequence
  Description of Artificial Sequence: Synthetic oligonucleotide
ccagccagaauucuaccc

SEQ ID NO: 138442 - RNA, 18 nt, Artificial Sequence
  Description of Artificial Sequence: Synthetic oligonucleotide
cucuaccagccagaauuc

SEQ ID NO: 138443 - RNA, 18 nt, Artificial Sequence
  Description of Artificial Sequence: Synthetic oligonucleotide
accugcucuaccagccag

SEQ ID NO: 138444 - RNA, 18 nt, Artificial Sequence
  Description of Artificial Sequence: Synthetic oligonucleotide
aucucaccugcucuacca

SEQ ID NO: 138445 - RNA, 18 nt, Artificial Sequence
  Description of Artificial Sequence: Synthetic oligonucleotide
gucccaucucaccugcuc

SEQ ID NO: 138446 - RNA, 18 nt, Artificial Sequence
  Description of Artificial Sequence: Synthetic oligonucleotide
ggaaugucccaucucacc

SEQ ID NO: 138447 - RNA, 18 nt, Artificial Sequence
  Description of Artificial Sequence: Synthetic oligonucleotide
ucuuuggaaugucccauc

SEQ ID NO: 138448 - RNA, 18 nt, Artificial Sequence
  Description of Artificial Sequence: Synthetic oligonucleotide
gcuguucuuuggaauguc

SEQ ID NO: 138449 - RNA, 18 nt, Artificial Sequence
  Description of Artificial Sequence: Synthetic oligonucleotide
cucaggcuguucuuugga

SEQ ID NO: 138450 - RNA, 18 nt, Artificial Sequence
  Description of Artificial Sequence: Synthetic oligonucleotide
cuuggcucaggcuguucu

SEQ ID NO: 138451 - RNA, 18 nt, Artificial Sequence
  Description of Artificial Sequence: Synthetic oligonucleotide
uaggccuuggcucaggcu

SEQ ID NO: 138452 - RNA, 18 nt, Artificial Sequence
  Description of Artificial Sequence: Synthetic oligonucleotide
accacuaggccuuggcuc

SEQ ID NO: 138453 - RNA, 18 nt, Artificial Sequence
  Description of Artificial Sequence: Synthetic oligonucleotide
uuacuaccacuaggccuu

SEQ ID NO: 138454 - RNA, 18 nt, Artificial Sequence
  Description of Artificial Sequence: Synthetic oligonucleotide
gauucuuacuaccacuag

SEQ ID NO: 138455 - RNA, 18 nt, Artificial Sequence
  Description of Artificial Sequence: Synthetic oligonucleotide
ugcuagauucuuacuacc

SEQ ID NO: 138456 - RNA, 18 nt, Artificial Sequence
  Description of Artificial Sequence: Synthetic oligonucleotide
auucuugcuagauucuua

SEQ ID NO: 138457 - RNA, 18 nt, Artificial Sequence
  Description of Artificial Sequence: Synthetic oligonucleotide
ccucaauucuugcuagau

SEQ ID NO: 138458 - RNA, 18 nt, Artificial Sequence
  Description of Artificial Sequence: Synthetic oligonucleotide
uucuuccucaauucuugc

SEQ ID NO: 138459 - RNA, 18 nt, Artificial Sequence
  Description of Artificial Sequence: Synthetic oligonucleotide
caccauucuuccucaauu

SEQ ID NO: 138460 - RNA, 18 nt, Artificial Sequence
  Description of Artificial Sequence: Synthetic oligonucleotide
ucccacaccauucuuccu

SEQ ID NO: 138461 - RNA, 18 nt, Artificial Sequence
  Description of Artificial Sequence: Synthetic oligonucleotide
cccucucccacaccauuc

SEQ ID NO: 138462 - RNA, 18 nt, Artificial Sequence
  Description of Artificial Sequence: Synthetic oligonucleotide
aucaucccucucccacac

SEQ ID NO: 138463 - RNA, 18 nt, Artificial Sequence
  Description of Artificial Sequence: Synthetic oligonucleotide
ucuucaucaucccucucc

SEQ ID NO: 138464 - RNA, 18 nt, Artificial Sequence
  Description of Artificial Sequence: Synthetic oligonucleotide
cucucucuucaucauccc

SEQ ID NO: 138465 - RNA, 18 nt, Artificial Sequence
  Description of Artificial Sequence: Synthetic oligonucleotide
gcccucucucucuucauc

SEQ ID NO: 138466 - RNA, 18 nt, Artificial Sequence
  Description of Artificial Sequence: Synthetic oligonucleotide
agcaggcccucucucucu

SEQ ID NO: 138467 - RNA, 18 nt, Artificial Sequence
  Description of Artificial Sequence: Synthetic oligonucleotide
ucuccagcaggcccucuc

SEQ ID NO: 138468 - RNA, 18 nt, Artificial Sequence
  Description of Artificial Sequence: Synthetic oligonucleotide
uaugcucuccagcaggcc

SEQ ID NO: 138469 - RNA, 18 nt, Artificial Sequence
  Description of Artificial Sequence: Synthetic oligonucleotide
gacccuaugcucuccagc

SEQ ID NO: 138470 - RNA, 18 nt, Artificial Sequence
  Description of Artificial Sequence: Synthetic oligonucleotide
uuccagacccuaugcucu

SEQ ID NO: 138471 - RNA, 18 nt, Artificial Sequence
  Description of Artificial Sequence: Synthetic oligonucleotide
ugguguuccagacccuau

SEQ ID NO: 138472 - RNA, 18 nt, Artificial Sequence
  Description of Artificial Sequence: Synthetic oligonucleotide
cagccugguguuccagac

SEQ ID NO: 138473 - RNA, 18 nt, Artificial Sequence
  Description of Artificial Sequence: Synthetic oligonucleotide
gaccucagccugguguuc

SEQ ID NO: 138474 - RNA, 18 nt, Artificial Sequence
  Description of Artificial Sequence: Synthetic oligonucleotide
aucaggaccucagccugg

SEQ ID NO: 138475 - RNA, 18 nt, Artificial Sequence
  Description of Artificial Sequence: Synthetic oligonucleotide
agcugaucaggaccucag

SEQ ID NO: 138476 - RNA, 18 nt, Artificial Sequence
  Description of Artificial Sequence: Synthetic oligonucleotide
cuugaagcugaucaggac

SEQ ID NO: 138477 - RNA, 18 nt, Artificial Sequence
  Description of Artificial Sequence: Synthetic oligonucleotide
uacuccuugaagcugauc

SEQ ID NO: 138478 - RNA, 18 nt, Artificial Sequence
  Description of Artificial Sequence: Synthetic oligonucleotide
cugcauacuccuugaagc

SEQ ID NO: 138479 - RNA, 18 nt, Artificial Sequence
  Description of Artificial Sequence: Synthetic oligonucleotide
gcucccugcauacuccuu

SEQ ID NO: 138480 - RNA, 18 nt, Artificial Sequence
  Description of Artificial Sequence: Synthetic oligonucleotide
gcccagcucccugcauac

SEQ ID NO: 138481 - RNA, 18 nt, Artificial Sequence
  Description of Artificial Sequence: Synthetic oligonucleotide
uggaagcccagcucccug

SEQ ID NO: 138482 - RNA, 18 nt, Artificial Sequence
  Description of Artificial Sequence: Synthetic oligonucleotide
uuuucuggaagcccagcu

SEQ ID NO: 138483 - RNA, 18 nt, Artificial Sequence
  Description of Artificial Sequence: Synthetic oligonucleotide
guucauuuucuggaagcc

SEQ ID NO: 138484 - RNA, 18 nt, Artificial Sequence
  Description of Artificial Sequence: Synthetic oligonucleotide
gcuguguucauuuucugg

SEQ ID NO: 138485 - RNA, 18 nt, Artificial Sequence
  Description of Artificial Sequence: Synthetic oligonucleotide
gaacugcuguguucauuu

SEQ ID NO: 138486 - RNA, 18 nt, Artificial Sequence
  Description of Artificial Sequence: Synthetic oligonucleotide
cugcagaacugcuguguu

SEQ ID NO: 138487 - RNA, 18 nt, Artificial Sequence
  Description of Artificial Sequence: Synthetic oligonucleotide
guccucugcagaacugcu

SEQ ID NO: 138488 - RNA, 18 nt, Artificial Sequence
  Description of Artificial Sequence: Synthetic oligonucleotide
cucccguccucugcagaa

SEQ ID NO: 138489 - RNA, 18 nt, Artificial Sequence
  Description of Artificial Sequence: Synthetic oligonucleotide
ccagccucccguccucug

SEQ ID NO: 138490 - RNA, 18 nt, Artificial Sequence
  Description of Artificial Sequence: Synthetic oligonucleotide
agcuuccagccucccguc

SEQ ID NO: 138491 - RNA, 18 nt, Artificial Sequence
  Description of Artificial Sequence: Synthetic oligonucleotide
cucccagcuuccagccuc

SEQ ID NO: 138492 - RNA, 18 nt, Artificial Sequence
  Description of Artificial Sequence: Synthetic oligonucleotide
cugaccucccagcuucca

SEQ ID NO: 138493 - RNA, 18 nt, Artificial Sequence
  Description of Artificial Sequence: Synthetic oligonucleotide
cccaccugaccucccagc

SEQ ID NO: 138494 - RNA, 18 nt, Artificial Sequence
  Description of Artificial Sequence: Synthetic oligonucleotide
uccaccccaccugaccuc

SEQ ID NO: 138495 - RNA, 18 nt, Artificial Sequence
  Description of Artificial Sequence: Synthetic oligonucleotide
uaucauccaccccaccug

SEQ ID NO: 138496 - RNA, 18 nt, Artificial Sequence
  Description of Artificial Sequence: Synthetic oligonucleotide
cauuauaucauccacccc

SEQ ID NO: 138497 - RNA, 18 nt, Artificial Sequence
  Description of Artificial Sequence: Synthetic oligonucleotide
acccgcauuauaucaucc

SEQ ID NO: 138498 - RNA, 18 nt, Artificial Sequence
  Description of Artificial Sequence: Synthetic oligonucleotide
cucucacccgcauuauau

SEQ ID NO: 138499 - RNA, 18 nt, Artificial Sequence
  Description of Artificial Sequence: Synthetic oligonucleotide
cauuacucucacccgcau

SEQ ID NO: 138500 - RNA, 18 nt, Artificial Sequence
  Description of Artificial Sequence: Synthetic oligonucleotide
agccucauuacucucacc

SEQ ID NO: 138501 - RNA, 18 nt, Artificial Sequence
  Description of Artificial Sequence: Synthetic oligonucleotide
ccccaagccucauuacuc

SEQ ID NO: 138502 - RNA, 18 nt, Artificial Sequence
  Description of Artificial Sequence: Synthetic oligonucleotide
uccagccccaagccucau

SEQ ID NO: 138503 - RNA, 18 nt, Artificial Sequence
  Description of Artificial Sequence: Synthetic oligonucleotide
uccucuccagccccaagc

SEQ ID NO: 138504 - RNA, 18 nt, Artificial Sequence
  Description of Artificial Sequence: Synthetic oligonucleotide
ucuuguccucuccagccc

SEQ ID NO: 138505 - RNA, 18 nt, Artificial Sequence
  Description of Artificial Sequence: Synthetic oligonucleotide
acccaucuuguccucucc

SEQ ID NO: 138506 - RNA, 18 nt, Artificial Sequence
  Description of Artificial Sequence: Synthetic oligonucleotide
gguuuacccaucuugucc

SEQ ID NO: 138507 - RNA, 18 nt, Artificial Sequence
  Description of Artificial Sequence: Synthetic oligonucleotide
gugaggguuuacccaucu

SEQ ID NO: 138508 - RNA, 18 nt, Artificial Sequence
  Description of Artificial Sequence: Synthetic oligonucleotide
cugaugugaggguuuacc

SEQ ID NO: 138509 - RNA, 18 nt, Artificial Sequence
  Description of Artificial Sequence: Synthetic oligonucleotide
ucacucugaugugagggu

SEQ ID NO: 138510 - RNA, 18 nt, Artificial Sequence
  Description of Artificial Sequence: Synthetic oligonucleotide
ggaugucacucugaugug

SEQ ID NO: 138511 - RNA, 18 nt, Artificial Sequence
  Description of Artificial Sequence: Synthetic oligonucleotide
cuccuggaugucacucug

SEQ ID NO: 138512 - RNA, 18 nt, Artificial Sequence
  Description of Artificial Sequence: Synthetic oligonucleotide
uauuccuccuggauguca

SEQ ID NO: 138513 - RNA, 18 nt, Artificial Sequence
  Description of Artificial Sequence: Synthetic oligonucleotide
gagcuuauuccuccugga

SEQ ID NO: 138514 - RNA, 18 nt, Artificial Sequence
  Description of Artificial Sequence: Synthetic oligonucleotide
ccugggagcuuauuccuc

SEQ ID NO: 138515 - RNA, 18 nt, Artificial Sequence
  Description of Artificial Sequence: Synthetic oligonucleotide
caggcccugggagcuuau

SEQ ID NO: 138516 - RNA, 18 nt, Artificial Sequence
  Description of Artificial Sequence: Synthetic oligonucleotide
ugagacaggcccugggag

SEQ ID NO: 138517 - RNA, 18 nt, Artificial Sequence
  Description of Artificial Sequence: Synthetic oligonucleotide
gagcuugagacaggcccu

SEQ ID NO: 138518 - RNA, 18 nt, Artificial Sequence
  Description of Artificial Sequence: Synthetic oligonucleotide
aggaagagcuugagacag

SEQ ID NO: 138519 - RNA, 18 nt, Artificial Sequence
  Description of Artificial Sequence: Synthetic oligonucleotide
gaguaaggaagagcuuga

SEQ ID NO: 138520 - RNA, 18 nt, Artificial Sequence
  Description of Artificial Sequence: Synthetic oligonucleotide
ccugggaguaaggaagag

SEQ ID NO: 138521 - RNA, 18 nt, Artificial Sequence
  Description of Artificial Sequence: Synthetic oligonucleotide
cagugccugggaguaagg

SEQ ID NO: 138522 - RNA, 18 nt, Artificial Sequence
  Description of Artificial Sequence: Synthetic oligonucleotide
uaagacagugccugggag

SEQ ID NO: 138523 - RNA, 18 nt, Artificial Sequence
  Description of Artificial Sequence: Synthetic oligonucleotide
ugccuuaagacagugccu

SEQ ID NO: 138524 - RNA, 18 nt, Artificial Sequence
  Description of Artificial Sequence: Synthetic oligonucleotide
ucagaugccuuaagacag

SEQ ID NO: 138525 - RNA, 18 nt, Artificial Sequence
  Description of Artificial Sequence: Synthetic oligonucleotide
gcaugucagaugccuuaa

SEQ ID NO: 138526 - RNA, 18 nt, Artificial Sequence
  Description of Artificial Sequence: Synthetic oligonucleotide
augaugcaugucagaugc

SEQ ID NO: 138527 - RNA, 18 nt, Artificial Sequence
  Description of Artificial Sequence: Synthetic oligonucleotide
augagaugaugcauguca

SEQ ID NO: 138528 - RNA, 18 nt, Artificial Sequence
  Description of Artificial Sequence: Synthetic oligonucleotide
auuaaaugagaugaugca

SEQ ID NO: 138529 - RNA, 18 nt, Artificial Sequence
  Description of Artificial Sequence: Synthetic oligonucleotide
ggaggauuaaaugagaug

SEQ ID NO: 138530 - RNA, 18 nt, Artificial Sequence
  Description of Artificial Sequence: Synthetic oligonucleotide
ggaagggaggauuaaaug

SEQ ID NO: 138531 - RNA, 18 nt, Artificial Sequence
  Description of Artificial Sequence: Synthetic oligonucleotide
agggaggaagggaggauu

SEQ ID NO: 138532 - RNA, 18 nt, Artificial Sequence
  Description of Artificial Sequence: Synthetic oligonucleotide
uuaauagggaggaaggga

SEQ ID NO: 138533 - RNA, 18 nt, Artificial Sequence
  Description of Artificial Sequence: Synthetic oligonucleotide
cuagguuaauagggagga

SEQ ID NO: 138534 - RNA, 18 nt, Artificial Sequence
  Description of Artificial Sequence: Synthetic oligonucleotide
aaucucuagguuaauagg

SEQ ID NO: 138535 - RNA, 18 nt, Artificial Sequence
  Description of Artificial Sequence: Synthetic oligonucleotide
aaaacaaucucuagguua

SEQ ID NO: 138536 - RNA, 18 nt, Artificial Sequence
  Description of Artificial Sequence: Synthetic oligonucleotide
aaacaaaaacaaucucua

SEQ ID NO: 138537 - RNA, 18 nt, Artificial Sequence
  Description of Artificial Sequence: Synthetic oligonucleotide
auaaaaaacaaaaacaau

SEQ ID NO: 138538 - RNA, 18 nt, Artificial Sequence
  Description of Artificial Sequence: Synthetic oligonucleotide
ggagaauaaaaaacaaaa

SEQ ID NO: 138539 - RNA, 18 nt, Artificial Sequence
  Description of Artificial Sequence: Synthetic oligonucleotide
gaggaggagaauaaaaaa

SEQ ID NO: 138540 - RNA, 18 nt, Artificial Sequence
  Description of Artificial Sequence: Synthetic oligonucleotide
ggagggaggaggagaaua

SEQ ID NO: 138541 - RNA, 18 nt, Artificial Sequence
  Description of Artificial Sequence: Synthetic oligonucleotide
gggagggaggaggagaau

SEQ ID NO: 138542 - RNA, 18 nt, Artificial Sequence
  Description of Artificial Sequence: Synthetic oligonucleotide
agguuaggagggaguggg

SEQ ID NO: 138543 - RNA, 18 nt, Artificial Sequence
  Description of Artificial Sequence: Synthetic oligonucleotide
ucucuagguuaggaggga

SEQ ID NO: 138544 - RNA, 18 nt, Artificial Sequence
  Description of Artificial Sequence: Synthetic oligonucleotide
aacaaucucuagguuagg

SEQ ID NO: 138545 - RNA, 18 nt, Artificial Sequence
  Description of Artificial Sequence: Synthetic oligonucleotide
ucuguaacaaucucuagg

SEQ ID NO: 138546 - RNA, 18 nt, Artificial Sequence
  Description of Artificial Sequence: Synthetic oligonucleotide
cagcuucuguaacaaucu

SEQ ID NO: 138547 - RNA, 18 nt, Artificial Sequence
  Description of Artificial Sequence: Synthetic oligonucleotide
aauuucagcuucuguaac

SEQ ID NO: 138548 - RNA, 18 nt, Artificial Sequence
  Description of Artificial Sequence: Synthetic oligonucleotide
aacgcaauuucagcuucu

SEQ ID NO: 138549 - RNA, 18 nt, Artificial Sequence
  Description of Artificial Sequence: Synthetic oligonucleotide
cuuagaacgcaauuucag

SEQ ID NO: 138550 - RNA, 18 nt, Artificial Sequence
  Description of Artificial Sequence: Synthetic oligonucleotide
caccucuuagaacgcaau

SEQ ID NO: 138551 - RNA, 18 nt, Artificial Sequence
  Description of Artificial Sequence: Synthetic oligonucleotide
cacuucaccucuuagaac

SEQ ID NO: 138552 - RNA, 18 nt, Artificial Sequence
  Description of Artificial Sequence: Synthetic oligonucleotide
aaaaucacuucaccucuu

SEQ ID NO: 138553 - RNA, 18 nt, Artificial Sequence
  Description of Artificial Sequence: Synthetic oligonucleotide
gaaaaaaaaucacuucac

SEQ ID NO: 138554 - RNA, 18 nt, Artificial Sequence
  Description of Artificial Sequence: Synthetic oligonucleotide
uuucagaaaaaaaaucac

SEQ ID NO: 138555 - RNA, 18 nt, Artificial Sequence
  Description of Artificial Sequence: Synthetic oligonucleotide
gugaguuucagaaaaaaa

SEQ ID NO: 138556 - RNA, 18 nt, Artificial Sequence
  Description of Artificial Sequence: Synthetic oligonucleotide
guugugugaguuucagaa

SEQ ID NO: 138557 - RNA, 18 nt, Artificial Sequence
  Description of Artificial Sequence: Synthetic oligonucleotide
uccuaguugugugaguuu

SEQ ID NO: 138558 - RNA, 18 nt, Artificial Sequence
  Description of Artificial Sequence: Synthetic oligonucleotide
ccacuuccuaguugugug

SEQ ID NO: 138559 - RNA, 18 nt, Artificial Sequence
  Description of Artificial Sequence: Synthetic oligonucleotide
cucagccacuuccuaguu

SEQ ID NO: 138560 - RNA, 18 nt, Artificial Sequence
  Description of Artificial Sequence: Synthetic oligonucleotide
ccugacucagccacuucc

SEQ ID NO: 138561 - RNA, 18 nt, Artificial Sequence
  Description of Artificial Sequence: Synthetic oligonucleotide
caaguccugacucagcca

SEQ ID NO: 138562 - RNA, 18 nt, Artificial Sequence
  Description of Artificial Sequence: Synthetic oligonucleotide
ggguucaaguccugacuc

SEQ ID NO: 138563 - RNA, 18 nt, Artificial Sequence
  Description of Artificial Sequence: Synthetic oligonucleotide
gaccuggguucaaguccu

SEQ ID NO: 138564 - RNA, 18 nt, Artificial Sequence
  Description of Artificial Sequence: Synthetic oligonucleotide
agggagaccuggguucaa

SEQ ID NO: 138565 - RNA, 18 nt, Artificial Sequence
  Description of Artificial Sequence: Synthetic oligonucleotide
gauccagggagaccuggg

SEQ ID NO: 138566 - RNA, 18 nt, Artificial Sequence
  Description of Artificial Sequence: Synthetic oligonucleotide
guucugauccagggagac

SEQ ID NO: 138567 - RNA, 18 nt, Artificial Sequence
  Description of Artificial Sequence: Synthetic oligonucleotide
cuccuguucugauccagg

SEQ ID NO: 138568 - RNA, 18 nt, Artificial Sequence
  Description of Artificial Sequence: Synthetic oligonucleotide
aagagcuccuguucugau

SEQ ID NO: 138569 - RNA, 18 nt, Artificial Sequence
  Description of Artificial Sequence: Synthetic oligonucleotide
uaguuaagagcuccuguu

SEQ ID NO: 138570 - RNA, 18 nt, Artificial Sequence
  Description of Artificial Sequence: Synthetic oligonucleotide
cacuguaguuaagagcuc

SEQ ID NO: 138571 - RNA, 18 nt, Artificial Sequence
  Description of Artificial Sequence: Synthetic oligonucleotide
ucagccacuguaguuaag

SEQ ID NO: 138572 - RNA, 18 nt, Artificial Sequence
  Description of Artificial Sequence: Synthetic oligonucleotide
gcuauucagccacuguag

SEQ ID NO: 138573 - RNA, 18 nt, Artificial Sequence
  Description of Artificial Sequence: Synthetic oligonucleotide
gagaagcuauucagccac

SEQ ID NO: 138574 - RNA, 18 nt, Artificial Sequence
  Description of Artificial Sequence: Synthetic oligonucleotide
cuuuggagaagcuauuca

SEQ ID NO: 138575 - RNA, 18 nt, Artificial Sequence
  Description of Artificial Sequence: Synthetic oligonucleotide
ggagccuuuggagaagcu

SEQ ID NO: 138576 - RNA, 18 nt, Artificial Sequence
  Description of Artificial Sequence: Synthetic oligonucleotide
cacagggagccuuuggag

SEQ ID NO: 138577 - RNA, 18 nt, Artificial Sequence
  Description of Artificial Sequence: Synthetic oligonucleotide
gagaacacagggagccuu

SEQ ID NO: 138578 - RNA, 18 nt, Artificial Sequence
  Description of Artificial Sequence: Synthetic oligonucleotide
acggugagaacacaggga

SEQ ID NO: 138579 - RNA, 18 nt, Artificial Sequence
  Description of Artificial Sequence: Synthetic oligonucleotide
ugaucacggugagaacac

SEQ ID NO: 138580 - RNA, 18 nt, Artificial Sequence
  Description of Artificial Sequence: Synthetic oligonucleotide
caacuugaucacggugag

SEQ ID NO: 138581 - RNA, 18 nt, Artificial Sequence
  Description of Artificial Sequence: Synthetic oligonucleotide
ccccucaacuugaucacg

SEQ ID NO: 138582 - RNA, 18 nt, Artificial Sequence
  Description of Artificial Sequence: Synthetic oligonucleotide
ggaagccccucaacuuga

SEQ ID NO: 138583 - RNA, 18 nt, Artificial Sequence
  Description of Artificial Sequence: Synthetic oligonucleotide
gagccggaagccccucaa

SEQ ID NO: 138584 - RNA, 18 nt, Artificial Sequence
  Description of Artificial Sequence: Synthetic oligonucleotide
gaagggagccggaagccc

SEQ ID NO: 138585 - RNA, 18 nt, Artificial Sequence
  Description of Artificial Sequence: Synthetic oligonucleotide
cuguagaagggagccgga

SEQ ID NO: 138586 - RNA, 18 nt, Artificial Sequence
  Description of Artificial Sequence: Synthetic oligonucleotide
ugaggcuguagaagggag

SEQ ID NO: 138587 - RNA, 18 nt, Artificial Sequence
  Description of Artificial Sequence: Synthetic oligonucleotide
guuucugaggcuguagaa

SEQ ID NO: 138588 - RNA, 18 nt, Artificial Sequence
  Description of Artificial Sequence: Synthetic oligonucleotide
gucugguuucugaggcug

SEQ ID NO: 138589 - RNA, 18 nt, Artificial Sequence
  Description of Artificial Sequence: Synthetic oligonucleotide
aacgagucugguuucuga

SEQ ID NO: 138590 - RNA, 18 nt, Artificial Sequence
  Description of Artificial Sequence: Synthetic oligonucleotide
agaagaacgagucugguu

SEQ ID NO: 138591 - RNA, 18 nt, Artificial Sequence
  Description of Artificial Sequence: Synthetic oligonucleotide
uucccagaagaacgaguc

SEQ ID NO: 138592 - RNA, 18 nt, Artificial Sequence
  Description of Artificial Sequence: Synthetic oligonucleotide
caggguucccagaagaac

SEQ ID NO: 138593 - RNA, 18 nt, Artificial Sequence
  Description of Artificial Sequence: Synthetic oligonucleotide
gugggcaggguucccaga

SEQ ID NO: 138594 - RNA, 18 nt, Artificial Sequence
  Description of Artificial Sequence: Synthetic oligonucleotide
ugggagugggcaggguuc

SEQ ID NO: 138595 - RNA, 18 nt, Artificial Sequence
  Description of Artificial Sequence: Synthetic oligonucleotide
gguccugggagugggcag

SEQ ID NO: 138596 - RNA, 18 nt, Artificial Sequence
  Description of Artificial Sequence: Synthetic oligonucleotide
aucuugguccugggagug

SEQ ID NO: 138597 - RNA, 18 nt, Artificial Sequence
  Description of Artificial Sequence: Synthetic oligonucleotide
ggccaaucuugguccugg

SEQ ID NO: 138598 - RNA, 18 nt, Artificial Sequence
  Description of Artificial Sequence: Synthetic oligonucleotide
ccucaggccaaucuuggu

SEQ ID NO: 138599 - RNA, 18 nt, Artificial Sequence
  Description of Artificial Sequence: Synthetic oligonucleotide
ugcagccucaggccaauc

SEQ ID NO: 138600 - RNA, 18 nt, Artificial Sequence
  Description of Artificial Sequence: Synthetic oligonucleotide
uuuagugcagccucaggc

SEQ ID NO: 138601 - RNA, 18 nt, Artificial Sequence
  Description of Artificial Sequence: Synthetic oligonucleotide
ugaauuuuagugcagccu

SEQ ID NO: 138602 - RNA, 18 nt, Artificial Sequence
  Description of Artificial Sequence: Synthetic oligonucleotide
cuaagugaauuuuagugc

SEQ ID NO: 138603 - RNA, 18 nt, Artificial Sequence
  Description of Artificial Sequence: Synthetic oligonucleotide
cgacccuaagugaauuuu

SEQ ID NO: 138604 - RNA, 18 nt, Artificial Sequence
  Description of Artificial Sequence: Synthetic oligonucleotide
augcucgacccuaaguga

SEQ ID NO: 138605 - RNA, 18 nt, Artificial Sequence
  Description of Artificial Sequence: Synthetic oligonucleotide
acaggaugcucgacccua

SEQ ID NO: 138606 - RNA, 18 nt, Artificial Sequence
  Description of Artificial Sequence: Synthetic oligonucleotide
agcaaacaggaugcucga

SEQ ID NO: 138607 - RNA, 18 nt, Artificial Sequence
  Description of Artificial Sequence: Synthetic oligonucleotide
uuaucagcaaacaggaug

SEQ ID NO: 138608 - RNA, 18 nt, Artificial Sequence
  Description of Artificial Sequence: Synthetic oligonucleotide
aauauuuaucagcaaaca

SEQ ID NO: 138609 - RNA, 18 nt, Artificial Sequence
  Description of Artificial Sequence: Synthetic oligonucleotide
uccuuaauauuuaucagc

SEQ ID NO: 138610 - RNA, 18 nt, Artificial Sequence
  Description of Artificial Sequence: Synthetic oligonucleotide
aauucuccuuaauauuua

SEQ ID NO: 138611 - RNA, 18 nt, Artificial Sequence
  Description of Artificial Sequence: Synthetic oligonucleotide
ucaugaauucuccuuaau

SEQ ID NO: 138612 - RNA, 18 nt, Artificial Sequence
  Description of Artificial Sequence: Synthetic oligonucleotide
aagagucaugaauucucc

SEQ ID NO: 138613 - RNA, 18 nt, Artificial Sequence
  Description of Artificial Sequence: Synthetic oligonucleotide
cugucaagagucaugaau

SEQ ID NO: 138614 - RNA, 18 nt, Artificial Sequence
  Description of Artificial Sequence: Synthetic oligonucleotide
aaaagcugucaagaguca

SEQ ID NO: 138615 - RNA, 18 nt, Artificial Sequence
  Description of Artificial Sequence: Synthetic oligonucleotide
gagagaaaagcugucaag

SEQ ID NO: 138616 - RNA, 18 nt, Artificial Sequence
  Description of Artificial Sequence: Synthetic oligonucleotide
gugaagagagaaaagcug

SEQ ID NO: 138617 - RNA, 18 nt, Artificial Sequence
  Description of Artificial Sequence: Synthetic oligonucleotide
gggagugaagagagaaaa

SEQ ID NO: 138618 - RNA, 18 nt, Artificial Sequence
  Description of Artificial Sequence: Synthetic oligonucleotide
cccuccccuugacuuggg

SEQ ID NO: 138619 - RNA, 18 nt, Artificial Sequence
  Description of Artificial Sequence: Synthetic oligonucleotide
gccaccccuccccuugac

SEQ ID NO: 138620 - RNA, 18 nt, Artificial Sequence
  Description of Artificial Sequence: Synthetic oligonucleotide
ccccugccaccccucccc

SEQ ID NO: 138621 - RNA, 18 nt, Artificial Sequence
  Description of Artificial Sequence: Synthetic oligonucleotide
acagaccccugccacccc

SEQ ID NO: 138622 - RNA, 18 nt, Artificial Sequence
  Description of Artificial Sequence: Synthetic oligonucleotide
aggaaacagaccccugcc

SEQ ID NO: 138623 - RNA, 18 nt, Artificial Sequence
  Description of Artificial Sequence: Synthetic oligonucleotide
cuuccaggaaacagaccc

SEQ ID NO: 138624 - RNA, 18 nt, Artificial Sequence
  Description of Artificial Sequence: Synthetic oligonucleotide
ccugacuuccaggaaaca

SEQ ID NO: 138625 - RNA, 18 nt, Artificial Sequence
  Description of Artificial Sequence: Synthetic oligonucleotide
augagccugacuuccagg

SEQ ID NO: 138626 - RNA, 18 nt, Artificial Sequence
  Description of Artificial Sequence: Synthetic oligonucleotide
gccagaugagccugacuu

SEQ ID NO: 138627 - RNA, 18 nt, Artificial Sequence
  Description of Artificial Sequence: Synthetic oligonucleotide
aacaggccagaugagccu

SEQ ID NO: 138628 - RNA, 18 nt, Artificial Sequence
  Description of Artificial Sequence: Synthetic oligonucleotide
augccaacaggccagaug

SEQ ID NO: 138629 - RNA, 18 nt, Artificial Sequence
  Description of Artificial Sequence: Synthetic oligonucleotide
cccccaugccaacaggcc

SEQ ID NO: 138630 - RNA, 18 nt, Artificial Sequence
  Description of Artificial Sequence: Synthetic oligonucleotide
ucccacccccaugccaac

SEQ ID NO: 138631 - RNA, 18 nt, Artificial Sequence
  Description of Artificial Sequence: Synthetic oligonucleotide
cacugucccacccccaug

SEQ ID NO: 138632 - RNA, 18 nt, Artificial Sequence
  Description of Artificial Sequence: Synthetic oligonucleotide
gugcacacugucccaccc

SEQ ID NO: 138633 - RNA, 18 nt, Artificial Sequence
  Description of Artificial Sequence: Synthetic oligonucleotide
acacugugcacacugucc

SEQ ID NO: 138634 - RNA, 18 nt, Artificial Sequence
  Description of Artificial Sequence: Synthetic oligonucleotide
cccccacacugugcacac

SEQ ID NO: 138635 - RNA, 18 nt, Artificial Sequence
  Description of Artificial Sequence: Synthetic oligonucleotide
cccugcccccacacugug

SEQ ID NO: 138636 - RNA, 18 nt, Artificial Sequence
  Description of Artificial Sequence: Synthetic oligonucleotide
cccuccccugcccccaca

SEQ ID NO: 138637 - RNA, 18 nt, Artificial Sequence
  Description of Artificial Sequence: Synthetic oligonucleotide
cuuagcccuccccugccc

SEQ ID NO: 138638 - RNA, 18 nt, Artificial Sequence
  Description of Artificial Sequence: Synthetic oligonucleotide
gccugcuuagcccucccc

SEQ ID NO: 138639 - RNA, 18 nt, Artificial Sequence
  Description of Artificial Sequence: Synthetic oligonucleotide
cccaggccugcuuagccc

SEQ ID NO: 138640 - RNA, 18 nt, Artificial Sequence
  Description of Artificial Sequence: Synthetic oligonucleotide
ucaaacccaggccugcuu

SEQ ID NO: 138641 - RNA, 18 nt, Artificial Sequence
  Description of Artificial Sequence: Synthetic oligonucleotide
agcccucaaacccaggcc

SEQ ID NO: 138642 - RNA, 18 nt, Artificial Sequence
  Description of Artificial Sequence: Synthetic oligonucleotide
ggagcagcccucaaaccc

SEQ ID NO: 138643 - RNA, 18 nt, Artificial Sequence
  Description of Artificial Sequence: Synthetic oligonucleotide
ucuccggagcagcccuca

SEQ ID NO: 138644 - RNA, 18 nt, Artificial Sequence
  Description of Artificial Sequence: Synthetic oligonucleotide
gacggucuccggagcagc

SEQ ID NO: 138645 - RNA, 18 nt, Artificial Sequence
  Description of Artificial Sequence: Synthetic oligonucleotide
ggagugacggucuccgga

SEQ ID NO: 138646 - RNA, 18 nt, Artificial Sequence
  Description of Artificial Sequence: Synthetic oligonucleotide
caccuggagugacggucu

SEQ ID NO: 138647 - RNA, 18 nt, Artificial Sequence
  Description of Artificial Sequence: Synthetic oligonucleotide
gaaugcaccuggagugac

SEQ ID NO: 138648 - RNA, 18 nt, Artificial Sequence
  Description of Artificial Sequence: Synthetic oligonucleotide
uuccagaaugcaccugga

SEQ ID NO: 138649 - RNA, 18 nt, Artificial Sequence
  Description of Artificial Sequence: Synthetic oligonucleotide
aaugcuuccagaaugcac

SEQ ID NO: 138650 - RNA, 18 nt, Artificial Sequence
  Description of Artificial Sequence: Synthetic oligonucleotide
ggucuaaugcuuccagaa

SEQ ID NO: 138651 - RNA, 18 nt, Artificial Sequence
  Description of Artificial Sequence: Synthetic oligonucleotide
gggucuaaugcuuccaga

SEQ ID NO: 138652 - RNA, 18 nt, Artificial Sequence
  Description of Artificial Sequence: Synthetic oligonucleotide
uggucgcuccauccuggg

SEQ ID NO: 138653 - RNA, 18 nt, Artificial Sequence
  Description of Artificial Sequence: Synthetic oligonucleotide
caugcuggucgcuccauc

SEQ ID NO: 138654 - RNA, 18 nt, Artificial Sequence
  Description of Artificial Sequence: Synthetic oligonucleotide
gaugacaugcuggucgcu

SEQ ID NO: 138655 - RNA, 18 nt, Artificial Sequence
  Description of Artificial Sequence: Synthetic oligonucleotide
acauggaugacaugcugg

SEQ ID NO: 138656 - RNA, 18 nt, Artificial Sequence
  Description of Artificial Sequence: Synthetic oligonucleotide
auuccacauggaugacau

SEQ ID NO: 138657 - RNA, 18 nt, Artificial Sequence
  Description of Artificial Sequence: Synthetic oligonucleotide
ccaagauuccacauggau

SEQ ID NO: 138658 - RNA, 18 nt, Artificial Sequence
  Description of Artificial Sequence: Synthetic oligonucleotide
agccaccaagauuccaca

SEQ ID NO: 138659 - RNA, 18 nt, Artificial Sequence
  Description of Artificial Sequence: Synthetic oligonucleotide
cucaaagccaccaagauu

SEQ ID NO: 138660 - RNA, 18 nt, Artificial Sequence
  Description of Artificial Sequence: Synthetic oligonucleotide
auguccucaaagccacca

SEQ ID NO: 138661 - RNA, 18 nt, Artificial Sequence
  Description of Artificial Sequence: Synthetic oligonucleotide
ccagaauguccucaaagc

SEQ ID NO: 138662 - RNA, 18 nt, Artificial Sequence
  Description of Artificial Sequence: Synthetic oligonucleotide
auuuuccagaauguccuc

SEQ ID NO: 138663 - RNA, 18 nt, Artificial Sequence
  Description of Artificial Sequence: Synthetic oligonucleotide
guggcauuuuccagaaug

SEQ ID NO: 138664 - RNA, 18 nt, Artificial Sequence
  Description of Artificial Sequence: Synthetic oligonucleotide
ggucaguggcauuuucca

SEQ ID NO: 138665 - RNA, 18 nt, Artificial Sequence
  Description of Artificial Sequence: Synthetic oligonucleotide
acacuggucaguggcauu

SEQ ID NO: 138666 - RNA, 18 nt, Artificial Sequence
  Description of Artificial Sequence: Synthetic oligonucleotide
uguucacacuggucagug

SEQ ID NO: 138667 - RNA, 18 nt, Artificial Sequence
  Description of Artificial Sequence: Synthetic oligonucleotide
ccuuuuguucacacuggu

SEQ ID NO: 138668 - RNA, 18 nt, Artificial Sequence
  Description of Artificial Sequence: Synthetic oligonucleotide
acaucccuuuuguucaca

SEQ ID NO: 138669 - RNA, 18 nt, Artificial Sequence
  Description of Artificial Sequence: Synthetic oligonucleotide
auaacacaucccuuuugu

SEQ ID NO: 138670 - RNA, 18 nt, Artificial Sequence
  Description of Artificial Sequence: Synthetic oligonucleotide
gccccauaacacaucccu

SEQ ID NO: 138671 - RNA, 18 nt, Artificial Sequence
  Description of Artificial Sequence: Synthetic oligonucleotide
cuccagccccauaacaca

SEQ ID NO: 138672 - RNA, 18 nt, Artificial Sequence
  Description of Artificial Sequence: Synthetic oligonucleotide
cacaccuccagccccaua

SEQ ID NO: 138673 - RNA, 18 nt, Artificial Sequence
  Description of Artificial Sequence: Synthetic oligonucleotide
cuaaucacaccuccagcc

SEQ ID NO: 138674 - RNA, 18 nt, Artificial Sequence
  Description of Artificial Sequence: Synthetic oligonucleotide
ccuaccuaaucacaccuc

SEQ ID NO: 138675 - RNA, 18 nt, Artificial Sequence
  Description of Artificial Sequence: Synthetic oligonucleotide
ucccuccuaccuaaucac

SEQ ID NO: 138676 - RNA, 18 nt, Artificial Sequence
  Description of Artificial Sequence: Synthetic oligonucleotide
caguuucccuccuaccua

SEQ ID NO: 138677 - RNA, 18 nt, Artificial Sequence
  Description of Artificial Sequence: Synthetic oligonucleotide
uccaacaguuucccuccu

SEQ ID NO: 138678 - RNA, 18 nt, Artificial Sequence
  Description of Artificial Sequence: Synthetic oligonucleotide
gucgguccaacaguuucc

SEQ ID NO: 138679 - RNA, 18 nt, Artificial Sequence
  Description of Artificial Sequence: Synthetic oligonucleotide
caggagucgguccaacag

SEQ ID NO: 138680 - RNA, 18 nt, Artificial Sequence
  Description of Artificial Sequence: Synthetic oligonucleotide
gggcaggagucgguccaa

SEQ ID NO: 138681 - RNA, 18 nt, Artificial Sequence
  Description of Artificial Sequence: Synthetic oligonucleotide
ggucaguguugagcaggg

SEQ ID NO: 138682 - RNA, 18 nt, Artificial Sequence
  Description of Artificial Sequence: Synthetic oligonucleotide
gggucaguguugagcagg

SEQ ID NO: 138683 - RNA, 18 nt, Artificial Sequence
  Description of Artificial Sequence: Synthetic oligonucleotide
cuccaaccacucagaggg

SEQ ID NO: 138684 - RNA, 18 nt, Artificial Sequence
  Description of Artificial Sequence: Synthetic oligonucleotide
acugccuccaaccacuca

SEQ ID NO: 138685 - RNA, 18 nt, Artificial Sequence
  Description of Artificial Sequence: Synthetic oligonucleotide
gggcacugccuccaacca

SEQ ID NO: 138686 - RNA, 18 nt, Artificial Sequence
  Description of Artificial Sequence: Synthetic oligonucleotide
ggauuucugggcacuggg

SEQ ID NO: 138687 - RNA, 18 nt, Artificial Sequence
  Description of Artificial Sequence: Synthetic oligonucleotide
uggugggauuucugggca

SEQ ID NO: 138688 - RNA, 18 nt, Artificial Sequence
  Description of Artificial Sequence: Synthetic oligonucleotide
acuaauggugggauuucu

SEQ ID NO: 138689 - RNA, 18 nt, Artificial Sequence
  Description of Artificial Sequence: Synthetic oligonucleotide
caaucacuaaugguggga

SEQ ID NO: 138690 - RNA, 18 nt, Artificial Sequence
  Description of Artificial Sequence: Synthetic oligonucleotide
aaaaacaaucacuaaugg

SEQ ID NO: 138691 - RNA, 18 nt, Artificial Sequence
  Description of Artificial Sequence: Synthetic oligonucleotide
ucauaaaaaacaaucacu

SEQ ID NO: 138692 - RNA, 18 nt, Artificial Sequence
  Description of Artificial Sequence: Synthetic oligonucleotide
cuuucucauaaaaaacaa

SEQ ID NO: 138693 - RNA, 18 nt, Artificial Sequence
  Description of Artificial Sequence: Synthetic oligonucleotide
cgccucuuucucauaaaa

SEQ ID NO: 138694 - RNA, 18 nt, Artificial Sequence
  Description of Artificial Sequence: Synthetic oligonucleotide
cuccacgccucuuucuca

SEQ ID NO: 138695 - RNA, 18 nt, Artificial Sequence
  Description of Artificial Sequence: Synthetic oligonucleotide
uacuucuccacgccucuu

SEQ ID NO: 138696 - RNA, 18 nt, Artificial Sequence
  Description of Artificial Sequence: Synthetic oligonucleotide
cccaauacuucuccacgc

SEQ ID NO: 138697 - RNA, 18 nt, Artificial Sequence
  Description of Artificial Sequence: Synthetic oligonucleotide
auugccccaauacuucuc

SEQ ID NO: 138698 - RNA, 18 nt, Artificial Sequence
  Description of Artificial Sequence: Synthetic oligonucleotide
gacacauugccccaauac

SEQ ID NO: 138699 - RNA, 18 nt, Artificial Sequence
  Description of Artificial Sequence: Synthetic oligonucleotide
ucccugacacauugcccc

SEQ ID NO: 138700 - RNA, 18 nt, Artificial Sequence
  Description of Artificial Sequence: Synthetic oligonucleotide
auuccucccugacacauu

SEQ ID NO: 138701 - RNA, 18 nt, Artificial Sequence
  Description of Artificial Sequence: Synthetic oligonucleotide
uggugauuccucccugac

SEQ ID NO: 138702 - RNA, 18 nt, Artificial Sequence
  Description of Artificial Sequence: Synthetic oligonucleotide
ggauguggugauuccucc

SEQ ID NO: 138703 - RNA, 18 nt, Artificial Sequence
  Description of Artificial Sequence: Synthetic oligonucleotide
cguagggauguggugauu

SEQ ID NO: 138704 - RNA, 18 nt, Artificial Sequence
  Description of Artificial Sequence: Synthetic oligonucleotide
acugccguagggaugugg

SEQ ID NO: 138705 - RNA, 18 nt, Artificial Sequence
  Description of Artificial Sequence: Synthetic oligonucleotide
cugggacugccguaggga

SEQ ID NO: 138706 - RNA, 18 nt, Artificial Sequence
  Description of Artificial Sequence: Synthetic oligonucleotide
cuuggcugggacugccgu

SEQ ID NO: 138707 - RNA, 18 nt, Artificial Sequence
  Description of Artificial Sequence: Synthetic oligonucleotide
gggcuuggcugggacugc

SEQ ID NO: 138708 - RNA, 18 nt, Artificial Sequence
  Description of Artificial Sequence: Synthetic oligonucleotide
gucuccgcugggauuggg

SEQ ID NO: 138709 - RNA, 18 nt, Artificial Sequence
  Description of Artificial Sequence: Synthetic oligonucleotide
gcacagucuccgcuggga

SEQ ID NO: 138710 - RNA, 18 nt, Artificial Sequence
  Description of Artificial Sequence: Synthetic oligonucleotide
gcagggcacagucuccgc

SEQ ID NO: 138711 - RNA, 18 nt, Artificial Sequence
  Description of Artificial Sequence: Synthetic oligonucleotide
ucugagcagggcacaguc

SEQ ID NO: 138712 - RNA, 18 nt, Artificial Sequence
  Description of Artificial Sequence: Synthetic oligonucleotide
ggagcucugagcagggca

SEQ ID NO: 138713 - RNA, 18 nt, Artificial Sequence
  Description of Artificial Sequence: Synthetic oligonucleotide
gcuugggagcucugagca

SEQ ID NO: 138714 - RNA, 18 nt, Artificial Sequence
  Description of Artificial Sequence: Synthetic oligonucleotide
ggaaggcuugggagcucu

SEQ ID NO: 138715 - RNA, 18 nt, Artificial Sequence
  Description of Artificial Sequence: Synthetic oligonucleotide
gggaaggcuugggagcuc

SEQ ID NO: 138716 - RNA, 18 nt, Artificial Sequence
  Description of Artificial Sequence: Synthetic oligonucleotide
cuugagugaggugguggg

SEQ ID NO: 138717 - RNA, 18 nt, Artificial Sequence
  Description of Artificial Sequence: Synthetic oligonucleotide
gggcacuugagugaggug

SEQ ID NO: 138718 - RNA, 18 nt, Artificial Sequence
  Description of Artificial Sequence: Synthetic oligonucleotide
ccgucuggcagggauuuc

SEQ ID NO: 138719 - RNA, 18 nt, Artificial Sequence
  Description of Artificial Sequence: Synthetic oligonucleotide
cugagccgucuggcaggg

SEQ ID NO: 138720 - RNA, 18 nt, Artificial Sequence
  Description of Artificial Sequence: Synthetic oligonucleotide
ccaggcugagccgucugg

SEQ ID NO: 138721 - RNA, 18 nt, Artificial Sequence
  Description of Artificial Sequence: Synthetic oligonucleotide
gcagaccaggcugagccg

SEQ ID NO: 138722 - RNA, 18 nt, Artificial Sequence
  Description of Artificial Sequence: Synthetic oligonucleotide
uuaccgcagaccaggcug

SEQ ID NO: 138723 - RNA, 18 nt, Artificial Sequence
  Description of Artificial Sequence: Synthetic oligonucleotide
cugccuuaccgcagacca

SEQ ID NO: 138724 - RNA, 18 nt, Artificial Sequence
  Description of Artificial Sequence: Synthetic oligonucleotide
ccucccugccuuaccgca

SEQ ID NO: 138725 - RNA, 18 nt, Artificial Sequence
  Description of Artificial Sequence: Synthetic oligonucleotide
uccagccucccugccuua

SEQ ID NO: 138726 - RNA, 18 nt, Artificial Sequence
  Description of Artificial Sequence: Synthetic oligonucleotide
augguuccagccucccug

SEQ ID NO: 138727 - RNA, 18 nt, Artificial Sequence
  Description of Artificial Sequence: Synthetic oligonucleotide
cagaaaugguuccagccu

SEQ ID NO: 138728 - RNA, 18 nt, Artificial Sequence
  Description of Artificial Sequence: Synthetic oligonucleotide
augcccagaaaugguucc

SEQ ID NO: 138729 - RNA, 18 nt, Artificial Sequence
  Description of Artificial Sequence: Synthetic oligonucleotide
ccacaaugcccagaaaug

SEQ ID NO: 138730 - RNA, 18 nt, Artificial Sequence
  Description of Artificial Sequence: Synthetic oligonucleotide
aaugaccacaaugcccag

SEQ ID NO: 138731 - RNA, 18 nt, Artificial Sequence
  Description of Artificial Sequence: Synthetic oligonucleotide
gugggaaugaccacaaug

SEQ ID NO: 138732 - RNA, 18 nt, Artificial Sequence
  Description of Artificial Sequence: Synthetic oligonucleotide
acacagugggaaugacca

SEQ ID NO: 138733 - RNA, 18 nt, Artificial Sequence
  Description of Artificial Sequence: Synthetic oligonucleotide
gaggaacacagugggaau

SEQ ID NO: 138734 - RNA, 18 nt, Artificial Sequence
  Description of Artificial Sequence: Synthetic oligonucleotide
agguggaggaacacagug

SEQ ID NO: 138735 - RNA, 18 nt, Artificial Sequence
  Description of Artificial Sequence: Synthetic oligonucleotide
ggaggagguggaggaaca

SEQ ID NO: 138736 - RNA, 18 nt, Artificial Sequence
  Description of Artificial Sequence: Synthetic oligonucleotide
uggagggaggagguggag

SEQ ID NO: 138737 - RNA, 18 nt, Artificial Sequence
  Description of Artificial Sequence: Synthetic oligonucleotide
aacgcuggagggaggagg

SEQ ID NO: 138738 - RNA, 18 nt, Artificial Sequence
  Description of Artificial Sequence: Synthetic oligonucleotide
ugagcaacgcuggaggga

SEQ ID NO: 138739 - RNA, 18 nt, Artificial Sequence
  Description of Artificial Sequence: Synthetic oligonucleotide
aggucugagcaacgcugg

SEQ ID NO: 138740 - RNA, 18 nt, Artificial Sequence
  Description of Artificial Sequence: Synthetic oligonucleotide
gacagaggucugagcaac

SEQ ID NO: 138741 - RNA, 18 nt, Artificial Sequence
  Description of Artificial Sequence: Synthetic oligonucleotide
cccaagacagaggucuga

SEQ ID NO: 138742 - RNA, 18 nt, Artificial Sequence
  Description of Artificial Sequence: Synthetic oligonucleotide
uuucucccaagacagagg

SEQ ID NO: 138743 - RNA, 18 nt, Artificial Sequence
  Description of Artificial Sequence: Synthetic oligonucleotide
caaccuuucucccaagac

SEQ ID NO: 138744 - RNA, 18 nt, Artificial Sequence
  Description of Artificial Sequence: Synthetic oligonucleotide
uaucucaaccuuucuccc

SEQ ID NO: 138745 - RNA, 18 nt, Artificial Sequence
  Description of Artificial Sequence: Synthetic oligonucleotide
auucuuaucucaaccuuu

SEQ ID NO: 138746 - RNA, 18 nt, Artificial Sequence
  Description of Artificial Sequence: Synthetic oligonucleotide
gggacauucuuaucucaa

SEQ ID NO: 138747 - RNA, 18 nt, Artificial Sequence
  Description of Artificial Sequence: Synthetic oligonucleotide
uccaugggacauucuuau

SEQ ID NO: 138748 - RNA, 18 nt, Artificial Sequence
  Description of Artificial Sequence: Synthetic oligonucleotide
ggcacuccaugggacauu

SEQ ID NO: 138749 - RNA, 18 nt, Artificial Sequence
  Description of Artificial Sequence: Synthetic oligonucleotide
cccacggcacuccauggg

SEQ ID NO: 138750 - RNA, 18 nt, Artificial Sequence
  Description of Artificial Sequence: Synthetic oligonucleotide
uguugcccacggcacucc

SEQ ID NO: 138751 - RNA, 18 nt, Artificial Sequence
  Description of Artificial Sequence: Synthetic oligonucleotide
gccacuguugcccacggc

SEQ ID NO: 138752 - RNA, 18 nt, Artificial Sequence
  Description of Artificial Sequence: Synthetic oligonucleotide
gaagggccacuguugccc

SEQ ID NO: 138753 - RNA, 18 nt, Artificial Sequence
  Description of Artificial Sequence: Synthetic oligonucleotide
cccaugaagggccacugu

SEQ ID NO: 138754 - RNA, 18 nt, Artificial Sequence
  Description of Artificial Sequence: Synthetic oligonucleotide
uuguucccaugaagggcc

SEQ ID NO: 138755 - RNA, 18 nt, Artificial Sequence
  Description of Artificial Sequence: Synthetic oligonucleotide
acagauuguucccaugaa

SEQ ID NO: 138756 - RNA, 18 nt, Artificial Sequence
  Description of Artificial Sequence: Synthetic oligonucleotide
cuccaacagauuguuccc

SEQ ID NO: 138757 - RNA, 18 nt, Artificial Sequence
  Description of Artificial Sequence: Synthetic oligonucleotide
cccugcuccaacagauug

SEQ ID NO: 138758 - RNA, 18 nt, Artificial Sequence
  Description of Artificial Sequence: Synthetic oligonucleotide
ugacccccugcuccaaca

SEQ ID NO: 138759 - RNA, 18 nt, Artificial Sequence
  Description of Artificial Sequence: Synthetic oligonucleotide
agaacugacccccugcuc

SEQ ID NO: 138760 - RNA, 18 nt, Artificial Sequence
  Description of Artificial Sequence: Synthetic oligonucleotide
agcagagaacugaccccc

SEQ ID NO: 138761 - RNA, 18 nt, Artificial Sequence
  Description of Artificial Sequence: Synthetic oligonucleotide
uucccagcagagaacuga

SEQ ID NO: 138762 - RNA, 18 nt, Artificial Sequence
  Description of Artificial Sequence: Synthetic oligonucleotide
guagauucccagcagaga

SEQ ID NO: 138763 - RNA, 18 nt, Artificial Sequence
  Description of Artificial Sequence: Synthetic oligonucleotide
ggguagauucccagcaga

SEQ ID NO: 138764 - RNA, 18 nt, Artificial Sequence
  Description of Artificial Sequence: Synthetic oligonucleotide
uuucuccuccagaaaggg

SEQ ID NO: 138765 - RNA, 18 nt, Artificial Sequence
  Description of Artificial Sequence: Synthetic oligonucleotide
auggguuucuccuccaga

SEQ ID NO: 138766 - RNA, 18 nt, Artificial Sequence
  Description of Artificial Sequence: Synthetic oligonucleotide
guggaauggguuucuccu

SEQ ID NO: 138767 - RNA, 18 nt, Artificial Sequence
  Description of Artificial Sequence: Synthetic oligonucleotide
uuaagguggaauggguuu

SEQ ID NO: 138768 - RNA, 18 nt, Artificial Sequence
  Description of Artificial Sequence: Synthetic oligonucleotide
aguuauuaagguggaaug

SEQ ID NO: 138769 - RNA, 18 nt, Artificial Sequence
  Description of Artificial Sequence: Synthetic oligonucleotide
aauaaaguuauuaaggug

SEQ ID NO: 138770 - RNA, 18 nt, Artificial Sequence
  Description of Artificial Sequence: Synthetic oligonucleotide
auuacaauaaaguuauua

SEQ ID NO: 138771 - RNA, 18 nt, Artificial Sequence
  Description of Artificial Sequence: Synthetic oligonucleotide
cucacauuacaauaaagu

SEQ ID NO: 138772 - RNA, 18 nt, Artificial Sequence
  Description of Artificial Sequence: Synthetic oligonucleotide
uguuucucacauuacaau

SEQ ID NO: 138773 - RNA, 18 nt, Artificial Sequence
  Description of Artificial Sequence: Synthetic oligonucleotide
uuuuguguuucucacauu

SEQ ID NO: 138774 - RNA, 18 nt, Artificial Sequence
  Description of Artificial Sequence: Synthetic oligonucleotide
cuuuguuuuguguuucuc

SEQ ID NO: 138775 - RNA, 18 nt, Artificial Sequence
  Description of Artificial Sequence: Synthetic oligonucleotide
guaaacuuuguuuugugu

SEQ ID NO: 138776 - RNA, 18 nt, Artificial Sequence
  Description of Artificial Sequence: Synthetic oligonucleotide
aaaaaguaaacuuuguuu

SEQ ID NO: 138777 - RNA, 18 nt, Artificial Sequence
  Description of Artificial Sequence: Synthetic oligonucleotide
agucaaaaaaguaaacuu

SEQ ID NO: 138778 - RNA, 18 nt, Artificial Sequence
  Description of Artificial Sequence: Synthetic oligonucleotide
cuuagagucaaaaaagua

SEQ ID NO: 138779 - RNA, 18 nt, Artificial Sequence
  Description of Artificial Sequence: Synthetic oligonucleotide
gucagcuuagagucaaaa

SEQ ID NO: 138780 - RNA, 18 nt, Artificial Sequence
  Description of Artificial Sequence: Synthetic oligonucleotide
aucaugucagcuuagagu

SEQ ID NO: 138781 - RNA, 18 nt, Artificial Sequence
  Description of Artificial Sequence: Synthetic oligonucleotide
cuaauaucaugucagcuu

SEQ ID NO: 138782 - RNA, 18 nt, Artificial Sequence
  Description of Artificial Sequence: Synthetic oligonucleotide
auuuucuaauaucauguc

SEQ ID NO: 138783 - RNA, 18 nt, Artificial Sequence
  Description of Artificial Sequence: Synthetic oligonucleotide
gagagauuuucuaauauc

SEQ ID NO: 138784 - RNA, 18 nt, Artificial Sequence
  Description of Artificial Sequence: Synthetic oligonucleotide
agagcgagagauuuucua

SEQ ID NO: 138785 - RNA, 18 nt, Artificial Sequence
  Description of Artificial Sequence: Synthetic oligonucleotide
aaaagagagcgagagauu

SEQ ID NO: 138786 - RNA, 18 nt, Artificial Sequence
  Description of Artificial Sequence: Synthetic oligonucleotide
aaaaaaaaagagagcgag

SEQ ID NO: 138787 - RNA, 18 nt, Artificial Sequence
  Description of Artificial Sequence: Synthetic oligonucleotide
aaaaaaaaaaaaaagaga

SEQ ID NO: 138788 - RNA, 18 nt, Artificial Sequence
  Description of Artificial Sequence: Synthetic oligonucleotide
aaaaaaaaaaaaaaaaaa

SEQ ID NO: 138789 - RNA, 18 nt, Artificial Sequence
  Description of Artificial Sequence: Synthetic oligonucleotide
aaaaaaaaaaaaaaaaaa

SEQ ID NO: 138790 - RNA, 18 nt, Artificial Sequence
  Description of Artificial Sequence: Synthetic oligonucleotide
uagccaaaaaaaaaaaaa

SEQ ID NO: 138791 - RNA, 18 nt, Artificial Sequence
  Description of Artificial Sequence: Synthetic oligonucleotide
ucaaguagccaaaaaaaa

SEQ ID NO: 138792 - RNA, 18 nt, Artificial Sequence
  Description of Artificial Sequence: Synthetic oligonucleotide
acaacucaaguagccaaa

SEQ ID NO: 138793 - RNA, 18 nt, Artificial Sequence
  Description of Artificial Sequence: Synthetic oligonucleotide
ggaccacaacucaaguag

SEQ ID NO: 138794 - RNA, 18 nt, Artificial Sequence
  Description of Artificial Sequence: Synthetic oligonucleotide
uuuuaggaccacaacuca

SEQ ID NO: 138795 - RNA, 18 nt, Artificial Sequence
  Description of Artificial Sequence: Synthetic oligonucleotide
uuauguuuuaggaccaca

SEQ ID NO: 138796 - RNA, 18 nt, Artificial Sequence
  Description of Artificial Sequence: Synthetic oligonucleotide
agauuuuauguuuuagga

SEQ ID NO: 138797 - RNA, 18 nt, Artificial Sequence
  Description of Artificial Sequence: Synthetic oligonucleotide
ccaucagauuuuauguuu

SEQ ID NO: 138798 - RNA, 18 nt, Artificial Sequence
  Description of Artificial Sequence: Synthetic oligonucleotide
uuuguccaucagauuuua

SEQ ID NO: 138799 - RNA, 18 nt, Artificial Sequence
  Description of Artificial Sequence: Synthetic oligonucleotide
cucuguuuguccaucaga

SEQ ID NO: 138800 - RNA, 18 nt, Artificial Sequence
  Description of Artificial Sequence: Synthetic oligonucleotide
caacccucuguuugucca

SEQ ID NO: 138801 - RNA, 18 nt, Artificial Sequence
  Description of Artificial Sequence: Synthetic oligonucleotide
cccagcaacccucuguuu

SEQ ID NO: 138802 - RNA, 18 nt, Artificial Sequence
  Description of Artificial Sequence: Synthetic oligonucleotide
guccccccagcaacccuc

SEQ ID NO: 138803 - RNA, 18 nt, Artificial Sequence
  Description of Artificial Sequence: Synthetic oligonucleotide
cgcuuguccccccagcaa

SEQ ID NO: 138804 - RNA, 18 nt, Artificial Sequence
  Description of Artificial Sequence: Synthetic oligonucleotide
gcccacgcuugucccccc

SEQ ID NO: 138805 - RNA, 18 nt, Artificial Sequence
  Description of Artificial Sequence: Synthetic oligonucleotide
auugugcccacgcuuguc

SEQ ID NO: 138806 - RNA, 18 nt, Artificial Sequence
  Description of Artificial Sequence: Synthetic oligonucleotide
gggaaauugugcccacgc

SEQ ID NO: 138807 - RNA, 18 nt, Artificial Sequence
  Description of Artificial Sequence: Synthetic oligonucleotide
aagaucagggugucuugg

SEQ ID NO: 138808 - RNA, 18 nt, Artificial Sequence
  Description of Artificial Sequence: Synthetic oligonucleotide
gccugaagaucagggugu

SEQ ID NO: 138809 - RNA, 18 nt, Artificial Sequence
  Description of Artificial Sequence: Synthetic oligonucleotide
gacccgccugaagaucag

SEQ ID NO: 138810 - RNA, 18 nt, Artificial Sequence
  Description of Artificial Sequence: Synthetic oligonucleotide
ccugagacccgccugaag

SEQ ID NO: 138811 - RNA, 18 nt, Artificial Sequence
  Description of Artificial Sequence: Synthetic oligonucleotide
aagcuccugagacccgcc

SEQ ID NO: 138812 - RNA, 18 nt, Artificial Sequence
  Description of Artificial Sequence: Synthetic oligonucleotide
uuuagaagcuccugagac

SEQ ID NO: 138813 - RNA, 18 nt, Artificial Sequence
  Description of Artificial Sequence: Synthetic oligonucleotide
ggauuuuuagaagcuccu

SEQ ID NO: 138814 - RNA, 18 nt, Artificial Sequence
  Description of Artificial Sequence: Synthetic oligonucleotide
caugcggauuuuuagaag

SEQ ID NO: 138815 - RNA, 18 nt, Artificial Sequence
  Description of Artificial Sequence: Synthetic oligonucleotide
agagccaugcggauuuuu

SEQ ID NO: 138816 - RNA, 18 nt, Artificial Sequence
  Description of Artificial Sequence: Synthetic oligonucleotide
ucaggagagccaugcgga

SEQ ID NO: 138817 - RNA, 18 nt, Artificial Sequence
  Description of Artificial Sequence: Synthetic oligonucleotide
cacucucaggagagccau

SEQ ID NO: 138818 - RNA, 18 nt, Artificial Sequence
  Description of Artificial Sequence: Synthetic oligonucleotide
cuguccacucucaggaga

SEQ ID NO: 138819 - RNA, 18 nt, Artificial Sequence
  Description of Artificial Sequence: Synthetic oligonucleotide
cuccucuguccacucuca

SEQ ID NO: 138820 - RNA, 18 nt, Artificial Sequence
  Description of Artificial Sequence: Synthetic oligonucleotide
cuccucuccucuguccac

SEQ ID NO: 138821 - RNA, 18 nt, Artificial Sequence
  Description of Artificial Sequence: Synthetic oligonucleotide
acccucuccucuccucug

SEQ ID NO: 138822 - RNA, 18 nt, Artificial Sequence
  Description of Artificial Sequence: Synthetic oligonucleotide
uucugacccucuccucuc

SEQ ID NO: 138823 - RNA, 18 nt, Artificial Sequence
  Description of Artificial Sequence: Synthetic oligonucleotide
uucauuucugacccucuc

SEQ ID NO: 138824 - RNA, 18 nt, Artificial Sequence
  Description of Artificial Sequence: Synthetic oligonucleotide
gagcguucauuucugacc

SEQ ID NO: 138825 - RNA, 18 nt, Artificial Sequence
  Description of Artificial Sequence: Synthetic oligonucleotide
uagaagagcguucauuuc

SEQ ID NO: 138826 - RNA, 18 nt, Artificial Sequence
  Description of Artificial Sequence: Synthetic oligonucleotide
agaaauagaagagcguuc

SEQ ID NO: 138827 - RNA, 18 nt, Artificial Sequence
  Description of Artificial Sequence: Synthetic oligonucleotide
ugacaagaaauagaagag

SEQ ID NO: 138828 - RNA, 18 nt, Artificial Sequence
  Description of Artificial Sequence: Synthetic oligonucleotide
gguaaugacaagaaauag

SEQ ID NO: 138829 - RNA, 18 nt, Artificial Sequence
  Description of Artificial Sequence: Synthetic oligonucleotide
ggcuugguaaugacaaga

SEQ ID NO: 138830 - RNA, 18 nt, Artificial Sequence
  Description of Artificial Sequence: Synthetic oligonucleotide
uaauuggcuugguaauga

SEQ ID NO: 138831 - RNA, 18 nt, Artificial Sequence
  Description of Artificial Sequence: Synthetic oligonucleotide
aaaaguaauuggcuuggu

SEQ ID NO: 138832 - RNA, 18 nt, Artificial Sequence
  Description of Artificial Sequence: Synthetic oligonucleotide
uuggcaaaaguaauuggc

SEQ ID NO: 138833 - RNA, 18 nt, Artificial Sequence
  Description of Artificial Sequence: Synthetic oligonucleotide
aaaauuuggcaaaaguaa

SEQ ID NO: 138834 - RNA, 18 nt, Artificial Sequence
  Description of Artificial Sequence: Synthetic oligonucleotide
acagaaaaauuuggcaaa

SEQ ID NO: 138835 - RNA, 18 nt, Artificial Sequence
  Description of Artificial Sequence: Synthetic oligonucleotide
agaucacagaaaaauuug

SEQ ID NO: 138836 - RNA, 18 nt, Artificial Sequence
  Description of Artificial Sequence: Synthetic oligonucleotide
agggcagaucacagaaaa

SEQ ID NO: 138837 - RNA, 18 nt, Artificial Sequence
  Description of Artificial Sequence: Synthetic oligonucleotide
uaaucagggcagaucaca

SEQ ID NO: 138838 - RNA, 18 nt, Artificial Sequence
  Description of Artificial Sequence: Synthetic oligonucleotide
caucuuaaucagggcaga

SEQ ID NO: 138839 - RNA, 18 nt, Artificial Sequence
  Description of Artificial Sequence: Synthetic oligonucleotide
caauucaucuuaaucagg

SEQ ID NO: 138840 - RNA, 18 nt, Artificial Sequence
  Description of Artificial Sequence: Synthetic oligonucleotide
uuucacaauucaucuuaa

SEQ ID NO: 138841 - RNA, 18 nt, Artificial Sequence
  Description of Artificial Sequence: Synthetic oligonucleotide
guaaauuucacaauucau

SEQ ID NO: 138842 - RNA, 18 nt, Artificial Sequence
  Description of Artificial Sequence: Synthetic oligonucleotide
uugauguaaauuucacaa

SEQ ID NO: 138843 - RNA, 18 nt, Artificial Sequence
  Description of Artificial Sequence: Synthetic oligonucleotide
auugcuugauguaaauuu

SEQ ID NO: 138844 - RNA, 18 nt, Artificial Sequence
  Description of Artificial Sequence: Synthetic oligonucleotide
ugauaauugcuugaugua

SEQ ID NO: 138845 - RNA, 18 nt, Artificial Sequence
  Description of Artificial Sequence: Synthetic oligonucleotide
cgcuuugauaauugcuug

SEQ ID NO: 138846 - RNA, 18 nt, Artificial Sequence
  Description of Artificial Sequence: Synthetic oligonucleotide
cagcccgcuuugauaauu

SEQ ID NO: 138847 - RNA, 18 nt, Artificial Sequence
  Description of Artificial Sequence: Synthetic oligonucleotide
ggacccagcccgcuuuga

SEQ ID NO: 138848 - RNA, 18 nt, Artificial Sequence
  Description of Artificial Sequence: Synthetic oligonucleotide
ugaugggacccagcccgc

SEQ ID NO: 138849 - RNA, 18 nt, Artificial Sequence
  Description of Artificial Sequence: Synthetic oligonucleotide
cguucugaugggacccag

SEQ ID NO: 138850 - RNA, 18 nt, Artificial Sequence
  Description of Artificial Sequence: Synthetic oligonucleotide
ugggucguucugauggga

SEQ ID NO: 138851 - RNA, 18 nt, Artificial Sequence
  Description of Artificial Sequence: Synthetic oligonucleotide
agaugugggucguucuga

SEQ ID NO: 138852 - RNA, 18 nt, Artificial Sequence
  Description of Artificial Sequence: Synthetic oligonucleotide
cagaaagaugugggucgu

SEQ ID NO: 138853 - RNA, 18 nt, Artificial Sequence
  Description of Artificial Sequence: Synthetic oligonucleotide
acccacagaaagaugugg

SEQ ID NO: 138854 - RNA, 18 nt, Artificial Sequence
  Description of Artificial Sequence: Synthetic oligonucleotide
uucacacccacagaaaga

SEQ ID NO: 138855 - RNA, 18 nt, Artificial Sequence
  Description of Artificial Sequence: Synthetic oligonucleotide
ugacauucacacccacag

SEQ ID NO: 138856 - RNA, 18 nt, Artificial Sequence
  Description of Artificial Sequence: Synthetic oligonucleotide
ccuaaugacauucacacc

SEQ ID NO: 138857 - RNA, 18 nt, Artificial Sequence
  Description of Artificial Sequence: Synthetic oligonucleotide
caagaccuaaugacauuc

SEQ ID NO: 138858 - RNA, 18 nt, Artificial Sequence
  Description of Artificial Sequence: Synthetic oligonucleotide
cagcgcaagaccuaauga

SEQ ID NO: 138859 - RNA, 18 nt, Artificial Sequence
  Description of Artificial Sequence: Synthetic oligonucleotide
gggucagcgcaagaccua

SEQ ID NO: 138860 - RNA, 18 nt, Artificial Sequence
  Description of Artificial Sequence: Synthetic oligonucleotide
ucaggcggcagugauggg

SEQ ID NO: 138861 - RNA, 18 nt, Artificial Sequence
  Description of Artificial Sequence: Synthetic oligonucleotide
ccccaucaggcggcagug

SEQ ID NO: 138862 - RNA, 18 nt, Artificial Sequence
  Description of Artificial Sequence: Synthetic oligonucleotide
cuuugccccaucaggcgg

SEQ ID NO: 138863 - RNA, 18 nt, Artificial Sequence
  Description of Artificial Sequence: Synthetic oligonucleotide
uguuucuuugccccauca

SEQ ID NO: 138864 - RNA, 18 nt, Artificial Sequence
  Description of Artificial Sequence: Synthetic oligonucleotide
uuuuuuguuucuuugccc

SEQ ID NO: 138865 - RNA, 18 nt, Artificial Sequence
  Description of Artificial Sequence: Synthetic oligonucleotide
aaauguuuuuuguuucuu

SEQ ID NO: 138866 - RNA, 18 nt, Artificial Sequence
  Description of Artificial Sequence: Synthetic oligonucleotide
guaagaaauguuuuuugu

SEQ ID NO: 138867 - RNA, 18 nt, Artificial Sequence
  Description of Artificial Sequence: Synthetic oligonucleotide
gaagaguaagaaauguuu

SEQ ID NO: 138868 - RNA, 18 nt, Artificial Sequence
  Description of Artificial Sequence: Synthetic oligonucleotide
acacagaagaguaagaaa

SEQ ID NO: 138869 - RNA, 18 nt, Artificial Sequence
  Description of Artificial Sequence: Synthetic oligonucleotide
uuaaaacacagaagagua

SEQ ID NO: 138870 - RNA, 18 nt, Artificial Sequence
  Description of Artificial Sequence: Synthetic oligonucleotide
uuuuguuaaaacacagaa

SEQ ID NO: 138871 - RNA, 18 nt, Artificial Sequence
  Description of Artificial Sequence: Synthetic oligonucleotide
uaaacuuuuguuaaaaca

SEQ ID NO: 138872 - RNA, 18 nt, Artificial Sequence
  Description of Artificial Sequence: Synthetic oligonucleotide
uuuuauaaacuuuuguua

SEQ ID NO: 138873 - RNA, 18 nt, Artificial Sequence
  Description of Artificial Sequence: Synthetic oligonucleotide
uuuuguuuuauaaacuuu

SEQ ID NO: 138874 - RNA, 18 nt, Artificial Sequence
  Description of Artificial Sequence: Synthetic oligonucleotide
auuuauuuuguuuuauaa

SEQ ID NO: 138875 - RNA, 18 nt, Artificial Sequence
  Description of Artificial Sequence: Synthetic oligonucleotide
gcgccauuuauuuuguuu

SEQ ID NO: 138876 - RNA, 18 nt, Artificial Sequence
  Description of Artificial Sequence: Synthetic oligonucleotide
cauaugcgccauuuauuu

SEQ ID NO: 138877 - RNA, 18 nt, Artificial Sequence
  Description of Artificial Sequence: Synthetic oligonucleotide
gaaaacauaugcgccauu

SEQ ID NO: 138878 - RNA, 18 nt, Artificial Sequence
  Description of Artificial Sequence: Synthetic oligonucleotide
cccgccccccucggacca

SEQ ID NO: 138879 - RNA, 18 nt, Artificial Sequence
  Description of Artificial Sequence: Synthetic oligonucleotide
ucagccccgccccccucg

SEQ ID NO: 138880 - RNA, 18 nt, Artificial Sequence
  Description of Artificial Sequence: Synthetic oligonucleotide
cgacgucagccccgcccc

SEQ ID NO: 138881 - RNA, 18 nt, Artificial Sequence
  Description of Artificial Sequence: Synthetic oligonucleotide
cagcgcgacgucagcccc

SEQ ID NO: 138882 - RNA, 18 nt, Artificial Sequence
  Description of Artificial Sequence: Synthetic oligonucleotide
auucccagcgcgacguca

SEQ ID NO: 138883 - RNA, 18 nt, Artificial Sequence
  Description of Artificial Sequence: Synthetic oligonucleotide
agggcauucccagcgcga

SEQ ID NO: 138884 - RNA, 18 nt, Artificial Sequence
  Description of Artificial Sequence: Synthetic oligonucleotide
cggccagggcauucccag

SEQ ID NO: 138885 - RNA, 18 nt, Artificial Sequence
  Description of Artificial Sequence: Synthetic oligonucleotide
ugucucggccagggcauu

SEQ ID NO: 138886 - RNA, 18 nt, Artificial Sequence
  Description of Artificial Sequence: Synthetic oligonucleotide
cucagugucucggccagg

SEQ ID NO: 138887 - RNA, 18 nt, Artificial Sequence
  Description of Artificial Sequence: Synthetic oligonucleotide
ccugccucagugucucgg

SEQ ID NO: 138888 - RNA, 18 nt, Artificial Sequence
  Description of Artificial Sequence: Synthetic oligonucleotide
ucuacccugccucagugu

SEQ ID NO: 138889 - RNA, 18 nt, Artificial Sequence
  Description of Artificial Sequence: Synthetic oligonucleotide
cgcucucuacccugccuc

SEQ ID NO: 138890 - RNA, 18 nt, Artificial Sequence
  Description of Artificial Sequence: Synthetic oligonucleotide
gcaagcgcucucuacccu

SEQ ID NO: 138891 - RNA, 18 nt, Artificial Sequence
  Description of Artificial Sequence: Synthetic oligonucleotide
cgcccgcaagcgcucucu

SEQ ID NO: 138892 - RNA, 18 nt, Artificial Sequence
  Description of Artificial Sequence: Synthetic oligonucleotide
cccggcgcccgcaagcgc

SEQ ID NO: 138893 - RNA, 18 nt, Artificial Sequence
  Description of Artificial Sequence: Synthetic oligonucleotide
cuccgcccggcgcccgca

SEQ ID NO: 138894 - RNA, 18 nt, Artificial Sequence
  Description of Artificial Sequence: Synthetic oligonucleotide
agcagcuccgcccggcgc

SEQ ID NO: 138895 - RNA, 18 nt, Artificial Sequence
  Description of Artificial Sequence: Synthetic oligonucleotide
uccgcagcagcuccgccc

SEQ ID NO: 138896 - RNA, 18 nt, Artificial Sequence
  Description of Artificial Sequence: Synthetic oligonucleotide
ccugauccgcagcagcuc

SEQ ID NO: 138897 - RNA, 18 nt, Artificial Sequence
  Description of Artificial Sequence: Synthetic oligonucleotide
cggguccugauccgcagc

SEQ ID NO: 138898 - RNA, 18 nt, Artificial Sequence
  Description of Artificial Sequence: Synthetic oligonucleotide
cggcucggguccugaucc

SEQ ID NO: 138899 - RNA, 18 nt, Artificial Sequence
  Description of Artificial Sequence: Synthetic oligonucleotide
ggaaucggcucggguccu

SEQ ID NO: 138900 - RNA, 18 nt, Artificial Sequence
  Description of Artificial Sequence: Synthetic oligonucleotide
gaucgggaaucggcucgg

SEQ ID NO: 138901 - RNA, 18 nt, Artificial Sequence
  Description of Artificial Sequence: Synthetic oligonucleotide
gucgggaucgggaaucgg

SEQ ID NO: 138902 - RNA, 18 nt, Artificial Sequence
  Description of Artificial Sequence: Synthetic oligonucleotide
ucugggucgggaucggga

SEQ ID NO: 138903 - RNA, 18 nt, Artificial Sequence
  Description of Artificial Sequence: Synthetic oligonucleotide
uaggaucugggucgggau

SEQ ID NO: 138904 - RNA, 18 nt, Artificial Sequence
  Description of Artificial Sequence: Synthetic oligonucleotide
cggguuaggaucuggguc

SEQ ID NO: 138905 - RNA, 18 nt, Artificial Sequence
  Description of Artificial Sequence: Synthetic oligonucleotide
gggcgcggguuaggaucu

SEQ ID NO: 138906 - RNA, 18 nt, Artificial Sequence
  Description of Artificial Sequence: Synthetic oligonucleotide
cauggcggcggcggcggg

SEQ ID NO: 138907 - RNA, 18 nt, Artificial Sequence
  Description of Artificial Sequence: Synthetic oligonucleotide
uacauggcggcggcggcg

SEQ ID NO: 138908 - RNA, 18 nt, Artificial Sequence
  Description of Artificial Sequence: Synthetic oligonucleotide
cgucguacauggcggcgg

SEQ ID NO: 138909 - RNA, 18 nt, Artificial Sequence
  Description of Artificial Sequence: Synthetic oligonucleotide
cucugcgucguacauggc

SEQ ID NO: 138910 - RNA, 18 nt, Artificial Sequence
  Description of Artificial Sequence: Synthetic oligonucleotide
ccgcgcucugcgucguac

SEQ ID NO: 138911 - RNA, 18 nt, Artificial Sequence
  Description of Artificial Sequence: Synthetic oligonucleotide
uccagccgcgcucugcgu

SEQ ID NO: 138912 - RNA, 18 nt, Artificial Sequence
  Description of Artificial Sequence: Synthetic oligonucleotide
caagcuccagccgcgcuc

SEQ ID NO: 138913 - RNA, 18 nt, Artificial Sequence
  Description of Artificial Sequence: Synthetic oligonucleotide
aaggacaagcuccagccg

SEQ ID NO: 138914 - RNA, 18 nt, Artificial Sequence
  Description of Artificial Sequence: Synthetic oligonucleotide
ccgcgaaggacaagcucc

SEQ ID NO: 138915 - RNA, 18 nt, Artificial Sequence
  Description of Artificial Sequence: Synthetic oligonucleotide
gcagcccgcgaaggacaa

SEQ ID NO: 138916 - RNA, 18 nt, Artificial Sequence
  Description of Artificial Sequence: Synthetic oligonucleotide
aagccgcagcccgcgaag

SEQ ID NO: 138917 - RNA, 18 nt, Artificial Sequence
  Description of Artificial Sequence: Synthetic oligonucleotide
ccaggaagccgcagcccg

SEQ ID NO: 138918 - RNA, 18 nt, Artificial Sequence
  Description of Artificial Sequence: Synthetic oligonucleotide
gaagcccaggaagccgca

SEQ ID NO: 138919 - RNA, 18 nt, Artificial Sequence
  Description of Artificial Sequence: Synthetic oligonucleotide
ugguagaagcccaggaag

SEQ ID NO: 138920 - RNA, 18 nt, Artificial Sequence
  Description of Artificial Sequence: Synthetic oligonucleotide
cgacgugguagaagccca

SEQ ID NO: 138921 - RNA, 18 nt, Artificial Sequence
  Description of Artificial Sequence: Synthetic oligonucleotide
cgccccgacgugguagaa

SEQ ID NO: 138922 - RNA, 18 nt, Artificial Sequence
  Description of Artificial Sequence: Synthetic oligonucleotide
cgggucgccccgacgugg

SEQ ID NO: 138923 - RNA, 18 nt, Artificial Sequence
  Description of Artificial Sequence: Synthetic oligonucleotide
ggcagcgggucgccccga

SEQ ID NO: 138924 - RNA, 18 nt, Artificial Sequence
  Description of Artificial Sequence: Synthetic oligonucleotide
gcucaggcagcgggucgc

SEQ ID NO: 138925 - RNA, 18 nt, Artificial Sequence
  Description of Artificial Sequence: Synthetic oligonucleotide
ugcucgcucaggcagcgg

SEQ ID NO: 138926 - RNA, 18 nt, Artificial Sequence
  Description of Artificial Sequence: Synthetic oligonucleotide
gggcgugcucgcucaggc

SEQ ID NO: 138927 - RNA, 18 nt, Artificial Sequence
  Description of Artificial Sequence: Synthetic oligonucleotide
ucgcggaggaggugcggg

SEQ ID NO: 138928 - RNA, 18 nt, Artificial Sequence
  Description of Artificial Sequence: Synthetic oligonucleotide
gcgucgcggaggaggugc

SEQ ID NO: 138929 - RNA, 18 nt, Artificial Sequence
  Description of Artificial Sequence: Synthetic oligonucleotide
ugcgcgcgucgcggagga

SEQ ID NO: 138930 - RNA, 18 nt, Artificial Sequence
  Description of Artificial Sequence: Synthetic oligonucleotide
caacaugcgcgcgucgcg

SEQ ID NO: 138931 - RNA, 18 nt, Artificial Sequence
  Description of Artificial Sequence: Synthetic oligonucleotide
ccgaacaacaugcgcgcg

SEQ ID NO: 138932 - RNA, 18 nt, Artificial Sequence
  Description of Artificial Sequence: Synthetic oligonucleotide
aagcgccgaacaacaugc

SEQ ID NO: 138933 - RNA, 18 nt, Artificial Sequence
  Description of Artificial Sequence: Synthetic oligonucleotide
ggccgaagcgccgaacaa

SEQ ID NO: 138934 - RNA, 18 nt, Artificial Sequence
  Description of Artificial Sequence: Synthetic oligonucleotide
gccccggccgaagcgccg

SEQ ID NO: 138935 - RNA, 18 nt, Artificial Sequence
  Description of Artificial Sequence: Synthetic oligonucleotide
gcaacgccccggccgaag

SEQ ID NO: 138936 - RNA, 18 nt, Artificial Sequence
  Description of Artificial Sequence: Synthetic oligonucleotide
gcagugcaacgccccggc

SEQ ID NO: 138937 - RNA, 18 nt, Artificial Sequence
  Description of Artificial Sequence: Synthetic oligonucleotide
ccgacgcagugcaacgcc

SEQ ID NO: 138938 - RNA, 18 nt, Artificial Sequence
  Description of Artificial Sequence: Synthetic oligonucleotide
ggacgccgacgcagugca

SEQ ID NO: 138939 - RNA, 18 nt, Artificial Sequence
  Description of Artificial Sequence: Synthetic oligonucleotide
ggagaggacgccgacgca

SEQ ID NO: 138940 - RNA, 18 nt, Artificial Sequence
  Description of Artificial Sequence: Synthetic oligonucleotide
auaccggagaggacgccg

SEQ ID NO: 138941 - RNA, 18 nt, Artificial Sequence
  Description of Artificial Sequence: Synthetic oligonucleotide
gcgggauaccggagagga

SEQ ID NO: 138942 - RNA, 18 nt, Artificial Sequence
  Description of Artificial Sequence: Synthetic oligonucleotide
ccgggcagcguccccaga

SEQ ID NO: 138943 - RNA, 18 nt, Artificial Sequence
  Description of Artificial Sequence: Synthetic oligonucleotide
ggagcccgggcagcgucc

SEQ ID NO: 138944 - RNA, 18 nt, Artificial Sequence
  Description of Artificial Sequence: Synthetic oligonucleotide
cacguggagcccgggcag

SEQ ID NO: 138945 - RNA, 18 nt, Artificial Sequence
  Description of Artificial Sequence: Synthetic oligonucleotide
cuccgcacguggagcccg

SEQ ID NO: 138946 - RNA, 18 nt, Artificial Sequence
  Description of Artificial Sequence: Synthetic oligonucleotide
acccacuccgcacgugga

SEQ ID NO: 138947 - RNA, 18 nt, Artificial Sequence
  Description of Artificial Sequence: Synthetic oligonucleotide
gggcacccacuccgcacg

SEQ ID NO: 138948 - RNA, 18 nt, Artificial Sequence
  Description of Artificial Sequence: Synthetic oligonucleotide
ccgcuccccggccuaggg

SEQ ID NO: 138949 - RNA, 18 nt, Artificial Sequence
  Description of Artificial Sequence: Synthetic oligonucleotide
aucccccgcuccccggcc

SEQ ID NO: 138950 - RNA, 18 nt, Artificial Sequence
  Description of Artificial Sequence: Synthetic oligonucleotide
gggaucccccgcuccccg

SEQ ID NO: 138951 - RNA, 18 nt, Artificial Sequence
  Description of Artificial Sequence: Synthetic oligonucleotide
ggccccgcgaccccuggg

SEQ ID NO: 138952 - RNA, 18 nt, Artificial Sequence
  Description of Artificial Sequence: Synthetic oligonucleotide
uccagggccccgcgaccc

SEQ ID NO: 138953 - RNA, 18 nt, Artificial Sequence
  Description of Artificial Sequence: Synthetic oligonucleotide
gcuccuccagggccccgc

SEQ ID NO: 138954 - RNA, 18 nt, Artificial Sequence
  Description of Artificial Sequence: Synthetic oligonucleotide
ugcccgcuccuccagggc

SEQ ID NO: 138955 - RNA, 18 nt, Artificial Sequence
  Description of Artificial Sequence: Synthetic oligonucleotide
uccgaugcccgcuccucc

SEQ ID NO: 138956 - RNA, 18 nt, Artificial Sequence
  Description of Artificial Sequence: Synthetic oligonucleotide
ccgcguccgaugcccgcu

SEQ ID NO: 138957 - RNA, 18 nt, Artificial Sequence
  Description of Artificial Sequence: Synthetic oligonucleotide
cguguccgcguccgaugc

SEQ ID NO: 138958 - RNA, 18 nt, Artificial Sequence
  Description of Artificial Sequence: Synthetic oligonucleotide
cccgccguguccgcgucc

SEQ ID NO: 138959 - RNA, 18 nt, Artificial Sequence
  Description of Artificial Sequence: Synthetic oligonucleotide
ugcaccccgccguguccg

SEQ ID NO: 138960 - RNA, 18 nt, Artificial Sequence
  Description of Artificial Sequence: Synthetic oligonucleotide
cgggaugcaccccgccgu

SEQ ID NO: 138961 - RNA, 18 nt, Artificial Sequence
  Description of Artificial Sequence: Synthetic oligonucleotide
gcccucgggaugcacccc

SEQ ID NO: 138962 - RNA, 18 nt, Artificial Sequence
  Description of Artificial Sequence: Synthetic oligonucleotide
gggcccucgggaugcacc

SEQ ID NO: 138963 - RNA, 18 nt, Artificial Sequence
  Description of Artificial Sequence: Synthetic oligonucleotide
agcaucugccucggaggg

SEQ ID NO: 138964 - RNA, 18 nt, Artificial Sequence
  Description of Artificial Sequence: Synthetic oligonucleotide
caggaagcaucugccucg

SEQ ID NO: 138965 - RNA, 18 nt, Artificial Sequence
  Description of Artificial Sequence: Synthetic oligonucleotide
ccccgcaggaagcaucug

SEQ ID NO: 138966 - RNA, 18 nt, Artificial Sequence
  Description of Artificial Sequence: Synthetic oligonucleotide
agcgcccccgcaggaagc

SEQ ID NO: 138967 - RNA, 18 nt, Artificial Sequence
  Description of Artificial Sequence: Synthetic oligonucleotide
ggaacagcgcccccgcag

SEQ ID NO: 138968 - RNA, 18 nt, Artificial Sequence
  Description of Artificial Sequence: Synthetic oligonucleotide
gcccaggaacagcgcccc

SEQ ID NO: 138969 - RNA, 18 nt, Artificial Sequence
  Description of Artificial Sequence: Synthetic oligonucleotide
cccgggcccaggaacagc

SEQ ID NO: 138970 - RNA, 18 nt, Artificial Sequence
  Description of Artificial Sequence: Synthetic oligonucleotide
cccuucccgggcccagga

SEQ ID NO: 138971 - RNA, 18 nt, Artificial Sequence
  Description of Artificial Sequence: Synthetic oligonucleotide
acgcccccuucccgggcc

SEQ ID NO: 138972 - RNA, 18 nt, Artificial Sequence
  Description of Artificial Sequence: Synthetic oligonucleotide
uuccaacgcccccuuccc

SEQ ID NO: 138973 - RNA, 18 nt, Artificial Sequence
  Description of Artificial Sequence: Synthetic oligonucleotide
ggguuccaacgcccccuu

SEQ ID NO: 138974 - RNA, 18 nt, Artificial Sequence
  Description of Artificial Sequence: Synthetic oligonucleotide
cggcccggaccgcucggg

SEQ ID NO: 138975 - RNA, 18 nt, Artificial Sequence
  Description of Artificial Sequence: Synthetic oligonucleotide
ggcuucggcccggaccgc

SEQ ID NO: 138976 - RNA, 18 nt, Artificial Sequence
  Description of Artificial Sequence: Synthetic oligonucleotide
ucccaggcuucggcccgg

SEQ ID NO: 138977 - RNA, 18 nt, Artificial Sequence
  Description of Artificial Sequence: Synthetic oligonucleotide
gagagucccaggcuucgg

SEQ ID NO: 138978 - RNA, 18 nt, Artificial Sequence
  Description of Artificial Sequence: Synthetic oligonucleotide
cgcacgagagucccaggc

SEQ ID NO: 138979 - RNA, 18 nt, Artificial Sequence
  Description of Artificial Sequence: Synthetic oligonucleotide
gggacgcacgagaguccc

SEQ ID NO: 138980 - RNA, 18 nt, Artificial Sequence
  Description of Artificial Sequence: Synthetic oligonucleotide
gcacgggcgccugauggg

SEQ ID NO: 138981 - RNA, 18 nt, Artificial Sequence
  Description of Artificial Sequence: Synthetic oligonucleotide
uucaugcacgggcgccug

SEQ ID NO: 138982 - RNA, 18 nt, Artificial Sequence
  Description of Artificial Sequence: Synthetic oligonucleotide
cucccuucaugcacgggc

SEQ ID NO: 138983 - RNA, 18 nt, Artificial Sequence
  Description of Artificial Sequence: Synthetic oligonucleotide
agggucucccuucaugca

SEQ ID NO: 138984 - RNA, 18 nt, Artificial Sequence
  Description of Artificial Sequence: Synthetic oligonucleotide
aggugagggucucccuuc

SEQ ID NO: 138985 - RNA, 18 nt, Artificial Sequence
  Description of Artificial Sequence: Synthetic oligonucleotide
uccggaggugagggucuc

SEQ ID NO: 138986 - RNA, 18 nt, Artificial Sequence
  Description of Artificial Sequence: Synthetic oligonucleotide
cucaguccggaggugagg

SEQ ID NO: 138987 - RNA, 18 nt, Artificial Sequence
  Description of Artificial Sequence: Synthetic oligonucleotide
cgacucucaguccggagg

SEQ ID NO: 138988 - RNA, 18 nt, Artificial Sequence
  Description of Artificial Sequence: Synthetic oligonucleotide
cgcuccgacucucagucc

SEQ ID NO: 138989 - RNA, 18 nt, Artificial Sequence
  Description of Artificial Sequence: Synthetic oligonucleotide
cgagacgcuccgacucuc

SEQ ID NO: 138990 - RNA, 18 nt, Artificial Sequence
  Description of Artificial Sequence: Synthetic oligonucleotide
cgcuccgagacgcuccga

SEQ ID NO: 138991 - RNA, 18 nt, Artificial Sequence
  Description of Artificial Sequence: Synthetic oligonucleotide
cccgucgcuccgagacgc

SEQ ID NO: 138992 - RNA, 18 nt, Artificial Sequence
  Description of Artificial Sequence: Synthetic oligonucleotide
uacuccccgucgcuccga

SEQ ID NO: 138993 - RNA, 18 nt, Artificial Sequence
  Description of Artificial Sequence: Synthetic oligonucleotide
cucccuacuccccgucgc

SEQ ID NO: 138994 - RNA, 18 nt, Artificial Sequence
  Description of Artificial Sequence: Synthetic oligonucleotide
ucccgcucccuacucccc

SEQ ID NO: 138995 - RNA, 18 nt, Artificial Sequence
  Description of Artificial Sequence: Synthetic oligonucleotide
ccgggucccgcucccuac

SEQ ID NO: 138996 - RNA, 18 nt, Artificial Sequence
  Description of Artificial Sequence: Synthetic oligonucleotide
ccgccccgggucccgcuc

SEQ ID NO: 138997 - RNA, 18 nt, Artificial Sequence
  Description of Artificial Sequence: Synthetic oligonucleotide
acccuccgccccgggucc

SEQ ID NO: 138998 - RNA, 18 nt, Artificial Sequence
  Description of Artificial Sequence: Synthetic oligonucleotide
gcacuacccuccgccccg

SEQ ID NO: 138999 - RNA, 18 nt, Artificial Sequence
  Description of Artificial Sequence: Synthetic oligonucleotide
ggccagcacuacccuccg

SEQ ID NO: 139000 - RNA, 18 nt, Artificial Sequence
  Description of Artificial Sequence: Synthetic oligonucleotide
gggccagcacuacccucc

SEQ ID NO: 139001 - RNA, 18 nt, Artificial Sequence
  Description of Artificial Sequence: Synthetic oligonucleotide
gacccggaguccgcaggg

SEQ ID NO: 139002 - RNA, 18 nt, Artificial Sequence
  Description of Artificial Sequence: Synthetic oligonucleotide
gggacccggaguccgcag

SEQ ID NO: 139003 - RNA, 18 nt, Artificial Sequence
  Description of Artificial Sequence: Synthetic oligonucleotide
ucccgagaggacacaggg

SEQ ID NO: 139004 - RNA, 18 nt, Artificial Sequence
  Description of Artificial Sequence: Synthetic oligonucleotide
gccccucccgagaggaca

SEQ ID NO: 139005 - RNA, 18 nt, Artificial Sequence
  Description of Artificial Sequence: Synthetic oligonucleotide
guccagccccucccgaga

SEQ ID NO: 139006 - RNA, 18 nt, Artificial Sequence
  Description of Artificial Sequence: Synthetic oligonucleotide
agcccguccagccccucc

SEQ ID NO: 139007 - RNA, 18 nt, Artificial Sequence
  Description of Artificial Sequence: Synthetic oligonucleotide
agcucagcccguccagcc

SEQ ID NO: 139008 - RNA, 18 nt, Artificial Sequence
  Description of Artificial Sequence: Synthetic oligonucleotide
ucggcagcucagcccguc

SEQ ID NO: 139009 - RNA, 18 nt, Artificial Sequence
  Description of Artificial Sequence: Synthetic oligonucleotide
gccccucggcagcucagc

SEQ ID NO: 139010 - RNA, 18 nt, Artificial Sequence
  Description of Artificial Sequence: Synthetic oligonucleotide
aaucggccccucggcagc

SEQ ID NO: 139011 - RNA, 18 nt, Artificial Sequence
  Description of Artificial Sequence: Synthetic oligonucleotide
gggcaaaucggccccucg

SEQ ID NO: 139012 - RNA, 18 nt, Artificial Sequence
  Description of Artificial Sequence: Synthetic oligonucleotide
gcccagggcaaaucggcc

SEQ ID NO: 139013 - RNA, 18 nt, Artificial Sequence
  Description of Artificial Sequence: Synthetic oligonucleotide
guccggcccagggcaaau

SEQ ID NO: 139014 - RNA, 18 nt, Artificial Sequence
  Description of Artificial Sequence: Synthetic oligonucleotide
ucuuuguccggcccaggg

SEQ ID NO: 139015 - RNA, 18 nt, Artificial Sequence
  Description of Artificial Sequence: Synthetic oligonucleotide
cccacucuuuguccggcc

SEQ ID NO: 139016 - RNA, 18 nt, Artificial Sequence
  Description of Artificial Sequence: Synthetic oligonucleotide
aaagccccacucuuuguc

SEQ ID NO: 139017 - RNA, 18 nt, Artificial Sequence
  Description of Artificial Sequence: Synthetic oligonucleotide
cggccaaagccccacucu

SEQ ID NO: 139018 - RNA, 18 nt, Artificial Sequence
  Description of Artificial Sequence: Synthetic oligonucleotide
gggaccggccaaagcccc

SEQ ID NO: 139019 - RNA, 18 nt, Artificial Sequence
  Description of Artificial Sequence: Synthetic oligonucleotide
agggaaggagcccaccgu

SEQ ID NO: 139020 - RNA, 18 nt, Artificial Sequence
  Description of Artificial Sequence: Synthetic oligonucleotide
cccagagggaaggagccc

SEQ ID NO: 139021 - RNA, 18 nt, Artificial Sequence
  Description of Artificial Sequence: Synthetic oligonucleotide
caauccccagagggaagg

SEQ ID NO: 139022 - RNA, 18 nt, Artificial Sequence
  Description of Artificial Sequence: Synthetic oligonucleotide
ucccucaauccccagagg

SEQ ID NO: 139023 - RNA, 18 nt, Artificial Sequence
  Description of Artificial Sequence: Synthetic oligonucleotide
ucagcauuagagcuuugg

SEQ ID NO: 139024 - RNA, 18 nt, Artificial Sequence
  Description of Artificial Sequence: Synthetic oligonucleotide
acauaucagcauuagagc

SEQ ID NO: 139025 - RNA, 18 nt, Artificial Sequence
  Description of Artificial Sequence: Synthetic oligonucleotide
caggaacauaucagcauu

SEQ ID NO: 139026 - RNA, 18 nt, Artificial Sequence
  Description of Artificial Sequence: Synthetic oligonucleotide
gaggccaggaacauauca

SEQ ID NO: 139027 - RNA, 18 nt, Artificial Sequence
  Description of Artificial Sequence: Synthetic oligonucleotide
acauagaggccaggaaca

SEQ ID NO: 139028 - RNA, 18 nt, Artificial Sequence
  Description of Artificial Sequence: Synthetic oligonucleotide
gccccacauagaggccag

SEQ ID NO: 139029 - RNA, 18 nt, Artificial Sequence
  Description of Artificial Sequence: Synthetic oligonucleotide
uccaugccccacauagag

SEQ ID NO: 139030 - RNA, 18 nt, Artificial Sequence
  Description of Artificial Sequence: Synthetic oligonucleotide
ccaccuccaugccccaca

SEQ ID NO: 139031 - RNA, 18 nt, Artificial Sequence
  Description of Artificial Sequence: Synthetic oligonucleotide
augccccaccuccaugcc

SEQ ID NO: 139032 - RNA, 18 nt, Artificial Sequence
  Description of Artificial Sequence: Synthetic oligonucleotide
ccuccaugccccaccucc

SEQ ID NO: 139033 - RNA, 18 nt, Artificial Sequence
  Description of Artificial Sequence: Synthetic oligonucleotide
ccucaccuccaugcccca

SEQ ID NO: 139034 - RNA, 18 nt, Artificial Sequence
  Description of Artificial Sequence: Synthetic oligonucleotide
gcaggccucaccuccaug

SEQ ID NO: 139035 - RNA, 18 nt, Artificial Sequence
  Description of Artificial Sequence: Synthetic oligonucleotide
ggcgagcaggccucaccu

SEQ ID NO: 139036 - RNA, 18 nt, Artificial Sequence
  Description of Artificial Sequence: Synthetic oligonucleotide
gcccaggcgagcaggccu

SEQ ID NO: 139037 - RNA, 18 nt, Artificial Sequence
  Description of Artificial Sequence: Synthetic oligonucleotide
cagaagcccaggcgagca

SEQ ID NO: 139038 - RNA, 18 nt, Artificial Sequence
  Description of Artificial Sequence: Synthetic oligonucleotide
acuuccagaagcccaggc

SEQ ID NO: 139039 - RNA, 18 nt, Artificial Sequence
  Description of Artificial Sequence: Synthetic oligonucleotide
cucccacuuccagaagcc

SEQ ID NO: 139040 - RNA, 18 nt, Artificial Sequence
  Description of Artificial Sequence: Synthetic oligonucleotide
ugagucucccacuuccag

SEQ ID NO: 139041 - RNA, 18 nt, Artificial Sequence
  Description of Artificial Sequence: Synthetic oligonucleotide
aggaaugagucucccacu

SEQ ID NO: 139042 - RNA, 18 nt, Artificial Sequence
  Description of Artificial Sequence: Synthetic oligonucleotide
gccacaggaaugagucuc

SEQ ID NO: 139043 - RNA, 18 nt, Artificial Sequence
  Description of Artificial Sequence: Synthetic oligonucleotide
ccucagccacaggaauga

SEQ ID NO: 139044 - RNA, 18 nt, Artificial Sequence
  Description of Artificial Sequence: Synthetic oligonucleotide
guaggccucagccacagg

SEQ ID NO: 139045 - RNA, 18 nt, Artificial Sequence
  Description of Artificial Sequence: Synthetic oligonucleotide
cugcuguaggccucagcc

SEQ ID NO: 139046 - RNA, 18 nt, Artificial Sequence
  Description of Artificial Sequence: Synthetic oligonucleotide
cagcacugcuguaggccu

SEQ ID NO: 139047 - RNA, 18 nt, Artificial Sequence
  Description of Artificial Sequence: Synthetic oligonucleotide
ccacacagcacugcugua

SEQ ID NO: 139048 - RNA, 18 nt, Artificial Sequence
  Description of Artificial Sequence: Synthetic oligonucleotide
uccuaccacacagcacug

SEQ ID NO: 139049 - RNA, 18 nt, Artificial Sequence
  Description of Artificial Sequence: Synthetic oligonucleotide
uguauuccuaccacacag

SEQ ID NO: 139050 - RNA, 18 nt, Artificial Sequence
  Description of Artificial Sequence: Synthetic oligonucleotide
uccaguguauuccuacca

SEQ ID NO: 139051 - RNA, 18 nt, Artificial Sequence
  Description of Artificial Sequence: Synthetic oligonucleotide
uggcuuccaguguauucc

SEQ ID NO: 139052 - RNA, 18 nt, Artificial Sequence
  Description of Artificial Sequence: Synthetic oligonucleotide
caucauggcuuccagugu

SEQ ID NO: 139053 - RNA, 18 nt, Artificial Sequence
  Description of Artificial Sequence: Synthetic oligonucleotide
aaugacaucauggcuucc

SEQ ID NO: 139054 - RNA, 18 nt, Artificial Sequence
  Description of Artificial Sequence: Synthetic oligonucleotide
ugcacaaugacaucaugg

SEQ ID NO: 139055 - RNA, 18 nt, Artificial Sequence
  Description of Artificial Sequence: Synthetic oligonucleotide
gaaaaugcacaaugacau

SEQ ID NO: 139056 - RNA, 18 nt, Artificial Sequence
  Description of Artificial Sequence: Synthetic oligonucleotide
uucuagaaaaugcacaau

SEQ ID NO: 139057 - RNA, 18 nt, Artificial Sequence
  Description of Artificial Sequence: Synthetic oligonucleotide
guggcuucuagaaaaugc

SEQ ID NO: 139058 - RNA, 18 nt, Artificial Sequence
  Description of Artificial Sequence: Synthetic oligonucleotide
ucaauguggcuucuagaa

SEQ ID NO: 139059 - RNA, 18 nt, Artificial Sequence
  Description of Artificial Sequence: Synthetic oligonucleotide
uuuauucaauguggcuuc

SEQ ID NO: 139060 - RNA, 18 nt, Artificial Sequence
  Description of Artificial Sequence: Synthetic oligonucleotide
uuuacuuuauucaaugug

SEQ ID NO: 139061 - RNA, 18 nt, Artificial Sequence
  Description of Artificial Sequence: Synthetic oligonucleotide
ugucuuuuacuuuauuca

SEQ ID NO: 139062 - RNA, 18 nt, Artificial Sequence
  Description of Artificial Sequence: Synthetic oligonucleotide
accugugucuuuuacuuu

SEQ ID NO: 139063 - RNA, 18 nt, Artificial Sequence
  Description of Artificial Sequence: Synthetic oligonucleotide
auucuaccugugucuuuu

SEQ ID NO: 139064 - RNA, 18 nt, Artificial Sequence
  Description of Artificial Sequence: Synthetic oligonucleotide
aauuaauucuaccugugu

SEQ ID NO: 139065 - RNA, 18 nt, Artificial Sequence
  Description of Artificial Sequence: Synthetic oligonucleotide
aaugaaauuaauucuacc

SEQ ID NO: 139066 - RNA, 18 nt, Artificial Sequence
  Description of Artificial Sequence: Synthetic oligonucleotide
ggcucaaugaaauuaauu

SEQ ID NO: 139067 - RNA, 18 nt, Artificial Sequence
  Description of Artificial Sequence: Synthetic oligonucleotide
uauugggcucaaugaaau

SEQ ID NO: 139068 - RNA, 18 nt, Artificial Sequence
  Description of Artificial Sequence: Synthetic oligonucleotide
ggauauauugggcucaau

SEQ ID NO: 139069 - RNA, 18 nt, Artificial Sequence
  Description of Artificial Sequence: Synthetic oligonucleotide
auuuuggauauauugggc

SEQ ID NO: 139070 - RNA, 18 nt, Artificial Sequence
  Description of Artificial Sequence: Synthetic oligonucleotide
auauuauuuuggauauau

SEQ ID NO: 139071 - RNA, 18 nt, Artificial Sequence
  Description of Artificial Sequence: Synthetic oligonucleotide
aaaugauauuauuuugga

SEQ ID NO: 139072 - RNA, 18 nt, Artificial Sequence
  Description of Artificial Sequence: Synthetic oligonucleotide
ugugaaaaugauauuauu

SEQ ID NO: 139073 - RNA, 18 nt, Artificial Sequence
  Description of Artificial Sequence: Synthetic oligonucleotide
auagaugugaaaaugaua

SEQ ID NO: 139074 - RNA, 18 nt, Artificial Sequence
  Description of Artificial Sequence: Synthetic oligonucleotide
auugaauagaugugaaaa

SEQ ID NO: 139075 - RNA, 18 nt, Artificial Sequence
  Description of Artificial Sequence: Synthetic oligonucleotide
uuuauauugaauagaugu

SEQ ID NO: 139076 - RNA, 18 nt, Artificial Sequence
  Description of Artificial Sequence: Synthetic oligonucleotide
aaauuuuuauauugaaua

SEQ ID NO: 139077 - RNA, 18 nt, Artificial Sequence
  Description of Artificial Sequence: Synthetic oligonucleotide
uuaguaaauuuuuauauu

SEQ ID NO: 139078 - RNA, 18 nt, Artificial Sequence
  Description of Artificial Sequence: Synthetic oligonucleotide
ucucauuaguaaauuuuu

SEQ ID NO: 139079 - RNA, 18 nt, Artificial Sequence
  Description of Artificial Sequence: Synthetic oligonucleotide
aaauaucucauuaguaaa

SEQ ID NO: 139080 - RNA, 18 nt, Artificial Sequence
  Description of Artificial Sequence: Synthetic oligonucleotide
guaugaaauaucucauua

SEQ ID NO: 139081 - RNA, 18 nt, Artificial Sequence
  Description of Artificial Sequence: Synthetic oligonucleotide
gcuuaguaugaaauaucu

SEQ ID NO: 139082 - RNA, 18 nt, Artificial Sequence
  Description of Artificial Sequence: Synthetic oligonucleotide
caguggcuuaguaugaaa

SEQ ID NO: 139083 - RNA, 18 nt, Artificial Sequence
  Description of Artificial Sequence: Synthetic oligonucleotide
gauuucaguggcuuagua

SEQ ID NO: 139084 - RNA, 18 nt, Artificial Sequence
  Description of Artificial Sequence: Synthetic oligonucleotide
aacuggauuucaguggcu

SEQ ID NO: 139085 - RNA, 18 nt, Artificial Sequence
  Description of Artificial Sequence: Synthetic oligonucleotide
auacaaacuggauuucag

SEQ ID NO: 139086 - RNA, 18 nt, Artificial Sequence
  Description of Artificial Sequence: Synthetic oligonucleotide
guaagauacaaacuggau

SEQ ID NO: 139087 - RNA, 18 nt, Artificial Sequence
  Description of Artificial Sequence: Synthetic oligonucleotide
gauguguaagauacaaac

SEQ ID NO: 139088 - RNA, 18 nt, Artificial Sequence
  Description of Artificial Sequence: Synthetic oligonucleotide
acugagauguguaagaua

SEQ ID NO: 139089 - RNA, 18 nt, Artificial Sequence
  Description of Artificial Sequence: Synthetic oligonucleotide
ucaaaacugagaugugua

SEQ ID NO: 139090 - RNA, 18 nt, Artificial Sequence
  Description of Artificial Sequence: Synthetic oligonucleotide
gcucgucaaaacugagau

SEQ ID NO: 139091 - RNA, 18 nt, Artificial Sequence
  Description of Artificial Sequence: Synthetic oligonucleotide
auguggcucgucaaaacu

SEQ ID NO: 139092 - RNA, 18 nt, Artificial Sequence
  Description of Artificial Sequence: Synthetic oligonucleotide
uugaaauguggcucguca

SEQ ID NO: 139093 - RNA, 18 nt, Artificial Sequence
  Description of Artificial Sequence: Synthetic oligonucleotide
cgcccuugaaauguggcu

SEQ ID NO: 139094 - RNA, 18 nt, Artificial Sequence
  Description of Artificial Sequence: Synthetic oligonucleotide
uaucacgcccuugaaaug

SEQ ID NO: 139095 - RNA, 18 nt, Artificial Sequence
  Description of Artificial Sequence: Synthetic oligonucleotide
guggcuaucacgcccuug

SEQ ID NO: 139096 - RNA, 18 nt, Artificial Sequence
  Description of Artificial Sequence: Synthetic oligonucleotide
cacauguggcuaucacgc

SEQ ID NO: 139097 - RNA, 18 nt, Artificial Sequence
  Description of Artificial Sequence: Synthetic oligonucleotide
ggagccacauguggcuau

SEQ ID NO: 139098 - RNA, 18 nt, Artificial Sequence
  Description of Artificial Sequence: Synthetic oligonucleotide
cuaugggagccacaugug

SEQ ID NO: 139099 - RNA, 18 nt, Artificial Sequence
  Description of Artificial Sequence: Synthetic oligonucleotide
gucuacuaugggagccac

SEQ ID NO: 139100 - RNA, 18 nt, Artificial Sequence
  Description of Artificial Sequence: Synthetic oligonucleotide
guacugucuacuauggga

SEQ ID NO: 139101 - RNA, 18 nt, Artificial Sequence
  Description of Artificial Sequence: Synthetic oligonucleotide
gaccaguacugucuacua

SEQ ID NO: 139102 - RNA, 18 nt, Artificial Sequence
  Description of Artificial Sequence: Synthetic oligonucleotide
cucuagaccaguacuguc

SEQ ID NO: 139103 - RNA, 18 nt, Artificial Sequence
  Description of Artificial Sequence: Synthetic oligonucleotide
cauuucucuagaccagua

SEQ ID NO: 139104 - RNA, 18 nt, Artificial Sequence
  Description of Artificial Sequence: Synthetic oligonucleotide
accaacauuucucuagac

SEQ ID NO: 139105 - RNA, 18 nt, Artificial Sequence
  Description of Artificial Sequence: Synthetic oligonucleotide
augccaccaacauuucuc

SEQ ID NO: 139106 - RNA, 18 nt, Artificial Sequence
  Description of Artificial Sequence: Synthetic oligonucleotide
caaggaugccaccaacau

SEQ ID NO: 139107 - RNA, 18 nt, Artificial Sequence
  Description of Artificial Sequence: Synthetic oligonucleotide
gacagcaaggaugccacc

SEQ ID NO: 139108 - RNA, 18 nt, Artificial Sequence
  Description of Artificial Sequence: Synthetic oligonucleotide
aaccagacagcaaggaug

SEQ ID NO: 139109 - RNA, 18 nt, Artificial Sequence
  Description of Artificial Sequence: Synthetic oligonucleotide
ccagaaaccagacagcaa

SEQ ID NO: 139110 - RNA, 18 nt, Artificial Sequence
  Description of Artificial Sequence: Synthetic oligonucleotide
caaggccagaaaccagac

SEQ ID NO: 139111 - RNA, 18 nt, Artificial Sequence
  Description of Artificial Sequence: Synthetic oligonucleotide
uuuggcaaggccagaaac

SEQ ID NO: 139112 - RNA, 18 nt, Artificial Sequence
  Description of Artificial Sequence: Synthetic oligonucleotide
auacuuuuggcaaggcca

SEQ ID NO: 139113 - RNA, 18 nt, Artificial Sequence
  Description of Artificial Sequence: Synthetic oligonucleotide
ugguaauacuuuuggcaa

SEQ ID NO: 139114 - RNA, 18 nt, Artificial Sequence
  Description of Artificial Sequence: Synthetic oligonucleotide
ugggaugguaauacuuuu

SEQ ID NO: 139115 - RNA, 18 nt, Artificial Sequence
  Description of Artificial Sequence: Synthetic oligonucleotide
cacacugggaugguaaua

SEQ ID NO: 139116 - RNA, 18 nt, Artificial Sequence
  Description of Artificial Sequence: Synthetic oligonucleotide
uguaccacacugggaugg

SEQ ID NO: 139117 - RNA, 18 nt, Artificial Sequence
  Description of Artificial Sequence: Synthetic oligonucleotide
aagaauguaccacacugg

SEQ ID NO: 139118 - RNA, 18 nt, Artificial Sequence
  Description of Artificial Sequence: Synthetic oligonucleotide
caugaaagaauguaccac

SEQ ID NO: 139119 - RNA, 18 nt, Artificial Sequence
  Description of Artificial Sequence: Synthetic oligonucleotide
aaauacaugaaagaaugu

SEQ ID NO: 139120 - RNA, 18 nt, Artificial Sequence
  Description of Artificial Sequence: Synthetic oligonucleotide
aggaccugcagagucugc

SEQ ID NO: 139121 - RNA, 18 nt, Artificial Sequence
  Description of Artificial Sequence: Synthetic oligonucleotide
cugagaggaccugcagag

SEQ ID NO: 139122 - RNA, 18 nt, Artificial Sequence
  Description of Artificial Sequence: Synthetic oligonucleotide
aagaucugagaggaccug

SEQ ID NO: 139123 - RNA, 18 nt, Artificial Sequence
  Description of Artificial Sequence: Synthetic oligonucleotide
cgcacaagaucugagagg

SEQ ID NO: 139124 - RNA, 18 nt, Artificial Sequence
  Description of Artificial Sequence: Synthetic oligonucleotide
ccuuccgcacaagaucug

SEQ ID NO: 139125 - RNA, 18 nt, Artificial Sequence
  Description of Artificial Sequence: Synthetic oligonucleotide
ccuggccuuccgcacaag

SEQ ID NO: 139126 - RNA, 18 nt, Artificial Sequence
  Description of Artificial Sequence: Synthetic oligonucleotide
cgacuccuggccuuccgc

SEQ ID NO: 139127 - RNA, 18 nt, Artificial Sequence
  Description of Artificial Sequence: Synthetic oligonucleotide
uguuccgacuccuggccu

SEQ ID NO: 139128 - RNA, 18 nt, Artificial Sequence
  Description of Artificial Sequence: Synthetic oligonucleotide
gccaauguuccgacuccu

SEQ ID NO: 139129 - RNA, 18 nt, Artificial Sequence
  Description of Artificial Sequence: Synthetic oligonucleotide
aagaugccaauguuccga

SEQ ID NO: 139130 - RNA, 18 nt, Artificial Sequence
  Description of Artificial Sequence: Synthetic oligonucleotide
gauggaagaugccaaugu

SEQ ID NO: 139131 - RNA, 18 nt, Artificial Sequence
  Description of Artificial Sequence: Synthetic oligonucleotide
ggauggauggaagaugcc

SEQ ID NO: 139132 - RNA, 18 nt, Artificial Sequence
  Description of Artificial Sequence: Synthetic oligonucleotide
uugaaggauggauggaag

SEQ ID NO: 139133 - RNA, 18 nt, Artificial Sequence
  Description of Artificial Sequence: Synthetic oligonucleotide
uuaaguugaaggauggau

SEQ ID NO: 139134 - RNA, 18 nt, Artificial Sequence
  Description of Artificial Sequence: Synthetic oligonucleotide
cuugcuuaaguugaagga

SEQ ID NO: 139135 - RNA, 18 nt, Artificial Sequence
  Description of Artificial Sequence: Synthetic oligonucleotide
aggaacuugcuuaaguug

SEQ ID NO: 139136 - RNA, 18 nt, Artificial Sequence
  Description of Artificial Sequence: Synthetic oligonucleotide
gucggaggaacuugcuua

SEQ ID NO: 139137 - RNA, 18 nt, Artificial Sequence
  Description of Artificial Sequence: Synthetic oligonucleotide
acccugucggaggaacuu

SEQ ID NO: 139138 - RNA, 18 nt, Artificial Sequence
  Description of Artificial Sequence: Synthetic oligonucleotide
cagagacccugucggagg

SEQ ID NO: 139139 - RNA, 18 nt, Artificial Sequence
  Description of Artificial Sequence: Synthetic oligonucleotide
auuugcagagacccuguc

SEQ ID NO: 139140 - RNA, 18 nt, Artificial Sequence
  Description of Artificial Sequence: Synthetic oligonucleotide
gaggcauuugcagagacc

SEQ ID NO: 139141 - RNA, 18 nt, Artificial Sequence
  Description of Artificial Sequence: Synthetic oligonucleotide
gccgggaggcauuugcag

SEQ ID NO: 139142 - RNA, 18 nt, Artificial Sequence
  Description of Artificial Sequence: Synthetic oligonucleotide
cauuggccgggaggcauu

SEQ ID NO: 139143 - RNA, 18 nt, Artificial Sequence
  Description of Artificial Sequence: Synthetic oligonucleotide
guggacauuggccgggag

SEQ ID NO: 139144 - RNA, 18 nt, Artificial Sequence
  Description of Artificial Sequence: Synthetic oligonucleotide
agcugguggacauuggcc

SEQ ID NO: 139145 - RNA, 18 nt, Artificial Sequence
  Description of Artificial Sequence: Synthetic oligonucleotide
agaugagcugguggacau

SEQ ID NO: 139146 - RNA, 18 nt, Artificial Sequence
  Description of Artificial Sequence: Synthetic oligonucleotide
gccggagaugagcuggug

SEQ ID NO: 139147 - RNA, 18 nt, Artificial Sequence
  Description of Artificial Sequence: Synthetic oligonucleotide
auuuugccggagaugagc

SEQ ID NO: 139148 - RNA, 18 nt, Artificial Sequence
  Description of Artificial Sequence: Synthetic oligonucleotide
ugccuauuuugccggaga

SEQ ID NO: 139149 - RNA, 18 nt, Artificial Sequence
  Description of Artificial Sequence: Synthetic oligonucleotide
agagaugccuauuuugcc

SEQ ID NO: 139150 - RNA, 18 nt, Artificial Sequence
  Description of Artificial Sequence: Synthetic oligonucleotide
guaagagagaugccuauu

SEQ ID NO: 139151 - RNA, 18 nt, Artificial Sequence
  Description of Artificial Sequence: Synthetic oligonucleotide
cucugguaagagagaugc

SEQ ID NO: 139152 - RNA, 18 nt, Artificial Sequence
  Description of Artificial Sequence: Synthetic oligonucleotide
agacacucugguaagaga

SEQ ID NO: 139153 - RNA, 18 nt, Artificial Sequence
  Description of Artificial Sequence: Synthetic oligonucleotide
ccaucagacacucuggua

SEQ ID NO: 139154 - RNA, 18 nt, Artificial Sequence
  Description of Artificial Sequence: Synthetic oligonucleotide
uuuccccaucagacacuc

SEQ ID NO: 139155 - RNA, 18 nt, Artificial Sequence
  Description of Artificial Sequence: Synthetic oligonucleotide
aacguuuuccccaucaga

SEQ ID NO: 139156 - RNA, 18 nt, Artificial Sequence
  Description of Artificial Sequence: Synthetic oligonucleotide
accagaacguuuucccca

SEQ ID NO: 139157 - RNA, 18 nt, Artificial Sequence
  Description of Artificial Sequence: Synthetic oligonucleotide
cagacaccagaacguuuu

SEQ ID NO: 139158 - RNA, 18 nt, Artificial Sequence
  Description of Artificial Sequence: Synthetic oligonucleotide
aaagucagacaccagaac

SEQ ID NO: 139159 - RNA, 18 nt, Artificial Sequence
  Description of Artificial Sequence: Synthetic oligonucleotide
gaccgaaagucagacacc

SEQ ID NO: 139160 - RNA, 18 nt, Artificial Sequence
  Description of Artificial Sequence: Synthetic oligonucleotide
cuuuggaccgaaagucag

SEQ ID NO: 139161 - RNA, 18 nt, Artificial Sequence
  Description of Artificial Sequence: Synthetic oligonucleotide
uucgucuuuggaccgaaa

SEQ ID NO: 139162 - RNA, 18 nt, Artificial Sequence
  Description of Artificial Sequence: Synthetic oligonucleotide
acgacuucgucuuuggac

SEQ ID NO: 139163 - RNA, 18 nt, Artificial Sequence
  Description of Artificial Sequence: Synthetic oligonucleotide
ucacuccuccauccacau

SEQ ID NO: 139164 - RNA, 18 nt, Artificial Sequence
  Description of Artificial Sequence: Synthetic oligonucleotide
gucacucacuccuccauc

SEQ ID NO: 139165 - RNA, 18 nt, Artificial Sequence
  Description of Artificial Sequence: Synthetic oligonucleotide
acguugucacucacuccu

SEQ ID NO: 139166 - RNA, 18 nt, Artificial Sequence
  Description of Artificial Sequence: Synthetic oligonucleotide
aggguacguugucacuca

SEQ ID NO: 139167 - RNA, 18 nt, Artificial Sequence
  Description of Artificial Sequence: Synthetic oligonucleotide
aaugaaggguacguuguc

SEQ ID NO: 139168 - RNA, 18 nt, Artificial Sequence
  Description of Artificial Sequence: Synthetic oligonucleotide
gcaucaaugaaggguacg

SEQ ID NO: 139169 - RNA, 18 nt, Artificial Sequence
  Description of Artificial Sequence: Synthetic oligonucleotide
uuuuggcaucaaugaagg

SEQ ID NO: 139170 - RNA, 18 nt, Artificial Sequence
  Description of Artificial Sequence: Synthetic oligonucleotide
gguuguuuuggcaucaau

SEQ ID NO: 139171 - RNA, 18 nt, Artificial Sequence
  Description of Artificial Sequence: Synthetic oligonucleotide
gugaugguuguuuuggca

SEQ ID NO: 139172 - RNA, 18 nt, Artificial Sequence
  Description of Artificial Sequence: Synthetic oligonucleotide
acacggugaugguuguuu

SEQ ID NO: 139173 - RNA, 18 nt, Artificial Sequence
  Description of Artificial Sequence: Synthetic oligonucleotide
guacuccccauagaaggg

SEQ ID NO: 139174 - RNA, 18 nt, Artificial Sequence
  Description of Artificial Sequence: Synthetic oligonucleotide
augucguacuccccauag

SEQ ID NO: 139175 - RNA, 18 nt, Artificial Sequence
  Description of Artificial Sequence: Synthetic oligonucleotide
ggcagaugucguacuccc

SEQ ID NO: 139176 - RNA, 18 nt, Artificial Sequence
  Description of Artificial Sequence: Synthetic oligonucleotide
uuuagggcagaugucgua

SEQ ID NO: 139177 - RNA, 18 nt, Artificial Sequence
  Description of Artificial Sequence: Synthetic oligonucleotide
uugacuuuagggcagaug

SEQ ID NO: 139178 - RNA, 18 nt, Artificial Sequence
  Description of Artificial Sequence: Synthetic oligonucleotide
uggacuugacuuuagggc

SEQ ID NO: 139179 - RNA, 18 nt, Artificial Sequence
  Description of Artificial Sequence: Synthetic oligonucleotide
guucguggacuugacuuu

SEQ ID NO: 139180 - RNA, 18 nt, Artificial Sequence
  Description of Artificial Sequence: Synthetic oligonucleotide
agaaaguucguggacuug

SEQ ID NO: 139181 - RNA, 18 nt, Artificial Sequence
  Description of Artificial Sequence: Synthetic oligonucleotide
caugaagaaaguucgugg

SEQ ID NO: 139182 - RNA, 18 nt, Artificial Sequence
  Description of Artificial Sequence: Synthetic oligonucleotide
guccacaugaagaaaguu

SEQ ID NO: 139183 - RNA, 18 nt, Artificial Sequence
  Description of Artificial Sequence: Synthetic oligonucleotide
gugauguccacaugaaga

SEQ ID NO: 139184 - RNA, 18 nt, Artificial Sequence
  Description of Artificial Sequence: Synthetic oligonucleotide
gcuuggugauguccacau

SEQ ID NO: 139185 - RNA, 18 nt, Artificial Sequence
  Description of Artificial Sequence: Synthetic oligonucleotide
acugagcuuggugauguc

SEQ ID NO: 139186 - RNA, 18 nt, Artificial Sequence
  Description of Artificial Sequence: Synthetic oligonucleotide
cguagacugagcuuggug

SEQ ID NO: 139187 - RNA, 18 nt, Artificial Sequence
  Description of Artificial Sequence: Synthetic oligonucleotide
agaggcguagacugagcu

SEQ ID NO: 139188 - RNA, 18 nt, Artificial Sequence
  Description of Artificial Sequence: Synthetic oligonucleotide
ugugcagaggcguagacu

SEQ ID NO: 139189 - RNA, 18 nt, Artificial Sequence
  Description of Artificial Sequence: Synthetic oligonucleotide
uucccugugcagaggcgu

SEQ ID NO: 139190 - RNA, 18 nt, Artificial Sequence
  Description of Artificial Sequence: Synthetic oligonucleotide
agagguucccugugcaga

SEQ ID NO: 139191 - RNA, 18 nt, Artificial Sequence
  Description of Artificial Sequence: Synthetic oligonucleotide
aagguagagguucccugu

SEQ ID NO: 139192 - RNA, 18 nt, Artificial Sequence
  Description of Artificial Sequence: Synthetic oligonucleotide
gagagaagguagagguuc

SEQ ID NO: 139193 - RNA, 18 nt, Artificial Sequence
  Description of Artificial Sequence: Synthetic oligonucleotide
cucucgagagaagguaga

SEQ ID NO: 139194 - RNA, 18 nt, Artificial Sequence
  Description of Artificial Sequence: Synthetic oligonucleotide
aaaagcucucgagagaag

SEQ ID NO: 139195 - RNA, 18 nt, Artificial Sequence
  Description of Artificial Sequence: Synthetic oligonucleotide
gggacaaaagcucucgag

SEQ ID NO: 139196 - RNA, 18 nt, Artificial Sequence
  Description of Artificial Sequence: Synthetic oligonucleotide
cugcccccucaccaccaa

SEQ ID NO: 139197 - RNA, 18 nt, Artificial Sequence
  Description of Artificial Sequence: Synthetic oligonucleotide
aacaccugcccccucacc

SEQ ID NO: 139198 - RNA, 18 nt, Artificial Sequence
  Description of Artificial Sequence: Synthetic oligonucleotide
cccagaacaccugccccc

SEQ ID NO: 139199 - RNA, 18 nt, Artificial Sequence
  Description of Artificial Sequence: Synthetic oligonucleotide
ugcaccccagaacaccug

SEQ ID NO: 139200 - RNA, 18 nt, Artificial Sequence
  Description of Artificial Sequence: Synthetic oligonucleotide
agagcugcaccccagaac

SEQ ID NO: 139201 - RNA, 18 nt, Artificial Sequence
  Description of Artificial Sequence: Synthetic oligonucleotide
aaagaagagcugcacccc

SEQ ID NO: 139202 - RNA, 18 nt, Artificial Sequence
  Description of Artificial Sequence: Synthetic oligonucleotide
gaggcaaagaagagcugc

SEQ ID NO: 139203 - RNA, 18 nt, Artificial Sequence
  Description of Artificial Sequence: Synthetic oligonucleotide
ucagggaggcaaagaaga

SEQ ID NO: 139204 - RNA, 18 nt, Artificial Sequence
  Description of Artificial Sequence: Synthetic oligonucleotide
ggcaaucagggaggcaaa

SEQ ID NO: 139205 - RNA, 18 nt, Artificial Sequence
  Description of Artificial Sequence: Synthetic oligonucleotide
cuccuggcaaucagggag

SEQ ID NO: 139206 - RNA, 18 nt, Artificial Sequence
  Description of Artificial Sequence: Synthetic oligonucleotide
gguagcuccuggcaauca

SEQ ID NO: 139207 - RNA, 18 nt, Artificial Sequence
  Description of Artificial Sequence: Synthetic oligonucleotide
uaacugguagcuccuggc

SEQ ID NO: 139208 - RNA, 18 nt, Artificial Sequence
  Description of Artificial Sequence: Synthetic oligonucleotide
gacaguaacugguagcuc

SEQ ID NO: 139209 - RNA, 18 nt, Artificial Sequence
  Description of Artificial Sequence: Synthetic oligonucleotide
gugcagacaguaacuggu

SEQ ID NO: 139210 - RNA, 18 nt, Artificial Sequence
  Description of Artificial Sequence: Synthetic oligonucleotide
ugauugugcagacaguaa

SEQ ID NO: 139211 - RNA, 18 nt, Artificial Sequence
  Description of Artificial Sequence: Synthetic oligonucleotide
cuguuugauugugcagac

SEQ ID NO: 139212 - RNA, 18 nt, Artificial Sequence
  Description of Artificial Sequence: Synthetic oligonucleotide
uauuucuguuugauugug

SEQ ID NO: 139213 - RNA, 18 nt, Artificial Sequence
  Description of Artificial Sequence: Synthetic oligonucleotide
aggucuauuucuguuuga

SEQ ID NO: 139214 - RNA, 18 nt, Artificial Sequence
  Description of Artificial Sequence: Synthetic oligonucleotide
aggacaggucuauuucug

SEQ ID NO: 139215 - RNA, 18 nt, Artificial Sequence
  Description of Artificial Sequence: Synthetic oligonucleotide
caucaaggacaggucuau

SEQ ID NO: 139216 - RNA, 18 nt, Artificial Sequence
  Description of Artificial Sequence: Synthetic oligonucleotide
uuaaccaucaaggacagg

SEQ ID NO: 139217 - RNA, 18 nt, Artificial Sequence
  Description of Artificial Sequence: Synthetic oligonucleotide
uuccguuaaccaucaagg

SEQ ID NO: 139218 - RNA, 18 nt, Artificial Sequence
  Description of Artificial Sequence: Synthetic oligonucleotide
uuuauuuccguuaaccau

SEQ ID NO: 139219 - RNA, 18 nt, Artificial Sequence
  Description of Artificial Sequence: Synthetic oligonucleotide
cgccuuuuauuuccguua

SEQ ID NO: 139220 - RNA, 18 nt, Artificial Sequence
  Description of Artificial Sequence: Synthetic oligonucleotide
acaagcgccuuuuauuuc

SEQ ID NO: 139221 - RNA, 18 nt, Artificial Sequence
  Description of Artificial Sequence: Synthetic oligonucleotide
cugggacaagcgccuuuu

SEQ ID NO: 139222 - RNA, 18 nt, Artificial Sequence
  Description of Artificial Sequence: Synthetic oligonucleotide
agcuucugggacaagcgc

SEQ ID NO: 139223 - RNA, 18 nt, Artificial Sequence
  Description of Artificial Sequence: Synthetic oligonucleotide
accugagcuucugggaca

SEQ ID NO: 139224 - RNA, 18 nt, Artificial Sequence
  Description of Artificial Sequence: Synthetic oligonucleotide
gccucaccugagcuucug

SEQ ID NO: 139225 - RNA, 18 nt, Artificial Sequence
  Description of Artificial Sequence: Synthetic oligonucleotide
guggugccucaccugagc

SEQ ID NO: 139226 - RNA, 18 nt, Artificial Sequence
  Description of Artificial Sequence: Synthetic oligonucleotide
ucaggguggugccucacc

SEQ ID NO: 139227 - RNA, 18 nt, Artificial Sequence
  Description of Artificial Sequence: Synthetic oligonucleotide
cauaaucaggguggugcc

SEQ ID NO: 139228 - RNA, 18 nt, Artificial Sequence
  Description of Artificial Sequence: Synthetic oligonucleotide
auucccauaaucagggug

SEQ ID NO: 139229 - RNA, 18 nt, Artificial Sequence
  Description of Artificial Sequence: Synthetic oligonucleotide
aggugauucccauaauca

SEQ ID NO: 139230 - RNA, 18 nt, Artificial Sequence
  Description of Artificial Sequence: Synthetic oligonucleotide
uucccaggugauucccau

SEQ ID NO: 139231 - RNA, 18 nt, Artificial Sequence
  Description of Artificial Sequence: Synthetic oligonucleotide
auauguucccaggugauu

SEQ ID NO: 139232 - RNA, 18 nt, Artificial Sequence
  Description of Artificial Sequence: Synthetic oligonucleotide
uggguauauguucccagg

SEQ ID NO: 139233 - RNA, 18 nt, Artificial Sequence
  Description of Artificial Sequence: Synthetic oligonucleotide
aggucuggguauauguuc

SEQ ID NO: 139234 - RNA, 18 nt, Artificial Sequence
  Description of Artificial Sequence: Synthetic oligonucleotide
guuuuaggucuggguaua

SEQ ID NO: 139235 - RNA, 18 nt, Artificial Sequence
  Description of Artificial Sequence: Synthetic oligonucleotide
ucugaguuuuaggucugg

SEQ ID NO: 139236 - RNA, 18 nt, Artificial Sequence
  Description of Artificial Sequence: Synthetic oligonucleotide
guggaucugaguuuuagg

SEQ ID NO: 139237 - RNA, 18 nt, Artificial Sequence
  Description of Artificial Sequence: Synthetic oligonucleotide
gggaaguggaucugaguu

SEQ ID NO: 139238 - RNA, 18 nt, Artificial Sequence
  Description of Artificial Sequence: Synthetic oligonucleotide
agccugggaaguggaucu

SEQ ID NO: 139239 - RNA, 18 nt, Artificial Sequence
  Description of Artificial Sequence: Synthetic oligonucleotide
accacagccugggaagug

SEQ ID NO: 139240 - RNA, 18 nt, Artificial Sequence
  Description of Artificial Sequence: Synthetic oligonucleotide
auauaaccacagccuggg

SEQ ID NO: 139241 - RNA, 18 nt, Artificial Sequence
  Description of Artificial Sequence: Synthetic oligonucleotide
ugacuauauaaccacagc

SEQ ID NO: 139242 - RNA, 18 nt, Artificial Sequence
  Description of Artificial Sequence: Synthetic oligonucleotide
cccccugacuauauaacc

SEQ ID NO: 139243 - RNA, 18 nt, Artificial Sequence
  Description of Artificial Sequence: Synthetic oligonucleotide
ugcaccccccugacuaua

SEQ ID NO: 139244 - RNA, 18 nt, Artificial Sequence
  Description of Artificial Sequence: Synthetic oligonucleotide
cauacugcaccccccuga

SEQ ID NO: 139245 - RNA, 18 nt, Artificial Sequence
  Description of Artificial Sequence: Synthetic oligonucleotide
auacccauacugcacccc

SEQ ID NO: 139246 - RNA, 18 nt, Artificial Sequence
  Description of Artificial Sequence: Synthetic oligonucleotide
uccuaauacccauacugc

SEQ ID NO: 139247 - RNA, 18 nt, Artificial Sequence
  Description of Artificial Sequence: Synthetic oligonucleotide
aaaaauccuaauacccau

SEQ ID NO: 139248 - RNA, 18 nt, Artificial Sequence
  Description of Artificial Sequence: Synthetic oligonucleotide
aaauaaaaaauccuaaua

SEQ ID NO: 139249 - RNA, 18 nt, Artificial Sequence
  Description of Artificial Sequence: Synthetic oligonucleotide
cuaaaaaauaaaaaaucc

SEQ ID NO: 139250 - RNA, 18 nt, Artificial Sequence
  Description of Artificial Sequence: Synthetic oligonucleotide
uauaacuaaaaaauaaaa

SEQ ID NO: 139251 - RNA, 18 nt, Artificial Sequence
  Description of Artificial Sequence: Synthetic oligonucleotide
aucuuuauaacuaaaaaa

SEQ ID NO: 139252 - RNA, 18 nt, Artificial Sequence
  Description of Artificial Sequence: Synthetic oligonucleotide
aaaaaaucuuuauaacua

SEQ ID NO: 139253 - RNA, 18 nt, Artificial Sequence
  Description of Artificial Sequence: Synthetic oligonucleotide
ccaaaaaaaaaucuuuau

SEQ ID NO: 139254 - RNA, 18 nt, Artificial Sequence
  Description of Artificial Sequence: Synthetic oligonucleotide
acaaaccaaaaaaaaauc

SEQ ID NO: 139255 - RNA, 18 nt, Artificial Sequence
  Description of Artificial Sequence: Synthetic oligonucleotide
caaaaacaaaccaaaaaa

SEQ ID NO: 139256 - RNA, 18 nt, Artificial Sequence
  Description of Artificial Sequence: Synthetic oligonucleotide
ugucucaaaaacaaacca

SEQ ID NO: 139257 - RNA, 18 nt, Artificial Sequence
  Description of Artificial Sequence: Synthetic oligonucleotide
gacccugucucaaaaaca

SEQ ID NO: 139258 - RNA, 18 nt, Artificial Sequence
  Description of Artificial Sequence: Synthetic oligonucleotide
agcaagacccugucucaa

SEQ ID NO: 139259 - RNA, 18 nt, Artificial Sequence
  Description of Artificial Sequence: Synthetic oligonucleotide
ggcagagcaagacccugu

SEQ ID NO: 139260 - RNA, 18 nt, Artificial Sequence
  Description of Artificial Sequence: Synthetic oligonucleotide
uaagcggcagagcaagac

SEQ ID NO: 139261 - RNA, 18 nt, Artificial Sequence
  Description of Artificial Sequence: Synthetic oligonucleotide
cagccuaagcggcagagc

SEQ ID NO: 139262 - RNA, 18 nt, Artificial Sequence
  Description of Artificial Sequence: Synthetic oligonucleotide
cacuccagccuaagcggc

SEQ ID NO: 139263 - RNA, 18 nt, Artificial Sequence
  Description of Artificial Sequence: Synthetic oligonucleotide
cacugcacuccagccuaa

SEQ ID NO: 139264 - RNA, 18 nt, Artificial Sequence
  Description of Artificial Sequence: Synthetic oligonucleotide
ugcaccacugcacuccag

SEQ ID NO: 139265 - RNA, 18 nt, Artificial Sequence
  Description of Artificial Sequence: Synthetic oligonucleotide
augauugcaccacugcac

SEQ ID NO: 139266 - RNA, 18 nt, Artificial Sequence
  Description of Artificial Sequence: Synthetic oligonucleotide
gagcuaugauugcaccac

SEQ ID NO: 139267 - RNA, 18 nt, Artificial Sequence
  Description of Artificial Sequence: Synthetic oligonucleotide
ucagugagcuaugauugc

SEQ ID NO: 139268 - RNA, 18 nt, Artificial Sequence
  Description of Artificial Sequence: Synthetic oligonucleotide
aggcuucagugagcuaug

SEQ ID NO: 139269 - RNA, 18 nt, Artificial Sequence
  Description of Artificial Sequence: Synthetic oligonucleotide
gucugaggcuucagugag

SEQ ID NO: 139270 - RNA, 18 nt, Artificial Sequence
  Description of Artificial Sequence: Synthetic oligonucleotide
caggagucugaggcuuca

SEQ ID NO: 139271 - RNA, 18 nt, Artificial Sequence
  Description of Artificial Sequence: Synthetic oligonucleotide
gaacccaggagucugagg

SEQ ID NO: 139272 - RNA, 18 nt, Artificial Sequence
  Description of Artificial Sequence: Synthetic oligonucleotide
ugcuugaacccaggaguc

SEQ ID NO: 139273 - RNA, 18 nt, Artificial Sequence
  Description of Artificial Sequence: Synthetic oligonucleotide
aggacugcuugaacccag

SEQ ID NO: 139274 - RNA, 18 nt, Artificial Sequence
  Description of Artificial Sequence: Synthetic oligonucleotide
gugggaggacugcuugaa

SEQ ID NO: 139275 - RNA, 18 nt, Artificial Sequence
  Description of Artificial Sequence: Synthetic oligonucleotide
cugaggugggaggacugc

SEQ ID NO: 139276 - RNA, 18 nt, Artificial Sequence
  Description of Artificial Sequence: Synthetic oligonucleotide
ggaggcugaggugggagg

SEQ ID NO: 139277 - RNA, 18 nt, Artificial Sequence
  Description of Artificial Sequence: Synthetic oligonucleotide
ccuuaggaggcugaggug

SEQ ID NO: 139278 - RNA, 18 nt, Artificial Sequence
  Description of Artificial Sequence: Synthetic oligonucleotide
cagcuccuuaggaggcug

SEQ ID NO: 139279 - RNA, 18 nt, Artificial Sequence
  Description of Artificial Sequence: Synthetic oligonucleotide
ggucccagcuccuuagga

SEQ ID NO: 139280 - RNA, 18 nt, Artificial Sequence
  Description of Artificial Sequence: Synthetic oligonucleotide
cugugggucccagcuccu

SEQ ID NO: 139281 - RNA, 18 nt, Artificial Sequence
  Description of Artificial Sequence: Synthetic oligonucleotide
caugccugugggucccag

SEQ ID NO: 139282 - RNA, 18 nt, Artificial Sequence
  Description of Artificial Sequence: Synthetic oligonucleotide
ugcugcaugccugugggu

SEQ ID NO: 139283 - RNA, 18 nt, Artificial Sequence
  Description of Artificial Sequence: Synthetic oligonucleotide
uguggugcugcaugccug

SEQ ID NO: 139284 - RNA, 18 nt, Artificial Sequence
  Description of Artificial Sequence: Synthetic oligonucleotide
ccagguguggugcugcau

SEQ ID NO: 139285 - RNA, 18 nt, Artificial Sequence
  Description of Artificial Sequence: Synthetic oligonucleotide
auuagccagguguggugc

SEQ ID NO: 139286 - RNA, 18 nt, Artificial Sequence
  Description of Artificial Sequence: Synthetic oligonucleotide
uaaaaauuagccaggugu

SEQ ID NO: 139287 - RNA, 18 nt, Artificial Sequence
  Description of Artificial Sequence: Synthetic oligonucleotide
auuuuuaaaaauuagcca

SEQ ID NO: 139288 - RNA, 18 nt, Artificial Sequence
  Description of Artificial Sequence: Synthetic oligonucleotide
acaaaauuuuuaaaaauu

SEQ ID NO: 139289 - RNA, 18 nt, Artificial Sequence
  Description of Artificial Sequence: Synthetic oligonucleotide
acuccacaaaauuuuuaa

SEQ ID NO: 139290 - RNA, 18 nt, Artificial Sequence
  Description of Artificial Sequence: Synthetic oligonucleotide
gcaacacuccacaaaauu

SEQ ID NO: 139291 - RNA, 18 nt, Artificial Sequence
  Description of Artificial Sequence: Synthetic oligonucleotide
ccugggcaacacuccaca

SEQ ID NO: 139292 - RNA, 18 nt, Artificial Sequence
  Description of Artificial Sequence: Synthetic oligonucleotide
accagccugggcaacacu

SEQ ID NO: 139293 - RNA, 18 nt, Artificial Sequence
  Description of Artificial Sequence: Synthetic oligonucleotide
gugagaccagccugggca

SEQ ID NO: 139294 - RNA, 18 nt, Artificial Sequence
  Description of Artificial Sequence: Synthetic oligonucleotide
ggagugugagaccagccu

SEQ ID NO: 139295 - RNA, 18 nt, Artificial Sequence
  Description of Artificial Sequence: Synthetic oligonucleotide
ccugaccucaggugaucc

SEQ ID NO: 139296 - RNA, 18 nt, Artificial Sequence
  Description of Artificial Sequence: Synthetic oligonucleotide
aaacuccugaccucaggu

SEQ ID NO: 139297 - RNA, 18 nt, Artificial Sequence
  Description of Artificial Sequence: Synthetic oligonucleotide
gucucaaacuccugaccu

SEQ ID NO: 139298 - RNA, 18 nt, Artificial Sequence
  Description of Artificial Sequence: Synthetic oligonucleotide
ggcuggucucaaacuccu

SEQ ID NO: 139299 - RNA, 18 nt, Artificial Sequence
  Description of Artificial Sequence: Synthetic oligonucleotide
ggccaggcuggucucaaa

SEQ ID NO: 139300 - RNA, 18 nt, Artificial Sequence
  Description of Artificial Sequence: Synthetic oligonucleotide
auguuggccaggcugguc

SEQ ID NO: 139301 - RNA, 18 nt, Artificial Sequence
  Description of Artificial Sequence: Synthetic oligonucleotide
ucaccauguuggccaggc

SEQ ID NO: 139302 - RNA, 18 nt, Artificial Sequence
  Description of Artificial Sequence: Synthetic oligonucleotide
ggguuucaccauguuggc

SEQ ID NO: 139303 - RNA, 18 nt, Artificial Sequence
  Description of Artificial Sequence: Synthetic oligonucleotide
auuuuucauggagacggg

SEQ ID NO: 139304 - RNA, 18 nt, Artificial Sequence
  Description of Artificial Sequence: Synthetic oligonucleotide
uauuuuucauggagacgg

SEQ ID NO: 139305 - RNA, 18 nt, Artificial Sequence
  Description of Artificial Sequence: Synthetic oligonucleotide
uuuuguauuuuucaugga

SEQ ID NO: 139306 - RNA, 18 nt, Artificial Sequence
  Description of Artificial Sequence: Synthetic oligonucleotide
guaauuuuuguauuuuuc

SEQ ID NO: 139307 - RNA, 18 nt, Artificial Sequence
  Description of Artificial Sequence: Synthetic oligonucleotide
cccggguaauuuuuguau

SEQ ID NO: 139308 - RNA, 18 nt, Artificial Sequence
  Description of Artificial Sequence: Synthetic oligonucleotide
ccaugcccggguaauuuu

SEQ ID NO: 139309 - RNA, 18 nt, Artificial Sequence
  Description of Artificial Sequence: Synthetic oligonucleotide
cgccaccaugcccgggua

SEQ ID NO: 139310 - RNA, 18 nt, Artificial Sequence
  Description of Artificial Sequence: Synthetic oligonucleotide
gugcccgccaccaugccc

SEQ ID NO: 139311 - RNA, 18 nt, Artificial Sequence
  Description of Artificial Sequence: Synthetic oligonucleotide
uacaggugcccgccacca

SEQ ID NO: 139312 - RNA, 18 nt, Artificial Sequence
  Description of Artificial Sequence: Synthetic oligonucleotide
gggauuacaggugcccgc

SEQ ID NO: 139313 - RNA, 18 nt, Artificial Sequence
  Description of Artificial Sequence: Synthetic oligonucleotide
uagcugggauuacaggug

SEQ ID NO: 139314 - RNA, 18 nt, Artificial Sequence
  Description of Artificial Sequence: Synthetic oligonucleotide
ccuaguagcugggauuac

SEQ ID NO: 139315 - RNA, 18 nt, Artificial Sequence
  Description of Artificial Sequence: Synthetic oligonucleotide
gccucccuaguagcuggg

SEQ ID NO: 139316 - RNA, 18 nt, Artificial Sequence
  Description of Artificial Sequence: Synthetic oligonucleotide
ccucagccucccuaguag

SEQ ID NO: 139317 - RNA, 18 nt, Artificial Sequence
  Description of Artificial Sequence: Synthetic oligonucleotide
uccugccucagccucccu

SEQ ID NO: 139318 - RNA, 18 nt, Artificial Sequence
  Description of Artificial Sequence: Synthetic oligonucleotide
cauuuuccugccucagcc

SEQ ID NO: 139319 - RNA, 18 nt, Artificial Sequence
  Description of Artificial Sequence: Synthetic oligonucleotide
caagccauuuuccugccu

SEQ ID NO: 139320 - RNA, 18 nt, Artificial Sequence
  Description of Artificial Sequence: Synthetic oligonucleotide
agguucaagccauuuucc

SEQ ID NO: 139321 - RNA, 18 nt, Artificial Sequence
  Description of Artificial Sequence: Synthetic oligonucleotide
uuccgagguucaagccau

SEQ ID NO: 139322 - RNA, 18 nt, Artificial Sequence
  Description of Artificial Sequence: Synthetic oligonucleotide
uccacuuccgagguucaa

SEQ ID NO: 139323 - RNA, 18 nt, Artificial Sequence
  Description of Artificial Sequence: Synthetic oligonucleotide
ccaccuccacuuccgagg

SEQ ID NO: 139324 - RNA, 18 nt, Artificial Sequence
  Description of Artificial Sequence: Synthetic oligonucleotide
aacggccaccuccacuuc

SEQ ID NO: 139325 - RNA, 18 nt, Artificial Sequence
  Description of Artificial Sequence: Synthetic oligonucleotide
cggcuaacggccaccucc

SEQ ID NO: 139326 - RNA, 18 nt, Artificial Sequence
  Description of Artificial Sequence: Synthetic oligonucleotide
gaucucggcuaacggcca

SEQ ID NO: 139327 - RNA, 18 nt, Artificial Sequence
  Description of Artificial Sequence: Synthetic oligonucleotide
ggcgugaucucggcuaac

SEQ ID NO: 139328 - RNA, 18 nt, Artificial Sequence
  Description of Artificial Sequence: Synthetic oligonucleotide
gcaguggcgugaucucgg

SEQ ID NO: 139329 - RNA, 18 nt, Artificial Sequence
  Description of Artificial Sequence: Synthetic oligonucleotide
ggagugcaguggcgugau

SEQ ID NO: 139330 - RNA, 18 nt, Artificial Sequence
  Description of Artificial Sequence: Synthetic oligonucleotide
aggcuggagugcaguggc

SEQ ID NO: 139331 - RNA, 18 nt, Artificial Sequence
  Description of Artificial Sequence: Synthetic oligonucleotide
ugcccaggcuggagugca

SEQ ID NO: 139332 - RNA, 18 nt, Artificial Sequence
  Description of Artificial Sequence: Synthetic oligonucleotide
ucuguugcccaggcugga

SEQ ID NO: 139333 - RNA, 18 nt, Artificial Sequence
  Description of Artificial Sequence: Synthetic oligonucleotide
cuugcucuguugcccagg

SEQ ID NO: 139334 - RNA, 18 nt, Artificial Sequence
  Description of Artificial Sequence: Synthetic oligonucleotide
agagucuugcucuguugc

SEQ ID NO: 139335 - RNA, 18 nt, Artificial Sequence
  Description of Artificial Sequence: Synthetic oligonucleotide
aaggcagagucuugcucu

SEQ ID NO: 139336 - RNA, 18 nt, Artificial Sequence
  Description of Artificial Sequence: Synthetic oligonucleotide
uuuuuaaggcagagucuu

SEQ ID NO: 139337 - RNA, 18 nt, Artificial Sequence
  Description of Artificial Sequence: Synthetic oligonucleotide
uuuuuuuuuuaaggcaga

SEQ ID NO: 139338 - RNA, 18 nt, Artificial Sequence
  Description of Artificial Sequence: Synthetic oligonucleotide
uuuuuuuuuuuuuuuaag

SEQ ID NO: 139339 - RNA, 18 nt, Artificial Sequence
  Description of Artificial Sequence: Synthetic oligonucleotide
uuuuuuuuuuuuuuuuuu

SEQ ID NO: 139340 - RNA, 18 nt, Artificial Sequence
  Description of Artificial Sequence: Synthetic oligonucleotide
uuuucuuuuuuuuuuuuu

SEQ ID NO: 139341 - RNA, 18 nt, Artificial Sequence
  Description of Artificial Sequence: Synthetic oligonucleotide
uuuacuuuucuuuuuuuu

SEQ ID NO: 139342 - RNA, 18 nt, Artificial Sequence
  Description of Artificial Sequence: Synthetic oligonucleotide
uuccuuuuacuuuucuuu

SEQ ID NO: 139343 - RNA, 18 nt, Artificial Sequence
  Description of Artificial Sequence: Synthetic oligonucleotide
uuuuuuuccuuuuacuuu

SEQ ID NO: 139344 - RNA, 18 nt, Artificial Sequence
  Description of Artificial Sequence: Synthetic oligonucleotide
ccucuuuuuuuuccuuuu

SEQ ID NO: 139345 - RNA, 18 nt, Artificial Sequence
  Description of Artificial Sequence: Synthetic oligonucleotide
cagagccucuuuuuuuuc

SEQ ID NO: 139346 - RNA, 18 nt, Artificial Sequence
  Description of Artificial Sequence: Synthetic oligonucleotide
caggccagagccucuuuu

SEQ ID NO: 139347 - RNA, 18 nt, Artificial Sequence
  Description of Artificial Sequence: Synthetic oligonucleotide
cccagcaggccagagccu

SEQ ID NO: 139348 - RNA, 18 nt, Artificial Sequence
  Description of Artificial Sequence: Synthetic oligonucleotide
ggcaccccagcaggccag

SEQ ID NO: 139349 - RNA, 18 nt, Artificial Sequence
  Description of Artificial Sequence: Synthetic oligonucleotide
uugcaggcaccccagcag

SEQ ID NO: 139350 - RNA, 18 nt, Artificial Sequence
  Description of Artificial Sequence: Synthetic oligonucleotide
agacuuugcaggcacccc

SEQ ID NO: 139351 - RNA, 18 nt, Artificial Sequence
  Description of Artificial Sequence: Synthetic oligonucleotide
cacggagacuuugcaggc

SEQ ID NO: 139352 - RNA, 18 nt, Artificial Sequence
  Description of Artificial Sequence: Synthetic oligonucleotide
ccuuccacggagacuuug

SEQ ID NO: 139353 - RNA, 18 nt, Artificial Sequence
  Description of Artificial Sequence: Synthetic oligonucleotide
gucacccuuccacggaga

SEQ ID NO: 139354 - RNA, 18 nt, Artificial Sequence
  Description of Artificial Sequence: Synthetic oligonucleotide
ugaaugucacccuuccac

SEQ ID NO: 139355 - RNA, 18 nt, Artificial Sequence
  Description of Artificial Sequence: Synthetic oligonucleotide
cggcuugaaugucacccu

SEQ ID NO: 139356 - RNA, 18 nt, Artificial Sequence
  Description of Artificial Sequence: Synthetic oligonucleotide
ggucucggcuugaauguc

SEQ ID NO: 139357 - RNA, 18 nt, Artificial Sequence
  Description of Artificial Sequence: Synthetic oligonucleotide
cuggaggucucggcuuga

SEQ ID NO: 139358 - RNA, 18 nt, Artificial Sequence
  Description of Artificial Sequence: Synthetic oligonucleotide
guucccuggaggucucgg

SEQ ID NO: 139359 - RNA, 18 nt, Artificial Sequence
  Description of Artificial Sequence: Synthetic oligonucleotide
agacaguucccuggaggu

SEQ ID NO: 139360 - RNA, 18 nt, Artificial Sequence
  Description of Artificial Sequence: Synthetic oligonucleotide
ccaggagacaguucccug

SEQ ID NO: 139361 - RNA, 18 nt, Artificial Sequence
  Description of Artificial Sequence: Synthetic oligonucleotide
ugcucccaggagacaguu

SEQ ID NO: 139362 - RNA, 18 nt, Artificial Sequence
  Description of Artificial Sequence: Synthetic oligonucleotide
cucugugcucccaggaga

SEQ ID NO: 139363 - RNA, 18 nt, Artificial Sequence
  Description of Artificial Sequence: Synthetic oligonucleotide
aagggcucugugcuccca

SEQ ID NO: 139364 - RNA, 18 nt, Artificial Sequence
  Description of Artificial Sequence: Synthetic oligonucleotide
gagcaaagggcucugugc

SEQ ID NO: 139365 - RNA, 18 nt, Artificial Sequence
  Description of Artificial Sequence: Synthetic oligonucleotide
gggcugagcaaagggcuc

SEQ ID NO: 139366 - RNA, 18 nt, Artificial Sequence
  Description of Artificial Sequence: Synthetic oligonucleotide
ggcacugagccaccuggg

SEQ ID NO: 139367 - RNA, 18 nt, Artificial Sequence
  Description of Artificial Sequence: Synthetic oligonucleotide
gggcacugagccaccugg

SEQ ID NO: 139368 - RNA, 18 nt, Artificial Sequence
  Description of Artificial Sequence: Synthetic oligonucleotide
cugagucugcuggcuggg

SEQ ID NO: 139369 - RNA, 18 nt, Artificial Sequence
  Description of Artificial Sequence: Synthetic oligonucleotide
agcucugagucugcuggc

SEQ ID NO: 139370 - RNA, 18 nt, Artificial Sequence
  Description of Artificial Sequence: Synthetic oligonucleotide
augcaagcucugagucug

SEQ ID NO: 139371 - RNA, 18 nt, Artificial Sequence
  Description of Artificial Sequence: Synthetic oligonucleotide
gaaucaugcaagcucuga

SEQ ID NO: 139372 - RNA, 18 nt, Artificial Sequence
  Description of Artificial Sequence: Synthetic oligonucleotide
ccaaagaaucaugcaagc

SEQ ID NO: 139373 - RNA, 18 nt, Artificial Sequence
  Description of Artificial Sequence: Synthetic oligonucleotide
gagcaccaaagaaucaug

SEQ ID NO: 139374 - RNA, 18 nt, Artificial Sequence
  Description of Artificial Sequence: Synthetic oligonucleotide
gcagagagcaccaaagaa

SEQ ID NO: 139375 - RNA, 18 nt, Artificial Sequence
  Description of Artificial Sequence: Synthetic oligonucleotide
agaccgcagagagcacca

SEQ ID NO: 139376 - RNA, 18 nt, Artificial Sequence
  Description of Artificial Sequence: Synthetic oligonucleotide
uuggaagaccgcagagag

SEQ ID NO: 139377 - RNA, 18 nt, Artificial Sequence
  Description of Artificial Sequence: Synthetic oligonucleotide
caucauuggaagaccgca

SEQ ID NO: 139378 - RNA, 18 nt, Artificial Sequence
  Description of Artificial Sequence: Synthetic oligonucleotide
uucagcaucauuggaaga

SEQ ID NO: 139379 - RNA, 18 nt, Artificial Sequence
  Description of Artificial Sequence: Synthetic oligonucleotide
uuuauuucagcaucauug

SEQ ID NO: 139380 - RNA, 18 nt, Artificial Sequence
  Description of Artificial Sequence: Synthetic oligonucleotide
caccauuuauuucagcau

SEQ ID NO: 139381 - RNA, 18 nt, Artificial Sequence
  Description of Artificial Sequence: Synthetic oligonucleotide
ccaagcaccauuuauuuc

SEQ ID NO: 139382 - RNA, 18 nt, Artificial Sequence
  Description of Artificial Sequence: Synthetic oligonucleotide
agacaccaagcaccauuu

SEQ ID NO: 139383 - RNA, 18 nt, Artificial Sequence
  Description of Artificial Sequence: Synthetic oligonucleotide
cagggagacaccaagcac

SEQ ID NO: 139384 - RNA, 18 nt, Artificial Sequence
  Description of Artificial Sequence: Synthetic oligonucleotide
uacagcagggagacacca

SEQ ID NO: 139385 - RNA, 18 nt, Artificial Sequence
  Description of Artificial Sequence: Synthetic oligonucleotide
gggacuacagcagggaga

SEQ ID NO: 139386 - RNA, 18 nt, Artificial Sequence
  Description of Artificial Sequence: Synthetic oligonucleotide
ggcauaucucucccagca

SEQ ID NO: 139387 - RNA, 18 nt, Artificial Sequence
  Description of Artificial Sequence: Synthetic oligonucleotide
ucgaaggcauaucucucc

SEQ ID NO: 139388 - RNA, 18 nt, Artificial Sequence
  Description of Artificial Sequence: Synthetic oligonucleotide
uauccucgaaggcauauc

SEQ ID NO: 139389 - RNA, 18 nt, Artificial Sequence
  Description of Artificial Sequence: Synthetic oligonucleotide
ccaaauauccucgaaggc

SEQ ID NO: 139390 - RNA, 18 nt, Artificial Sequence
  Description of Artificial Sequence: Synthetic oligonucleotide
ugcauccaaauauccucg

SEQ ID NO: 139391 - RNA, 18 nt, Artificial Sequence
  Description of Artificial Sequence: Synthetic oligonucleotide
cugaaugcauccaaauau

SEQ ID NO: 139392 - RNA, 18 nt, Artificial Sequence
  Description of Artificial Sequence: Synthetic oligonucleotide
agaaccugaaugcaucca

SEQ ID NO: 139393 - RNA, 18 nt, Artificial Sequence
  Description of Artificial Sequence: Synthetic oligonucleotide
uuccaagaaccugaaugc

SEQ ID NO: 139394 - RNA, 18 nt, Artificial Sequence
  Description of Artificial Sequence: Synthetic oligonucleotide
uucucuuccaagaaccug

SEQ ID NO: 139395 - RNA, 18 nt, Artificial Sequence
  Description of Artificial Sequence: Synthetic oligonucleotide
gcauaucucucccagcac

SEQ ID NO: 139396 - RNA, 18 nt, Artificial Sequence
  Description of Artificial Sequence: Synthetic oligonucleotide
cgaaggcauaucucuccc

SEQ ID NO: 139397 - RNA, 18 nt, Artificial Sequence
  Description of Artificial Sequence: Synthetic oligonucleotide
auccucgaaggcauaucu

SEQ ID NO: 139398 - RNA, 18 nt, Artificial Sequence
  Description of Artificial Sequence: Synthetic oligonucleotide
caaauauccucgaaggca

SEQ ID NO: 139399 - RNA, 18 nt, Artificial Sequence
  Description of Artificial Sequence: Synthetic oligonucleotide
gcauccaaauauccucga

SEQ ID NO: 139400 - RNA, 18 nt, Artificial Sequence
  Description of Artificial Sequence: Synthetic oligonucleotide
ugaaugcauccaaauauc

SEQ ID NO: 139401 - RNA, 18 nt, Artificial Sequence
  Description of Artificial Sequence: Synthetic oligonucleotide
gaaccugaaugcauccaa

SEQ ID NO: 139402 - RNA, 18 nt, Artificial Sequence
  Description of Artificial Sequence: Synthetic oligonucleotide
uccaagaaccugaaugca

SEQ ID NO: 139403 - RNA, 18 nt, Artificial Sequence
  Description of Artificial Sequence: Synthetic oligonucleotide
ucucuuccaagaaccuga

SEQ ID NO: 139404 - RNA, 18 nt, Artificial Sequence
  Description of Artificial Sequence: Synthetic oligonucleotide
ugauccucccagcccaua

SEQ ID NO: 139405 - RNA, 18 nt, Artificial Sequence
  Description of Artificial Sequence: Synthetic oligonucleotide
auggcugauccucccagc

SEQ ID NO: 139406 - RNA, 18 nt, Artificial Sequence
  Description of Artificial Sequence: Synthetic oligonucleotide
agggcauggcugauccuc

SEQ ID NO: 139407 - RNA, 18 nt, Artificial Sequence
  Description of Artificial Sequence: Synthetic oligonucleotide
ucaaaagggcauggcuga

SEQ ID NO: 139408 - RNA, 18 nt, Artificial Sequence
  Description of Artificial Sequence: Synthetic oligonucleotide
gcuugucaaaagggcaug

SEQ ID NO: 139409 - RNA, 18 nt, Artificial Sequence
  Description of Artificial Sequence: Synthetic oligonucleotide
uaaaugcuugucaaaagg

SEQ ID NO: 139410 - RNA, 18 nt, Artificial Sequence
  Description of Artificial Sequence: Synthetic oligonucleotide
gcuaguaaaugcuuguca

SEQ ID NO: 139411 - RNA, 18 nt, Artificial Sequence
  Description of Artificial Sequence: Synthetic oligonucleotide
agaccgcuaguaaaugcu

SEQ ID NO: 139412 - RNA, 18 nt, Artificial Sequence
  Description of Artificial Sequence: Synthetic oligonucleotide
uaccaagaccgcuaguaa

SEQ ID NO: 139413 - RNA, 18 nt, Artificial Sequence
  Description of Artificial Sequence: Synthetic oligonucleotide
gucuuuaccaagaccgcu

SEQ ID NO: 139414 - RNA, 18 nt, Artificial Sequence
  Description of Artificial Sequence: Synthetic oligonucleotide
cucaagucuuuaccaaga

SEQ ID NO: 139415 - RNA, 18 nt, Artificial Sequence
  Description of Artificial Sequence: Synthetic oligonucleotide
caaaucucaagucuuuac

SEQ ID NO: 139416 - RNA, 18 nt, Artificial Sequence
  Description of Artificial Sequence: Synthetic oligonucleotide
uaaggcaaaucucaaguc

SEQ ID NO: 139417 - RNA, 18 nt, Artificial Sequence
  Description of Artificial Sequence: Synthetic oligonucleotide
agaacuaaggcaaaucuc

SEQ ID NO: 139418 - RNA, 18 nt, Artificial Sequence
  Description of Artificial Sequence: Synthetic oligonucleotide
guguuagaacuaaggcaa

SEQ ID NO: 139419 - RNA, 18 nt, Artificial Sequence
  Description of Artificial Sequence: Synthetic oligonucleotide
acuaaguguuagaacuaa

SEQ ID NO: 139420 - RNA, 18 nt, Artificial Sequence
  Description of Artificial Sequence: Synthetic oligonucleotide
ugggcacuaaguguuaga

SEQ ID NO: 139421 - RNA, 18 nt, Artificial Sequence
  Description of Artificial Sequence: Synthetic oligonucleotide
ggcguugggcacuaagug

SEQ ID NO: 139422 - RNA, 18 nt, Artificial Sequence
  Description of Artificial Sequence: Synthetic oligonucleotide
aggaaggcguugggcacu

SEQ ID NO: 139423 - RNA, 18 nt, Artificial Sequence
  Description of Artificial Sequence: Synthetic oligonucleotide
acacaaggaaggcguugg

SEQ ID NO: 139424 - RNA, 18 nt, Artificial Sequence
  Description of Artificial Sequence: Synthetic oligonucleotide
gagcaacacaaggaaggc

SEQ ID NO: 139425 - RNA, 18 nt, Artificial Sequence
  Description of Artificial Sequence: Synthetic oligonucleotide
agguugagcaacacaagg

SEQ ID NO: 139426 - RNA, 18 nt, Artificial Sequence
  Description of Artificial Sequence: Synthetic oligonucleotide
ugaguagguugagcaaca

SEQ ID NO: 139427 - RNA, 18 nt, Artificial Sequence
  Description of Artificial Sequence: Synthetic oligonucleotide
gcucaugaguagguugag

SEQ ID NO: 139428 - RNA, 18 nt, Artificial Sequence
  Description of Artificial Sequence: Synthetic oligonucleotide
ccugggcucaugaguagg

SEQ ID NO: 139429 - RNA, 18 nt, Artificial Sequence
  Description of Artificial Sequence: Synthetic oligonucleotide
uaucuccugggcucauga

SEQ ID NO: 139430 - RNA, 18 nt, Artificial Sequence
  Description of Artificial Sequence: Synthetic oligonucleotide
uuuccuaucuccugggcu

SEQ ID NO: 139431 - RNA, 18 nt, Artificial Sequence
  Description of Artificial Sequence: Synthetic oligonucleotide
ggagauuuccuaucuccu

SEQ ID NO: 139432 - RNA, 18 nt, Artificial Sequence
  Description of Artificial Sequence: Synthetic oligonucleotide
gggacggagauuuccuau

SEQ ID NO: 139433 - RNA, 18 nt, Artificial Sequence
  Description of Artificial Sequence: Synthetic oligonucleotide
acaaugggacggagauuu

SEQ ID NO: 139434 - RNA, 18 nt, Artificial Sequence
  Description of Artificial Sequence: Synthetic oligonucleotide
ucuguacaaugggacgga

SEQ ID NO: 139435 - RNA, 18 nt, Artificial Sequence
  Description of Artificial Sequence: Synthetic oligonucleotide
ccccaucuguacaauggg

SEQ ID NO: 139436 - RNA, 18 nt, Artificial Sequence
  Description of Artificial Sequence: Synthetic oligonucleotide
uguuuccccaucuguaca

SEQ ID NO: 139437 - RNA, 18 nt, Artificial Sequence
  Description of Artificial Sequence: Synthetic oligonucleotide
aauucuguuuccccaucu

SEQ ID NO: 139438 - RNA, 18 nt, Artificial Sequence
  Description of Artificial Sequence: Synthetic oligonucleotide
uccaaaauucuguuuccc

SEQ ID NO: 139439 - RNA, 18 nt, Artificial Sequence
  Description of Artificial Sequence: Synthetic oligonucleotide
uccuuuccaaaauucugu

SEQ ID NO: 139440 - RNA, 18 nt, Artificial Sequence
  Description of Artificial Sequence: Synthetic oligonucleotide
ggcucuccuuuccaaaau

SEQ ID NO: 139441 - RNA, 18 nt, Artificial Sequence
  Description of Artificial Sequence: Synthetic oligonucleotide
ugcuuggcucuccuuucc

SEQ ID NO: 139442 - RNA, 18 nt, Artificial Sequence
  Description of Artificial Sequence: Synthetic oligonucleotide
ugugcugcuuggcucucc

SEQ ID NO: 139443 - RNA, 18 nt, Artificial Sequence
  Description of Artificial Sequence: Synthetic oligonucleotide
gggugugugcugcuuggc

SEQ ID NO: 139444 - RNA, 18 nt, Artificial Sequence
  Description of Artificial Sequence: Synthetic oligonucleotide
cggcucugccccucaggg

SEQ ID NO: 139445 - RNA, 18 nt, Artificial Sequence
  Description of Artificial Sequence: Synthetic oligonucleotide
aaucucggcucugccccu

SEQ ID NO: 139446 - RNA, 18 nt, Artificial Sequence
  Description of Artificial Sequence: Synthetic oligonucleotide
guucaaaucucggcucug

SEQ ID NO: 139447 - RNA, 18 nt, Artificial Sequence
  Description of Artificial Sequence: Synthetic oligonucleotide
ucccaguucaaaucucgg

SEQ ID NO: 139448 - RNA, 18 nt, Artificial Sequence
  Description of Artificial Sequence: Synthetic oligonucleotide
ugacaucccaguucaaau

SEQ ID NO: 139449 - RNA, 18 nt, Artificial Sequence
  Description of Artificial Sequence: Synthetic oligonucleotide
agucaugacaucccaguu

SEQ ID NO: 139450 - RNA, 18 nt, Artificial Sequence
  Description of Artificial Sequence: Synthetic oligonucleotide
ccuggagucaugacaucc

SEQ ID NO: 139451 - RNA, 18 nt, Artificial Sequence
  Description of Artificial Sequence: Synthetic oligonucleotide
agggcccuggagucauga

SEQ ID NO: 139452 - RNA, 18 nt, Artificial Sequence
  Description of Artificial Sequence: Synthetic oligonucleotide
gggagagggcccuggagu

SEQ ID NO: 139453 - RNA, 18 nt, Artificial Sequence
  Description of Artificial Sequence: Synthetic oligonucleotide
gggagggagagggcccug

SEQ ID NO: 139454 - RNA, 18 nt, Artificial Sequence
  Description of Artificial Sequence: Synthetic oligonucleotide
accgccuucagauaaggg

SEQ ID NO: 139455 - RNA, 18 nt, Artificial Sequence
  Description of Artificial Sequence: Synthetic oligonucleotide
gaaaaaccgccuucagau

SEQ ID NO: 139456 - RNA, 18 nt, Artificial Sequence
  Description of Artificial Sequence: Synthetic oligonucleotide
ggaaagaaaaaccgccuu

SEQ ID NO: 139457 - RNA, 18 nt, Artificial Sequence
  Description of Artificial Sequence: Synthetic oligonucleotide
gagcuggaaagaaaaacc

SEQ ID NO: 139458 - RNA, 18 nt, Artificial Sequence
  Description of Artificial Sequence: Synthetic oligonucleotide
aggucgagcuggaaagaa

SEQ ID NO: 139459 - RNA, 18 nt, Artificial Sequence
  Description of Artificial Sequence: Synthetic oligonucleotide
acaagaggucgagcugga

SEQ ID NO: 139460 - RNA, 18 nt, Artificial Sequence
  Description of Artificial Sequence: Synthetic oligonucleotide
gggucacaagaggucgag

SEQ ID NO: 139461 - RNA, 18 nt, Artificial Sequence
  Description of Artificial Sequence: Synthetic oligonucleotide
acuaagggucacaagagg

SEQ ID NO: 139462 - RNA, 18 nt, Artificial Sequence
  Description of Artificial Sequence: Synthetic oligonucleotide
guuaaacuaagggucaca

SEQ ID NO: 139463 - RNA, 18 nt, Artificial Sequence
  Description of Artificial Sequence: Synthetic oligonucleotide
cccuuguuaaacuaaggg

SEQ ID NO: 139464 - RNA, 18 nt, Artificial Sequence
  Description of Artificial Sequence: Synthetic oligonucleotide
uucggcccuuguuaaacu

SEQ ID NO: 139465 - RNA, 18 nt, Artificial Sequence
  Description of Artificial Sequence: Synthetic oligonucleotide
uuaacuucggcccuuguu

SEQ ID NO: 139466 - RNA, 18 nt, Artificial Sequence
  Description of Artificial Sequence: Synthetic oligonucleotide
acucuuuaacuucggccc

SEQ ID NO: 139467 - RNA, 18 nt, Artificial Sequence
  Description of Artificial Sequence: Synthetic oligonucleotide
cagaaacucuuuaacuuc

SEQ ID NO: 139468 - RNA, 18 nt, Artificial Sequence
  Description of Artificial Sequence: Synthetic oligonucleotide
aggcgcagaaacucuuua

SEQ ID NO: 139469 - RNA, 18 nt, Artificial Sequence
  Description of Artificial Sequence: Synthetic oligonucleotide
gguccaggcgcagaaacu

SEQ ID NO: 139470 - RNA, 18 nt, Artificial Sequence
  Description of Artificial Sequence: Synthetic oligonucleotide
ggguccaggcgcagaaac

SEQ ID NO: 139471 - RNA, 18 nt, Artificial Sequence
  Description of Artificial Sequence: Synthetic oligonucleotide
cugauugcuucauuuggg

SEQ ID NO: 139472 - RNA, 18 nt, Artificial Sequence
  Description of Artificial Sequence: Synthetic oligonucleotide
gaaaucugauugcuucau

SEQ ID NO: 139473 - RNA, 18 nt, Artificial Sequence
  Description of Artificial Sequence: Synthetic oligonucleotide
gaugagaaaucugauugc

SEQ ID NO: 139474 - RNA, 18 nt, Artificial Sequence
  Description of Artificial Sequence: Synthetic oligonucleotide
cuggagaugagaaaucug

SEQ ID NO: 139475 - RNA, 18 nt, Artificial Sequence
  Description of Artificial Sequence: Synthetic oligonucleotide
ccugacuggagaugagaa

SEQ ID NO: 139476 - RNA, 18 nt, Artificial Sequence
  Description of Artificial Sequence: Synthetic oligonucleotide
ccacaccugacuggagau

SEQ ID NO: 139477 - RNA, 18 nt, Artificial Sequence
  Description of Artificial Sequence: Synthetic oligonucleotide
uggacccacaccugacug

SEQ ID NO: 139478 - RNA, 18 nt, Artificial Sequence
  Description of Artificial Sequence: Synthetic oligonucleotide
gggcuuggacccacaccu

SEQ ID NO: 139479 - RNA, 18 nt, Artificial Sequence
  Description of Artificial Sequence: Synthetic oligonucleotide
cuagugggcuuggaccca

SEQ ID NO: 139480 - RNA, 18 nt, Artificial Sequence
  Description of Artificial Sequence: Synthetic oligonucleotide
cuugucuagugggcuugg

SEQ ID NO: 139481 - RNA, 18 nt, Artificial Sequence
  Description of Artificial Sequence: Synthetic oligonucleotide
gcaaacuugucuaguggg

SEQ ID NO: 139482 - RNA, 18 nt, Artificial Sequence
  Description of Artificial Sequence: Synthetic oligonucleotide
gaagagcaaacuugucua

SEQ ID NO: 139483 - RNA, 18 nt, Artificial Sequence
  Description of Artificial Sequence: Synthetic oligonucleotide
ucugggaagagcaaacuu

SEQ ID NO: 139484 - RNA, 18 nt, Artificial Sequence
  Description of Artificial Sequence: Synthetic oligonucleotide
ugugcucugggaagagca

SEQ ID NO: 139485 - RNA, 18 nt, Artificial Sequence
  Description of Artificial Sequence: Synthetic oligonucleotide
agaaaugugcucugggaa

SEQ ID NO: 139486 - RNA, 18 nt, Artificial Sequence
  Description of Artificial Sequence: Synthetic oligonucleotide
aaggcagaaaugugcucu

SEQ ID NO: 139487 - RNA, 18 nt, Artificial Sequence
  Description of Artificial Sequence: Synthetic oligonucleotide
acuugaaggcagaaaugu

SEQ ID NO: 139488 - RNA, 18 nt, Artificial Sequence
  Description of Artificial Sequence: Synthetic oligonucleotide
ggaugacuugaaggcaga

SEQ ID NO: 139489 - RNA, 18 nt, Artificial Sequence
  Description of Artificial Sequence: Synthetic oligonucleotide
agccaggaugacuugaag

SEQ ID NO: 139490 - RNA, 18 nt, Artificial Sequence
  Description of Artificial Sequence: Synthetic oligonucleotide
ugacaagccaggaugacu

SEQ ID NO: 139491 - RNA, 18 nt, Artificial Sequence
  Description of Artificial Sequence: Synthetic oligonucleotide
agcccugacaagccagga

SEQ ID NO: 139492 - RNA, 18 nt, Artificial Sequence
  Description of Artificial Sequence: Synthetic oligonucleotide
cccccagcccugacaagc

SEQ ID NO: 139493 - RNA, 18 nt, Artificial Sequence
  Description of Artificial Sequence: Synthetic oligonucleotide
gaacucccccagcccuga

SEQ ID NO: 139494 - RNA, 18 nt, Artificial Sequence
  Description of Artificial Sequence: Synthetic oligonucleotide
cagcagaacucccccagc

SEQ ID NO: 139495 - RNA, 18 nt, Artificial Sequence
  Description of Artificial Sequence: Synthetic oligonucleotide
aucacaaggccuuggaag

SEQ ID NO: 139496 - RNA, 18 nt, Artificial Sequence
  Description of Artificial Sequence: Synthetic oligonucleotide
cuuccaucacaaggccuu

SEQ ID NO: 139497 - RNA, 18 nt, Artificial Sequence
  Description of Artificial Sequence: Synthetic oligonucleotide
acucacuuccaucacaag

SEQ ID NO: 139498 - RNA, 18 nt, Artificial Sequence
  Description of Artificial Sequence: Synthetic oligonucleotide
aggguacucacuuccauc

SEQ ID NO: 139499 - RNA, 18 nt, Artificial Sequence
  Description of Artificial Sequence: Synthetic oligonucleotide
cgaagaggguacucacuu

SEQ ID NO: 139500 - RNA, 18 nt, Artificial Sequence
  Description of Artificial Sequence: Synthetic oligonucleotide
gaugucgaagaggguacu

SEQ ID NO: 139501 - RNA, 18 nt, Artificial Sequence
  Description of Artificial Sequence: Synthetic oligonucleotide
ggucugaugucgaagagg

SEQ ID NO: 139502 - RNA, 18 nt, Artificial Sequence
  Description of Artificial Sequence: Synthetic oligonucleotide
agcugggucugaugucga

SEQ ID NO: 139503 - RNA, 18 nt, Artificial Sequence
  Description of Artificial Sequence: Synthetic oligonucleotide
uuugaagcugggucugau

SEQ ID NO: 139504 - RNA, 18 nt, Artificial Sequence
  Description of Artificial Sequence: Synthetic oligonucleotide
caggauuugaagcugggu

SEQ ID NO: 139505 - RNA, 18 nt, Artificial Sequence
  Description of Artificial Sequence: Synthetic oligonucleotide
agagccaggauuugaagc

SEQ ID NO: 139506 - RNA, 18 nt, Artificial Sequence
  Description of Artificial Sequence: Synthetic oligonucleotide
auagcagagccaggauuu

SEQ ID NO: 139507 - RNA, 18 nt, Artificial Sequence
  Description of Artificial Sequence: Synthetic oligonucleotide
aauacauagcagagccag

SEQ ID NO: 139508 - RNA, 18 nt, Artificial Sequence
  Description of Artificial Sequence: Synthetic oligonucleotide
cagccaauacauagcaga

SEQ ID NO: 139509 - RNA, 18 nt, Artificial Sequence
  Description of Artificial Sequence: Synthetic oligonucleotide
ccacgcagccaauacaua

SEQ ID NO: 139510 - RNA, 18 nt, Artificial Sequence
  Description of Artificial Sequence: Synthetic oligonucleotide
uaaagccacgcagccaau

SEQ ID NO: 139511 - RNA, 18 nt, Artificial Sequence
  Description of Artificial Sequence: Synthetic oligonucleotide
uugucuaaagccacgcag

SEQ ID NO: 139512 - RNA, 18 nt, Artificial Sequence
  Description of Artificial Sequence: Synthetic oligonucleotide
aagacuugucuaaagcca

SEQ ID NO: 139513 - RNA, 18 nt, Artificial Sequence
  Description of Artificial Sequence: Synthetic oligonucleotide
guuaaaagacuugucuaa

SEQ ID NO: 139514 - RNA, 18 nt, Artificial Sequence
  Description of Artificial Sequence: Synthetic oligonucleotide
gcaagguuaaaagacuug

SEQ ID NO: 139515 - RNA, 18 nt, Artificial Sequence
  Description of Artificial Sequence: Synthetic oligonucleotide
gcacagcaagguuaaaag

SEQ ID NO: 139516 - RNA, 18 nt, Artificial Sequence
  Description of Artificial Sequence: Synthetic oligonucleotide
cagaagcacagcaagguu

SEQ ID NO: 139517 - RNA, 18 nt, Artificial Sequence
  Description of Artificial Sequence: Synthetic oligonucleotide
gaaaucagaagcacagca

SEQ ID NO: 139518 - RNA, 18 nt, Artificial Sequence
  Description of Artificial Sequence: Synthetic oligonucleotide
gcugagaaaucagaagca

SEQ ID NO: 139519 - RNA, 18 nt, Artificial Sequence
  Description of Artificial Sequence: Synthetic oligonucleotide
uuucagcugagaaaucag

SEQ ID NO: 139520 - RNA, 18 nt, Artificial Sequence
  Description of Artificial Sequence: Synthetic oligonucleotide
ccauuuuucagcugagaa

SEQ ID NO: 139521 - RNA, 18 nt, Artificial Sequence
  Description of Artificial Sequence: Synthetic oligonucleotide
caucuccauuuuucagcu

SEQ ID NO: 139522 - RNA, 18 nt, Artificial Sequence
  Description of Artificial Sequence: Synthetic oligonucleotide
aucaucaucuccauuuuu

SEQ ID NO: 139523 - RNA, 18 nt, Artificial Sequence
  Description of Artificial Sequence: Synthetic oligonucleotide
ccacuaucaucaucucca

SEQ ID NO: 139524 - RNA, 18 nt, Artificial Sequence
  Description of Artificial Sequence: Synthetic oligonucleotide
agaaaccacuaucaucau

SEQ ID NO: 139525 - RNA, 18 nt, Artificial Sequence
  Description of Artificial Sequence: Synthetic oligonucleotide
cuuacagaaaccacuauc

SEQ ID NO: 139526 - RNA, 18 nt, Artificial Sequence
  Description of Artificial Sequence: Synthetic oligonucleotide
aaggccuuacagaaacca

SEQ ID NO: 139527 - RNA, 18 nt, Artificial Sequence
  Description of Artificial Sequence: Synthetic oligonucleotide
accauaaggccuuacaga

SEQ ID NO: 139528 - RNA, 18 nt, Artificial Sequence
  Description of Artificial Sequence: Synthetic oligonucleotide
gcuucaccauaaggccuu

SEQ ID NO: 139529 - RNA, 18 nt, Artificial Sequence
  Description of Artificial Sequence: Synthetic oligonucleotide
uaggugcuucaccauaag

SEQ ID NO: 139530 - RNA, 18 nt, Artificial Sequence
  Description of Artificial Sequence: Synthetic oligonucleotide
ugagcuaggugcuucacc

SEQ ID NO: 139531 - RNA, 18 nt, Artificial Sequence
  Description of Artificial Sequence: Synthetic oligonucleotide
ggcccugagcuaggugcu

SEQ ID NO: 139532 - RNA, 18 nt, Artificial Sequence
  Description of Artificial Sequence: Synthetic oligonucleotide
uuccaggcccugagcuag

SEQ ID NO: 139533 - RNA, 18 nt, Artificial Sequence
  Description of Artificial Sequence: Synthetic oligonucleotide
cugccuuccaggcccuga

SEQ ID NO: 139534 - RNA, 18 nt, Artificial Sequence
  Description of Artificial Sequence: Synthetic oligonucleotide
uacaccugccuuccaggc

SEQ ID NO: 139535 - RNA, 18 nt, Artificial Sequence
  Description of Artificial Sequence: Synthetic oligonucleotide
cugguuacaccugccuuc

SEQ ID NO: 139536 - RNA, 18 nt, Artificial Sequence
  Description of Artificial Sequence: Synthetic oligonucleotide
aaccacugguuacaccug

SEQ ID NO: 139537 - RNA, 18 nt, Artificial Sequence
  Description of Artificial Sequence: Synthetic oligonucleotide
aacugaaccacugguuac

SEQ ID NO: 139538 - RNA, 18 nt, Artificial Sequence
  Description of Artificial Sequence: Synthetic oligonucleotide
auaacaacugaaccacug

SEQ ID NO: 139539 - RNA, 18 nt, Artificial Sequence
  Description of Artificial Sequence: Synthetic oligonucleotide
gguuuauaacaacugaac

SEQ ID NO: 139540 - RNA, 18 nt, Artificial Sequence
  Description of Artificial Sequence: Synthetic oligonucleotide
guguugguuuauaacaac

SEQ ID NO: 139541 - RNA, 18 nt, Artificial Sequence
  Description of Artificial Sequence: Synthetic oligonucleotide
gguuaguguugguuuaua

SEQ ID NO: 139542 - RNA, 18 nt, Artificial Sequence
  Description of Artificial Sequence: Synthetic oligonucleotide
gcgaggguuaguguuggu

SEQ ID NO: 139543 - RNA, 18 nt, Artificial Sequence
  Description of Artificial Sequence: Synthetic oligonucleotide
caaaggcgaggguuagug

SEQ ID NO: 139544 - RNA, 18 nt, Artificial Sequence
  Description of Artificial Sequence: Synthetic oligonucleotide
aggugcaaaggcgagggu

SEQ ID NO: 139545 - RNA, 18 nt, Artificial Sequence
  Description of Artificial Sequence: Synthetic oligonucleotide
ucaugaggugcaaaggcg

SEQ ID NO: 139546 - RNA, 18 nt, Artificial Sequence
  Description of Artificial Sequence: Synthetic oligonucleotide
ugguuucaugaggugcaa

SEQ ID NO: 139547 - RNA, 18 nt, Artificial Sequence
  Description of Artificial Sequence: Synthetic oligonucleotide
auaucugguuucaugagg

SEQ ID NO: 139548 - RNA, 18 nt, Artificial Sequence
  Description of Artificial Sequence: Synthetic oligonucleotide
ucuacauaucugguuuca

SEQ ID NO: 139549 - RNA, 18 nt, Artificial Sequence
  Description of Artificial Sequence: Synthetic oligonucleotide
cuccaucuacauaucugg

SEQ ID NO: 139550 - RNA, 18 nt, Artificial Sequence
  Description of Artificial Sequence: Synthetic oligonucleotide
gugggcuccaucuacaua

SEQ ID NO: 139551 - RNA, 18 nt, Artificial Sequence
  Description of Artificial Sequence: Synthetic oligonucleotide
gcuuugugggcuccaucu

SEQ ID NO: 139552 - RNA, 18 nt, Artificial Sequence
  Description of Artificial Sequence: Synthetic oligonucleotide
ugcuagcuuugugggcuc

SEQ ID NO: 139553 - RNA, 18 nt, Artificial Sequence
  Description of Artificial Sequence: Synthetic oligonucleotide
gcuccugcuagcuuugug

SEQ ID NO: 139554 - RNA, 18 nt, Artificial Sequence
  Description of Artificial Sequence: Synthetic oligonucleotide
gcuuggcuccugcuagcu

SEQ ID NO: 139555 - RNA, 18 nt, Artificial Sequence
  Description of Artificial Sequence: Synthetic oligonucleotide
cgugagcuuggcuccugc

SEQ ID NO: 139556 - RNA, 18 nt, Artificial Sequence
  Description of Artificial Sequence: Synthetic oligonucleotide
acacacgugagcuuggcu

SEQ ID NO: 139557 - RNA, 18 nt, Artificial Sequence
  Description of Artificial Sequence: Synthetic oligonucleotide
gcaggacacacgugagcu

SEQ ID NO: 139558 - RNA, 18 nt, Artificial Sequence
  Description of Artificial Sequence: Synthetic oligonucleotide
uuaaagcaggacacacgu

SEQ ID NO: 139559 - RNA, 18 nt, Artificial Sequence
  Description of Artificial Sequence: Synthetic oligonucleotide
gggcuuuaaagcaggaca

SEQ ID NO: 139560 - RNA, 18 nt, Artificial Sequence
  Description of Artificial Sequence: Synthetic oligonucleotide
ugucacccggagaaaggg

SEQ ID NO: 139561 - RNA, 18 nt, Artificial Sequence
  Description of Artificial Sequence: Synthetic oligonucleotide
uguuugucacccggagaa

SEQ ID NO: 139562 - RNA, 18 nt, Artificial Sequence
  Description of Artificial Sequence: Synthetic oligonucleotide
acagguguuugucacccg

SEQ ID NO: 139563 - RNA, 18 nt, Artificial Sequence
  Description of Artificial Sequence: Synthetic oligonucleotide
cgagcacagguguuuguc

SEQ ID NO: 139564 - RNA, 18 nt, Artificial Sequence
  Description of Artificial Sequence: Synthetic oligonucleotide
gagaacgagcacaggugu

SEQ ID NO: 139565 - RNA, 18 nt, Artificial Sequence
  Description of Artificial Sequence: Synthetic oligonucleotide
gggaagagaacgagcaca

SEQ ID NO: 139566 - RNA, 18 nt, Artificial Sequence
  Description of Artificial Sequence: Synthetic oligonucleotide
gggaagggaagagaacga

SEQ ID NO: 139567 - RNA, 18 nt, Artificial Sequence
  Description of Artificial Sequence: Synthetic oligonucleotide
auuagccaaaugcaaggg

SEQ ID NO: 139568 - RNA, 18 nt, Artificial Sequence
  Description of Artificial Sequence: Synthetic oligonucleotide
uauuagccaaaugcaagg

SEQ ID NO: 139569 - RNA, 18 nt, Artificial Sequence
  Description of Artificial Sequence: Synthetic oligonucleotide
ccuguuauuagccaaaug

SEQ ID NO: 139570 - RNA, 18 nt, Artificial Sequence
  Description of Artificial Sequence: Synthetic oligonucleotide
gcuggccuguuauuagcc

SEQ ID NO: 139571 - RNA, 18 nt, Artificial Sequence
  Description of Artificial Sequence: Synthetic oligonucleotide
aggcagcuggccuguuau

SEQ ID NO: 139572 - RNA, 18 nt, Artificial Sequence
  Description of Artificial Sequence: Synthetic oligonucleotide
gaggcaggcagcuggccu

SEQ ID NO: 139573 - RNA, 18 nt, Artificial Sequence
  Description of Artificial Sequence: Synthetic oligonucleotide
gcagggaggcaggcagcu

SEQ ID NO: 139574 - RNA, 18 nt, Artificial Sequence
  Description of Artificial Sequence: Synthetic oligonucleotide
aaacugcagggaggcagg

SEQ ID NO: 139575 - RNA, 18 nt, Artificial Sequence
  Description of Artificial Sequence: Synthetic oligonucleotide
cuaccaaacugcagggag

SEQ ID NO: 139576 - RNA, 18 nt, Artificial Sequence
  Description of Artificial Sequence: Synthetic oligonucleotide
cccaucuaccaaacugca

SEQ ID NO: 139577 - RNA, 18 nt, Artificial Sequence
  Description of Artificial Sequence: Synthetic oligonucleotide
acccacccaucuaccaaa

SEQ ID NO: 139578 - RNA, 18 nt, Artificial Sequence
  Description of Artificial Sequence: Synthetic oligonucleotide
ucguuacccacccaucua

SEQ ID NO: 139579 - RNA, 18 nt, Artificial Sequence
  Description of Artificial Sequence: Synthetic oligonucleotide
gguggucguuacccaccc

SEQ ID NO: 139580 - RNA, 18 nt, Artificial Sequence
  Description of Artificial Sequence: Synthetic oligonucleotide
ggagugguggucguuacc

SEQ ID NO: 139581 - RNA, 18 nt, Artificial Sequence
  Description of Artificial Sequence: Synthetic oligonucleotide
acgugggagugguggucg

SEQ ID NO: 139582 - RNA, 18 nt, Artificial Sequence
  Description of Artificial Sequence: Synthetic oligonucleotide
ggcgaacgugggaguggu

SEQ ID NO: 139583 - RNA, 18 nt, Artificial Sequence
  Description of Artificial Sequence: Synthetic oligonucleotide
caucaggcgaacguggga

SEQ ID NO: 139584 - RNA, 18 nt, Artificial Sequence
  Description of Artificial Sequence: Synthetic oligonucleotide
aagcccaucaggcgaacg

SEQ ID NO: 139585 - RNA, 18 nt, Artificial Sequence
  Description of Artificial Sequence: Synthetic oligonucleotide
aaaacaagcccaucaggc

SEQ ID NO: 139586 - RNA, 18 nt, Artificial Sequence
  Description of Artificial Sequence: Synthetic oligonucleotide
gacuucaggccuggcugg

SEQ ID NO: 139587 - RNA, 18 nt, Artificial Sequence
  Description of Artificial Sequence: Synthetic oligonucleotide
aggaugacuucaggccug

SEQ ID NO: 139588 - RNA, 18 nt, Artificial Sequence
  Description of Artificial Sequence: Synthetic oligonucleotide
uucugaggaugacuucag

SEQ ID NO: 139589 - RNA, 18 nt, Artificial Sequence
  Description of Artificial Sequence: Synthetic oligonucleotide
aucccuucugaggaugac

SEQ ID NO: 139590 - RNA, 18 nt, Artificial Sequence
  Description of Artificial Sequence: Synthetic oligonucleotide
gauccaucccuucugagg

SEQ ID NO: 139591 - RNA, 18 nt, Artificial Sequence
  Description of Artificial Sequence: Synthetic oligonucleotide
cucaggauccaucccuuc

SEQ ID NO: 139592 - RNA, 18 nt, Artificial Sequence
  Description of Artificial Sequence: Synthetic oligonucleotide
gcgaccucaggauccauc

SEQ ID NO: 139593 - RNA, 18 nt, Artificial Sequence
  Description of Artificial Sequence: Synthetic oligonucleotide
gcauggcgaccucaggau

SEQ ID NO: 139594 - RNA, 18 nt, Artificial Sequence
  Description of Artificial Sequence: Synthetic oligonucleotide
gcugggcauggcgaccuc

SEQ ID NO: 139595 - RNA, 18 nt, Artificial Sequence
  Description of Artificial Sequence: Synthetic oligonucleotide
gcccagcugggcauggcg

SEQ ID NO: 139596 - RNA, 18 nt, Artificial Sequence
  Description of Artificial Sequence: Synthetic oligonucleotide
uguuugcccagcugggca

SEQ ID NO: 139597 - RNA, 18 nt, Artificial Sequence
  Description of Artificial Sequence: Synthetic oligonucleotide
acucauguuugcccagcu

SEQ ID NO: 139598 - RNA, 18 nt, Artificial Sequence
  Description of Artificial Sequence: Synthetic oligonucleotide
uccagacucauguuugcc

SEQ ID NO: 139599 - RNA, 18 nt, Artificial Sequence
  Description of Artificial Sequence: Synthetic oligonucleotide
aagaauccagacucaugu

SEQ ID NO: 139600 - RNA, 18 nt, Artificial Sequence
  Description of Artificial Sequence: Synthetic oligonucleotide
gggaagaauccagacuca

SEQ ID NO: 139601 - RNA, 18 nt, Artificial Sequence
  Description of Artificial Sequence: Synthetic oligonucleotide
aaggcagccgacuccggg

SEQ ID NO: 139602 - RNA, 18 nt, Artificial Sequence
  Description of Artificial Sequence: Synthetic oligonucleotide
cagccaaggcagccgacu

SEQ ID NO: 139603 - RNA, 18 nt, Artificial Sequence
  Description of Artificial Sequence: Synthetic oligonucleotide
ccucacagccaaggcagc

SEQ ID NO: 139604 - RNA, 18 nt, Artificial Sequence
  Description of Artificial Sequence: Synthetic oligonucleotide
uccagccucacagccaag

SEQ ID NO: 139605 - RNA, 18 nt, Artificial Sequence
  Description of Artificial Sequence: Synthetic oligonucleotide
cucccuccagccucacag

SEQ ID NO: 139606 - RNA, 18 nt, Artificial Sequence
  Description of Artificial Sequence: Synthetic oligonucleotide
cucaucucccuccagccu

SEQ ID NO: 139607 - RNA, 18 nt, Artificial Sequence
  Description of Artificial Sequence: Synthetic oligonucleotide
agcagcucaucucccucc

SEQ ID NO: 139608 - RNA, 18 nt, Artificial Sequence
  Description of Artificial Sequence: Synthetic oligonucleotide
ggucuagcagcucaucuc

SEQ ID NO: 139609 - RNA, 18 nt, Artificial Sequence
  Description of Artificial Sequence: Synthetic oligonucleotide
cagguggucuagcagcuc

SEQ ID NO: 139610 - RNA, 18 nt, Artificial Sequence
  Description of Artificial Sequence: Synthetic oligonucleotide
agacgcagguggucuagc

SEQ ID NO: 139611 - RNA, 18 nt, Artificial Sequence
  Description of Artificial Sequence: Synthetic oligonucleotide
ugcugagacgcagguggu

SEQ ID NO: 139612 - RNA, 18 nt, Artificial Sequence
  Description of Artificial Sequence: Synthetic oligonucleotide
caggaugcugagacgcag

SEQ ID NO: 139613 - RNA, 18 nt, Artificial Sequence
  Description of Artificial Sequence: Synthetic oligonucleotide
cagggcaggaugcugaga

SEQ ID NO: 139614 - RNA, 18 nt, Artificial Sequence
  Description of Artificial Sequence: Synthetic oligonucleotide
caucccagggcaggaugc

SEQ ID NO: 139615 - RNA, 18 nt, Artificial Sequence
  Description of Artificial Sequence: Synthetic oligonucleotide
gcucucaucccagggcag

SEQ ID NO: 139616 - RNA, 18 nt, Artificial Sequence
  Description of Artificial Sequence: Synthetic oligonucleotide
aggaugcucucaucccag

SEQ ID NO: 139617 - RNA, 18 nt, Artificial Sequence
  Description of Artificial Sequence: Synthetic oligonucleotide
uguccaggaugcucucau

SEQ ID NO: 139618 - RNA, 18 nt, Artificial Sequence
  Description of Artificial Sequence: Synthetic oligonucleotide
gaggguguccaggaugcu

SEQ ID NO: 139619 - RNA, 18 nt, Artificial Sequence
  Description of Artificial Sequence: Synthetic oligonucleotide
ggcgagaggguguccagg

SEQ ID NO: 139620 - RNA, 18 nt, Artificial Sequence
  Description of Artificial Sequence: Synthetic oligonucleotide
gccugggcgagagggugu

SEQ ID NO: 139621 - RNA, 18 nt, Artificial Sequence
  Description of Artificial Sequence: Synthetic oligonucleotide
agcgagccugggcgagag

SEQ ID NO: 139622 - RNA, 18 nt, Artificial Sequence
  Description of Artificial Sequence: Synthetic oligonucleotide
uuucauuucuucacucag

SEQ ID NO: 139623 - RNA, 18 nt, Artificial Sequence
  Description of Artificial Sequence: Synthetic oligonucleotide
uugucuuucauuucuuca

SEQ ID NO: 139624 - RNA, 18 nt, Artificial Sequence
  Description of Artificial Sequence: Synthetic oligonucleotide
caccuuugucuuucauuu

SEQ ID NO: 139625 - RNA, 18 nt, Artificial Sequence
  Description of Artificial Sequence: Synthetic oligonucleotide
guauccaccuuugucuuu

SEQ ID NO: 139626 - RNA, 18 nt, Artificial Sequence
  Description of Artificial Sequence: Synthetic oligonucleotide
cucauguauccaccuuug

SEQ ID NO: 139627 - RNA, 18 nt, Artificial Sequence
  Description of Artificial Sequence: Synthetic oligonucleotide
ucuugcucauguauccac

SEQ ID NO: 139628 - RNA, 18 nt, Artificial Sequence
  Description of Artificial Sequence: Synthetic oligonucleotide
gcaaaucuugcucaugua

SEQ ID NO: 139629 - RNA, 18 nt, Artificial Sequence
  Description of Artificial Sequence: Synthetic oligonucleotide
aaguugcaaaucuugcuc

SEQ ID NO: 139630 - RNA, 18 nt, Artificial Sequence
  Description of Artificial Sequence: Synthetic oligonucleotide
guagcaaguugcaaaucu

SEQ ID NO: 139631 - RNA, 18 nt, Artificial Sequence
  Description of Artificial Sequence: Synthetic oligonucleotide
aauggguagcaaguugca

SEQ ID NO: 139632 - RNA, 18 nt, Artificial Sequence
  Description of Artificial Sequence: Synthetic oligonucleotide
auccuaauggguagcaag

SEQ ID NO: 139633 - RNA, 18 nt, Artificial Sequence
  Description of Artificial Sequence: Synthetic oligonucleotide
acauuauccuaaugggua

SEQ ID NO: 139634 - RNA, 18 nt, Artificial Sequence
  Description of Artificial Sequence: Synthetic oligonucleotide
auaagacauuauccuaau

SEQ ID NO: 139635 - RNA, 18 nt, Artificial Sequence
  Description of Artificial Sequence: Synthetic oligonucleotide
auuacauaagacauuauc

SEQ ID NO: 139636 - RNA, 18 nt, Artificial Sequence
  Description of Artificial Sequence: Synthetic oligonucleotide
gcagcauuacauaagaca

SEQ ID NO: 139637 - RNA, 18 nt, Artificial Sequence
  Description of Artificial Sequence: Synthetic oligonucleotide
acagggcagcauuacaua

SEQ ID NO: 139638 - RNA, 18 nt, Artificial Sequence
  Description of Artificial Sequence: Synthetic oligonucleotide
aggguacagggcagcauu

SEQ ID NO: 139639 - RNA, 18 nt, Artificial Sequence
  Description of Artificial Sequence: Synthetic oligonucleotide
caggcaggguacagggca

SEQ ID NO: 139640 - RNA, 18 nt, Artificial Sequence
  Description of Artificial Sequence: Synthetic oligonucleotide
uuccacaggcaggguaca

SEQ ID NO: 139641 - RNA, 18 nt, Artificial Sequence
  Description of Artificial Sequence: Synthetic oligonucleotide
gcagauuccacaggcagg

SEQ ID NO: 139642 - RNA, 18 nt, Artificial Sequence
  Description of Artificial Sequence: Synthetic oligonucleotide
caauggcagauuccacag

SEQ ID NO: 139643 - RNA, 18 nt, Artificial Sequence
  Description of Artificial Sequence: Synthetic oligonucleotide
aaucgcaauggcagauuc

SEQ ID NO: 139644 - RNA, 18 nt, Artificial Sequence
  Description of Artificial Sequence: Synthetic oligonucleotide
uggacaaucgcaauggca

SEQ ID NO: 139645 - RNA, 18 nt, Artificial Sequence
  Description of Artificial Sequence: Synthetic oligonucleotide
acggagccaccuaaaaug

SEQ ID NO: 139646 - RNA, 18 nt, Artificial Sequence
  Description of Artificial Sequence: Synthetic oligonucleotide
aagacacggagccaccua

SEQ ID NO: 139647 - RNA, 18 nt, Artificial Sequence
  Description of Artificial Sequence: Synthetic oligonucleotide
ugaggaagacacggagcc

SEQ ID NO: 139648 - RNA, 18 nt, Artificial Sequence
  Description of Artificial Sequence: Synthetic oligonucleotide
cccugugaggaagacacg

SEQ ID NO: 139649 - RNA, 18 nt, Artificial Sequence
  Description of Artificial Sequence: Synthetic oligonucleotide
aucaacccugugaggaag

SEQ ID NO: 139650 - RNA, 18 nt, Artificial Sequence
  Description of Artificial Sequence: Synthetic oligonucleotide
cucauaucaacccuguga

SEQ ID NO: 139651 - RNA, 18 nt, Artificial Sequence
  Description of Artificial Sequence: Synthetic oligonucleotide
ucauccucauaucaaccc

SEQ ID NO: 139652 - RNA, 18 nt, Artificial Sequence
  Description of Artificial Sequence: Synthetic oligonucleotide
uuguuucauccucauauc

SEQ ID NO: 139653 - RNA, 18 nt, Artificial Sequence
  Description of Artificial Sequence: Synthetic oligonucleotide
ucaucuuguuucauccuc

SEQ ID NO: 139654 - RNA, 18 nt, Artificial Sequence
  Description of Artificial Sequence: Synthetic oligonucleotide
aucuaucaucuuguuuca

SEQ ID NO: 139655 - RNA, 18 nt, Artificial Sequence
  Description of Artificial Sequence: Synthetic oligonucleotide
ccaugaucuaucaucuug

SEQ ID NO: 139656 - RNA, 18 nt, Artificial Sequence
  Description of Artificial Sequence: Synthetic oligonucleotide
ugccaccaugaucuauca

SEQ ID NO: 139657 - RNA, 18 nt, Artificial Sequence
  Description of Artificial Sequence: Synthetic oligonucleotide
cuacaugccaccaugauc

SEQ ID NO: 139658 - RNA, 18 nt, Artificial Sequence
  Description of Artificial Sequence: Synthetic oligonucleotide
ccagacuacaugccacca

SEQ ID NO: 139659 - RNA, 18 nt, Artificial Sequence
  Description of Artificial Sequence: Synthetic oligonucleotide
aggucccagacuacaugc

SEQ ID NO: 139660 - RNA, 18 nt, Artificial Sequence
  Description of Artificial Sequence: Synthetic oligonucleotide
aauccaggucccagacua

SEQ ID NO: 139661 - RNA, 18 nt, Artificial Sequence
  Description of Artificial Sequence: Synthetic oligonucleotide
acgacaauccagguccca

SEQ ID NO: 139662 - RNA, 18 nt, Artificial Sequence
  Description of Artificial Sequence: Synthetic oligonucleotide
guggcacgacaauccagg

SEQ ID NO: 139663 - RNA, 18 nt, Artificial Sequence
  Description of Artificial Sequence: Synthetic oligonucleotide
gaucuguggcacgacaau

SEQ ID NO: 139664 - RNA, 18 nt, Artificial Sequence
  Description of Artificial Sequence: Synthetic oligonucleotide
gcugugaucuguggcacg

SEQ ID NO: 139665 - RNA, 18 nt, Artificial Sequence
  Description of Artificial Sequence: Synthetic oligonucleotide
ugugagcugugaucugug

SEQ ID NO: 139666 - RNA, 18 nt, Artificial Sequence
  Description of Artificial Sequence: Synthetic oligonucleotide
uagacugugagcugugau

SEQ ID NO: 139667 - RNA, 18 nt, Artificial Sequence
  Description of Artificial Sequence: Synthetic oligonucleotide
gcacauagacugugagcu

SEQ ID NO: 139668 - RNA, 18 nt, Artificial Sequence
  Description of Artificial Sequence: Synthetic oligonucleotide
gcauugcacauagacugu

SEQ ID NO: 139669 - RNA, 18 nt, Artificial Sequence
  Description of Artificial Sequence: Synthetic oligonucleotide
gggcauugcacauagacu

SEQ ID NO: 139670 - RNA, 18 nt, Artificial Sequence
  Description of Artificial Sequence: Synthetic oligonucleotide
ggugggcaacauucaggg

SEQ ID NO: 139671 - RNA, 18 nt, Artificial Sequence
  Description of Artificial Sequence: Synthetic oligonucleotide
ggacaggugggcaacauu

SEQ ID NO: 139672 - RNA, 18 nt, Artificial Sequence
  Description of Artificial Sequence: Synthetic oligonucleotide
cuugaggacaggugggca

SEQ ID NO: 139673 - RNA, 18 nt, Artificial Sequence
  Description of Artificial Sequence: Synthetic oligonucleotide
uguggcuugaggacaggu

SEQ ID NO: 139674 - RNA, 18 nt, Artificial Sequence
  Description of Artificial Sequence: Synthetic oligonucleotide
gcauguguggcuugagga

SEQ ID NO: 139675 - RNA, 18 nt, Artificial Sequence
  Description of Artificial Sequence: Synthetic oligonucleotide
caggugcauguguggcuu

SEQ ID NO: 139676 - RNA, 18 nt, Artificial Sequence
  Description of Artificial Sequence: Synthetic oligonucleotide
aguuacaggugcaugugu

SEQ ID NO: 139677 - RNA, 18 nt, Artificial Sequence
  Description of Artificial Sequence: Synthetic oligonucleotide
cacugaguuacaggugca

SEQ ID NO: 139678 - RNA, 18 nt, Artificial Sequence
  Description of Artificial Sequence: Synthetic oligonucleotide
gcuugcacugaguuacag

SEQ ID NO: 139679 - RNA, 18 nt, Artificial Sequence
  Description of Artificial Sequence: Synthetic oligonucleotide
ucugggcuugcacugagu

SEQ ID NO: 139680 - RNA, 18 nt, Artificial Sequence
  Description of Artificial Sequence: Synthetic oligonucleotide
gaguuucugggcuugcac

SEQ ID NO: 139681 - RNA, 18 nt, Artificial Sequence
  Description of Artificial Sequence: Synthetic oligonucleotide
gggaguuucugggcuugc

SEQ ID NO: 139682 - RNA, 18 nt, Artificial Sequence
  Description of Artificial Sequence: Synthetic oligonucleotide
ucuaggaguccccacggg

SEQ ID NO: 139683 - RNA, 18 nt, Artificial Sequence
  Description of Artificial Sequence: Synthetic oligonucleotide
acagcucuaggagucccc

SEQ ID NO: 139684 - RNA, 18 nt, Artificial Sequence
  Description of Artificial Sequence: Synthetic oligonucleotide
cacugacagcucuaggag

SEQ ID NO: 139685 - RNA, 18 nt, Artificial Sequence
  Description of Artificial Sequence: Synthetic oligonucleotide
gaggccacugacagcucu

SEQ ID NO: 139686 - RNA, 18 nt, Artificial Sequence
  Description of Artificial Sequence: Synthetic oligonucleotide
uaugugaggccacugaca

SEQ ID NO: 139687 - RNA, 18 nt, Artificial Sequence
  Description of Artificial Sequence: Synthetic oligonucleotide
gcugcuaugugaggccac

SEQ ID NO: 139688 - RNA, 18 nt, Artificial Sequence
  Description of Artificial Sequence: Synthetic oligonucleotide
gaccagcugcuaugugag

SEQ ID NO: 139689 - RNA, 18 nt, Artificial Sequence
  Description of Artificial Sequence: Synthetic oligonucleotide
gacuggaccagcugcuau

SEQ ID NO: 139690 - RNA, 18 nt, Artificial Sequence
  Description of Artificial Sequence: Synthetic oligonucleotide
caagagacuggaccagcu

SEQ ID NO: 139691 - RNA, 18 nt, Artificial Sequence
  Description of Artificial Sequence: Synthetic oligonucleotide
aaucacaagagacuggac

SEQ ID NO: 139692 - RNA, 18 nt, Artificial Sequence
  Description of Artificial Sequence: Synthetic oligonucleotide
ugggcaaucacaagagac

SEQ ID NO: 139693 - RNA, 18 nt, Artificial Sequence
  Description of Artificial Sequence: Synthetic oligonucleotide
uuccuugggcaaucacaa

SEQ ID NO: 139694 - RNA, 18 nt, Artificial Sequence
  Description of Artificial Sequence: Synthetic oligonucleotide
ucaguuuccuugggcaau

SEQ ID NO: 139695 - RNA, 18 nt, Artificial Sequence
  Description of Artificial Sequence: Synthetic oligonucleotide
aggccucaguuuccuugg

SEQ ID NO: 139696 - RNA, 18 nt, Artificial Sequence
  Description of Artificial Sequence: Synthetic oligonucleotide
ucuccaggccucaguuuc

SEQ ID NO: 139697 - RNA, 18 nt, Artificial Sequence
  Description of Artificial Sequence: Synthetic oligonucleotide
caagcucuccaggccuca

SEQ ID NO: 139698 - RNA, 18 nt, Artificial Sequence
  Description of Artificial Sequence: Synthetic oligonucleotide
gaccccaagcucuccagg

SEQ ID NO: 139699 - RNA, 18 nt, Artificial Sequence
  Description of Artificial Sequence: Synthetic oligonucleotide
gcagugaccccaagcucu

SEQ ID NO: 139700 - RNA, 18 nt, Artificial Sequence
  Description of Artificial Sequence: Synthetic oligonucleotide
ucagagcagugaccccaa

SEQ ID NO: 139701 - RNA, 18 nt, Artificial Sequence
  Description of Artificial Sequence: Synthetic oligonucleotide
uggccucagagcagugac

SEQ ID NO: 139702 - RNA, 18 nt, Artificial Sequence
  Description of Artificial Sequence: Synthetic oligonucleotide
cucuauggccucagagca

SEQ ID NO: 139703 - RNA, 18 nt, Artificial Sequence
  Description of Artificial Sequence: Synthetic oligonucleotide
ggcaucucuauggccuca

SEQ ID NO: 139704 - RNA, 18 nt, Artificial Sequence
  Description of Artificial Sequence: Synthetic oligonucleotide
uacuaggcaucucuaugg

SEQ ID NO: 139705 - RNA, 18 nt, Artificial Sequence
  Description of Artificial Sequence: Synthetic oligonucleotide
ccuucuacuaggcaucuc

SEQ ID NO: 139706 - RNA, 18 nt, Artificial Sequence
  Description of Artificial Sequence: Synthetic oligonucleotide
cuggcccuucuacuaggc

SEQ ID NO: 139707 - RNA, 18 nt, Artificial Sequence
  Description of Artificial Sequence: Synthetic oligonucleotide
uaggccuggcccuucuac

SEQ ID NO: 139708 - RNA, 18 nt, Artificial Sequence
  Description of Artificial Sequence: Synthetic oligonucleotide
gcuucuaggccuggcccu

SEQ ID NO: 139709 - RNA, 18 nt, Artificial Sequence
  Description of Artificial Sequence: Synthetic oligonucleotide
auccugcuucuaggccug

SEQ ID NO: 139710 - RNA, 18 nt, Artificial Sequence
  Description of Artificial Sequence: Synthetic oligonucleotide
caaggauccugcuucuag

SEQ ID NO: 139711 - RNA, 18 nt, Artificial Sequence
  Description of Artificial Sequence: Synthetic oligonucleotide
ggcagcaaggauccugcu

SEQ ID NO: 139712 - RNA, 18 nt, Artificial Sequence
  Description of Artificial Sequence: Synthetic oligonucleotide
gggcagcaaggauccugc

SEQ ID NO: 139713 - RNA, 18 nt, Artificial Sequence
  Description of Artificial Sequence: Synthetic oligonucleotide
uggaaacagcucagaggg

SEQ ID NO: 139714 - RNA, 18 nt, Artificial Sequence
  Description of Artificial Sequence: Synthetic oligonucleotide
uuaaauggaaacagcuca

SEQ ID NO: 139715 - RNA, 18 nt, Artificial Sequence
  Description of Artificial Sequence: Synthetic oligonucleotide
ugauuuuaaauggaaaca

SEQ ID NO: 139716 - RNA, 18 nt, Artificial Sequence
  Description of Artificial Sequence: Synthetic oligonucleotide
ucaugugauuuuaaaugg

SEQ ID NO: 139717 - RNA, 18 nt, Artificial Sequence
  Description of Artificial Sequence: Synthetic oligonucleotide
ggccuucaugugauuuua

SEQ ID NO: 139718 - RNA, 18 nt, Artificial Sequence
  Description of Artificial Sequence: Synthetic oligonucleotide
gcgccggccuucauguga

SEQ ID NO: 139719 - RNA, 18 nt, Artificial Sequence
  Description of Artificial Sequence: Synthetic oligonucleotide
ccacggcgccggccuuca

SEQ ID NO: 139720 - RNA, 18 nt, Artificial Sequence
  Description of Artificial Sequence: Synthetic oligonucleotide
gugagccacggcgccggc

SEQ ID NO: 139721 - RNA, 18 nt, Artificial Sequence
  Description of Artificial Sequence: Synthetic oligonucleotide
cagccgugagccacggcg

SEQ ID NO: 139722 - RNA, 18 nt, Artificial Sequence
  Description of Artificial Sequence: Synthetic oligonucleotide
gauuacagccgugagcca

SEQ ID NO: 139723 - RNA, 18 nt, Artificial Sequence
  Description of Artificial Sequence: Synthetic oligonucleotide
gcugggauuacagccgug

SEQ ID NO: 139724 - RNA, 18 nt, Artificial Sequence
  Description of Artificial Sequence: Synthetic oligonucleotide
aaaaugcugggauuacag

SEQ ID NO: 139725 - RNA, 18 nt, Artificial Sequence
  Description of Artificial Sequence: Synthetic oligonucleotide
cucccaaaaugcugggau

SEQ ID NO: 139726 - RNA, 18 nt, Artificial Sequence
  Description of Artificial Sequence: Synthetic oligonucleotide
uuggccucccaaaaugcu

SEQ ID NO: 139727 - RNA, 18 nt, Artificial Sequence
  Description of Artificial Sequence: Synthetic oligonucleotide
ccaccuuggccucccaaa

SEQ ID NO: 139728 - RNA, 18 nt, Artificial Sequence
  Description of Artificial Sequence: Synthetic oligonucleotide
uccacccaccuuggccuc

SEQ ID NO: 139729 - RNA, 18 nt, Artificial Sequence
  Description of Artificial Sequence: Synthetic oligonucleotide
caugauccacccaccuug

SEQ ID NO: 139730 - RNA, 18 nt, Artificial Sequence
  Description of Artificial Sequence: Synthetic oligonucleotide
ccucacaugauccaccca

SEQ ID NO: 139731 - RNA, 18 nt, Artificial Sequence
  Description of Artificial Sequence: Synthetic oligonucleotide
ccugaccucacaugaucc

SEQ ID NO: 139732 - RNA, 18 nt, Artificial Sequence
  Description of Artificial Sequence: Synthetic oligonucleotide
aaacuccugaccucacau

SEQ ID NO: 139733 - RNA, 18 nt, Artificial Sequence
  Description of Artificial Sequence: Synthetic oligonucleotide
gucucaaacuccugaccu

SEQ ID NO: 139734 - RNA, 18 nt, Artificial Sequence
  Description of Artificial Sequence: Synthetic oligonucleotide
agcuggucucaaacuccu

SEQ ID NO: 139735 - RNA, 18 nt, Artificial Sequence
  Description of Artificial Sequence: Synthetic oligonucleotide
ggccaagcuggucucaaa

SEQ ID NO: 139736 - RNA, 18 nt, Artificial Sequence
  Description of Artificial Sequence: Synthetic oligonucleotide
auguuggccaagcugguc

SEQ ID NO: 139737 - RNA, 18 nt, Artificial Sequence
  Description of Artificial Sequence: Synthetic oligonucleotide
ucaccauguuggccaagc

SEQ ID NO: 139738 - RNA, 18 nt, Artificial Sequence
  Description of Artificial Sequence: Synthetic oligonucleotide
gcauuucaccauguuggc

SEQ ID NO: 139739 - RNA, 18 nt, Artificial Sequence
  Description of Artificial Sequence: Synthetic oligonucleotide
agauggcauuucaccaug

SEQ ID NO: 139740 - RNA, 18 nt, Artificial Sequence
  Description of Artificial Sequence: Synthetic oligonucleotide
gggaggaggaggcugauc

SEQ ID NO: 139741 - RNA, 18 nt, Artificial Sequence
  Description of Artificial Sequence: Synthetic oligonucleotide
ccccccggcagugguggg

SEQ ID NO: 139742 - RNA, 18 nt, Artificial Sequence
  Description of Artificial Sequence: Synthetic oligonucleotide
cauccccccggcaguggu

SEQ ID NO: 139743 - RNA, 18 nt, Artificial Sequence
  Description of Artificial Sequence: Synthetic oligonucleotide
acagacauccccccggca

SEQ ID NO: 139744 - RNA, 18 nt, Artificial Sequence
  Description of Artificial Sequence: Synthetic oligonucleotide
ugaccacagacauccccc

SEQ ID NO: 139745 - RNA, 18 nt, Artificial Sequence
  Description of Artificial Sequence: Synthetic oligonucleotide
augccugaccacagacau

SEQ ID NO: 139746 - RNA, 18 nt, Artificial Sequence
  Description of Artificial Sequence: Synthetic oligonucleotide
gauaaaugccugaccaca

SEQ ID NO: 139747 - RNA, 18 nt, Artificial Sequence
  Description of Artificial Sequence: Synthetic oligonucleotide
ucucugauaaaugccuga

SEQ ID NO: 139748 - RNA, 18 nt, Artificial Sequence
  Description of Artificial Sequence: Synthetic oligonucleotide
cagggucucugauaaaug

SEQ ID NO: 139749 - RNA, 18 nt, Artificial Sequence
  Description of Artificial Sequence: Synthetic oligonucleotide
caccucagggucucugau

SEQ ID NO: 139750 - RNA, 18 nt, Artificial Sequence
  Description of Artificial Sequence: Synthetic oligonucleotide
acccccaccucagggucu

SEQ ID NO: 139751 - RNA, 18 nt, Artificial Sequence
  Description of Artificial Sequence: Synthetic oligonucleotide
aaaggacccccaccucag

SEQ ID NO: 139752 - RNA, 18 nt, Artificial Sequence
  Description of Artificial Sequence: Synthetic oligonucleotide
cacauaaaggacccccac

SEQ ID NO: 139753 - RNA, 18 nt, Artificial Sequence
  Description of Artificial Sequence: Synthetic oligonucleotide
ccagacacauaaaggacc

SEQ ID NO: 139754 - RNA, 18 nt, Artificial Sequence
  Description of Artificial Sequence: Synthetic oligonucleotide
aucccccagacacauaaa

SEQ ID NO: 139755 - RNA, 18 nt, Artificial Sequence
  Description of Artificial Sequence: Synthetic oligonucleotide
ucuccaucccccagacac

SEQ ID NO: 139756 - RNA, 18 nt, Artificial Sequence
  Description of Artificial Sequence: Synthetic oligonucleotide
uagacucuccauccccca

SEQ ID NO: 139757 - RNA, 18 nt, Artificial Sequence
  Description of Artificial Sequence: Synthetic oligonucleotide
uccucuagacucuccauc

SEQ ID NO: 139758 - RNA, 18 nt, Artificial Sequence
  Description of Artificial Sequence: Synthetic oligonucleotide
cuaccuccucuagacucu

SEQ ID NO: 139759 - RNA, 18 nt, Artificial Sequence
  Description of Artificial Sequence: Synthetic oligonucleotide
gaacgcuaccuccucuag

SEQ ID NO: 139760 - RNA, 18 nt, Artificial Sequence
  Description of Artificial Sequence: Synthetic oligonucleotide
ggucugaacgcuaccucc

SEQ ID NO: 139761 - RNA, 18 nt, Artificial Sequence
  Description of Artificial Sequence: Synthetic oligonucleotide
ggagaggucugaacgcua

SEQ ID NO: 139762 - RNA, 18 nt, Artificial Sequence
  Description of Artificial Sequence: Synthetic oligonucleotide
accauggagaggucugaa

SEQ ID NO: 139763 - RNA, 18 nt, Artificial Sequence
  Description of Artificial Sequence: Synthetic oligonucleotide
gaggcaccauggagaggu

SEQ ID NO: 139764 - RNA, 18 nt, Artificial Sequence
  Description of Artificial Sequence: Synthetic oligonucleotide
cagcagaggcaccaugga

SEQ ID NO: 139765 - RNA, 18 nt, Artificial Sequence
  Description of Artificial Sequence: Synthetic oligonucleotide
gagcccagcagaggcacc

SEQ ID NO: 139766 - RNA, 18 nt, Artificial Sequence
  Description of Artificial Sequence: Synthetic oligonucleotide
caugugagcccagcagag

SEQ ID NO: 139767 - RNA, 18 nt, Artificial Sequence
  Description of Artificial Sequence: Synthetic oligonucleotide
ggucacaugugagcccag

SEQ ID NO: 139768 - RNA, 18 nt, Artificial Sequence
  Description of Artificial Sequence: Synthetic oligonucleotide
ugcuuggucacaugugag

SEQ ID NO: 139769 - RNA, 18 nt, Artificial Sequence
  Description of Artificial Sequence: Synthetic oligonucleotide
ugcugugcuuggucacau

SEQ ID NO: 139770 - RNA, 18 nt, Artificial Sequence
  Description of Artificial Sequence: Synthetic oligonucleotide
ugguuugcugugcuuggu

SEQ ID NO: 139771 - RNA, 18 nt, Artificial Sequence
  Description of Artificial Sequence: Synthetic oligonucleotide
ccucaugguuugcugugc

SEQ ID NO: 139772 - RNA, 18 nt, Artificial Sequence
  Description of Artificial Sequence: Synthetic oligonucleotide
cccugccucaugguuugc

SEQ ID NO: 139773 - RNA, 18 nt, Artificial Sequence
  Description of Artificial Sequence: Synthetic oligonucleotide
ccauccccugccucaugg

SEQ ID NO: 139774 - RNA, 18 nt, Artificial Sequence
  Description of Artificial Sequence: Synthetic oligonucleotide
caagaccauccccugccu

SEQ ID NO: 139775 - RNA, 18 nt, Artificial Sequence
  Description of Artificial Sequence: Synthetic oligonucleotide
auggucaagaccaucccc

SEQ ID NO: 139776 - RNA, 18 nt, Artificial Sequence
  Description of Artificial Sequence: Synthetic oligonucleotide
cucucauggucaagacca

SEQ ID NO: 139777 - RNA, 18 nt, Artificial Sequence
  Description of Artificial Sequence: Synthetic oligonucleotide
aagggcucucauggucaa

SEQ ID NO: 139778 - RNA, 18 nt, Artificial Sequence
  Description of Artificial Sequence: Synthetic oligonucleotide
gcugcaagggcucucaug

SEQ ID NO: 139779 - RNA, 18 nt, Artificial Sequence
  Description of Artificial Sequence: Synthetic oligonucleotide
cagcugcugcaagggcuc

SEQ ID NO: 139780 - RNA, 18 nt, Artificial Sequence
  Description of Artificial Sequence: Synthetic oligonucleotide
cauggcagcugcugcaag

SEQ ID NO: 139781 - RNA, 18 nt, Artificial Sequence
  Description of Artificial Sequence: Synthetic oligonucleotide
aggcccauggcagcugcu

SEQ ID NO: 139782 - RNA, 18 nt, Artificial Sequence
  Description of Artificial Sequence: Synthetic oligonucleotide
agcugaggcccauggcag

SEQ ID NO: 139783 - RNA, 18 nt, Artificial Sequence
  Description of Artificial Sequence: Synthetic oligonucleotide
agaggagcugaggcccau

SEQ ID NO: 139784 - RNA, 18 nt, Artificial Sequence
  Description of Artificial Sequence: Synthetic oligonucleotide
cuuggagaggagcugagg

SEQ ID NO: 139785 - RNA, 18 nt, Artificial Sequence
  Description of Artificial Sequence: Synthetic oligonucleotide
cccagcuuggagaggagc

SEQ ID NO: 139786 - RNA, 18 nt, Artificial Sequence
  Description of Artificial Sequence: Synthetic oligonucleotide
cucuucccagcuuggaga

SEQ ID NO: 139787 - RNA, 18 nt, Artificial Sequence
  Description of Artificial Sequence: Synthetic oligonucleotide
cagggcucuucccagcuu

SEQ ID NO: 139788 - RNA, 18 nt, Artificial Sequence
  Description of Artificial Sequence: Synthetic oligonucleotide
cuuuucagggcucuuccc

SEQ ID NO: 139789 - RNA, 18 nt, Artificial Sequence
  Description of Artificial Sequence: Synthetic oligonucleotide
cuuggcuuuucagggcuc

SEQ ID NO: 139790 - RNA, 18 nt, Artificial Sequence
  Description of Artificial Sequence: Synthetic oligonucleotide
aacaccuuggcuuuucag

SEQ ID NO: 139791 - RNA, 18 nt, Artificial Sequence
  Description of Artificial Sequence: Synthetic oligonucleotide
aaaaaaacaccuuggcuu

SEQ ID NO: 139792 - RNA, 18 nt, Artificial Sequence
  Description of Artificial Sequence: Synthetic oligonucleotide
gggaaaaaaaaacaccuu

SEQ ID NO: 139793 - RNA, 18 nt, Artificial Sequence
  Description of Artificial Sequence: Synthetic oligonucleotide
aaagagggaaaaaaaaac

SEQ ID NO: 139794 - RNA, 18 nt, Artificial Sequence
  Description of Artificial Sequence: Synthetic oligonucleotide
gaaauaaagagggaaaaa

SEQ ID NO: 139795 - RNA, 18 nt, Artificial Sequence
  Description of Artificial Sequence: Synthetic oligonucleotide
acacugaaauaaagaggg

SEQ ID NO: 139796 - RNA, 18 nt, Artificial Sequence
  Description of Artificial Sequence: Synthetic oligonucleotide
gacuuacacugaaauaaa

SEQ ID NO: 139797 - RNA, 18 nt, Artificial Sequence
  Description of Artificial Sequence: Synthetic oligonucleotide
caagggacuuacacugaa

SEQ ID NO: 139798 - RNA, 18 nt, Artificial Sequence
  Description of Artificial Sequence: Synthetic oligonucleotide
aagcucaagggacuuaca

SEQ ID NO: 139799 - RNA, 18 nt, Artificial Sequence
  Description of Artificial Sequence: Synthetic oligonucleotide
caagaaagcucaagggac

SEQ ID NO: 139800 - RNA, 18 nt, Artificial Sequence
  Description of Artificial Sequence: Synthetic oligonucleotide
ugguucaagaaagcucaa

SEQ ID NO: 139801 - RNA, 18 nt, Artificial Sequence
  Description of Artificial Sequence: Synthetic oligonucleotide
acuucugguucaagaaag

SEQ ID NO: 139802 - RNA, 18 nt, Artificial Sequence
  Description of Artificial Sequence: Synthetic oligonucleotide
agcccacuucugguucaa

SEQ ID NO: 139803 - RNA, 18 nt, Artificial Sequence
  Description of Artificial Sequence: Synthetic oligonucleotide
aaaugagcccacuucugg

SEQ ID NO: 139804 - RNA, 18 nt, Artificial Sequence
  Description of Artificial Sequence: Synthetic oligonucleotide
aagcaaaaugagcccacu

SEQ ID NO: 139805 - RNA, 18 nt, Artificial Sequence
  Description of Artificial Sequence: Synthetic oligonucleotide
cucuaaagcaaaaugagc

SEQ ID NO: 139806 - RNA, 18 nt, Artificial Sequence
  Description of Artificial Sequence: Synthetic oligonucleotide
gaaaucucuaaagcaaaa

SEQ ID NO: 139807 - RNA, 18 nt, Artificial Sequence
  Description of Artificial Sequence: Synthetic oligonucleotide
caccugaaaucucuaaag

SEQ ID NO: 139808 - RNA, 18 nt, Artificial Sequence
  Description of Artificial Sequence: Synthetic oligonucleotide
aagcccaccugaaaucuc

SEQ ID NO: 139809 - RNA, 18 nt, Artificial Sequence
  Description of Artificial Sequence: Synthetic oligonucleotide
aggacaagcccaccugaa

SEQ ID NO: 139810 - RNA, 18 nt, Artificial Sequence
  Description of Artificial Sequence: Synthetic oligonucleotide
ggacaaggacaagcccac

SEQ ID NO: 139811 - RNA, 18 nt, Artificial Sequence
  Description of Artificial Sequence: Synthetic oligonucleotide
ugcuaggacaaggacaag

SEQ ID NO: 139812 - RNA, 18 nt, Artificial Sequence
  Description of Artificial Sequence: Synthetic oligonucleotide
ugggaugcuaggacaagg

SEQ ID NO: 139813 - RNA, 18 nt, Artificial Sequence
  Description of Artificial Sequence: Synthetic oligonucleotide
ggaucugggaugcuagga

SEQ ID NO: 139814 - RNA, 18 nt, Artificial Sequence
  Description of Artificial Sequence: Synthetic oligonucleotide
aagguggaucugggaugc

SEQ ID NO: 139815 - RNA, 18 nt, Artificial Sequence
  Description of Artificial Sequence: Synthetic oligonucleotide
cccagaagguggaucugg

SEQ ID NO: 139816 - RNA, 18 nt, Artificial Sequence
  Description of Artificial Sequence: Synthetic oligonucleotide
gacuucccagaaggugga

SEQ ID NO: 139817 - RNA, 18 nt, Artificial Sequence
  Description of Artificial Sequence: Synthetic oligonucleotide
cugaugacuucccagaag

SEQ ID NO: 139818 - RNA, 18 nt, Artificial Sequence
  Description of Artificial Sequence: Synthetic oligonucleotide
ccaaucugaugacuuccc

SEQ ID NO: 139819 - RNA, 18 nt, Artificial Sequence
  Description of Artificial Sequence: Synthetic oligonucleotide
caccuccaaucugaugac

SEQ ID NO: 139820 - RNA, 18 nt, Artificial Sequence
  Description of Artificial Sequence: Synthetic oligonucleotide
aacaucaccuccaaucug

SEQ ID NO: 139821 - RNA, 18 nt, Artificial Sequence
  Description of Artificial Sequence: Synthetic oligonucleotide
cugccaacaucaccucca

SEQ ID NO: 139822 - RNA, 18 nt, Artificial Sequence
  Description of Artificial Sequence: Synthetic oligonucleotide
aaaagcugccaacaucac

SEQ ID NO: 139823 - RNA, 18 nt, Artificial Sequence
  Description of Artificial Sequence: Synthetic oligonucleotide
uuuacaaaagcugccaac

SEQ ID NO: 139824 - RNA, 18 nt, Artificial Sequence
  Description of Artificial Sequence: Synthetic oligonucleotide
cuuuguuuacaaaagcug

SEQ ID NO: 139825 - RNA, 18 nt, Artificial Sequence
  Description of Artificial Sequence: Synthetic oligonucleotide
cuacccuuuguuuacaaa

SEQ ID NO: 139826 - RNA, 18 nt, Artificial Sequence
  Description of Artificial Sequence: Synthetic oligonucleotide
caacacuacccuuuguuu

SEQ ID NO: 139827 - RNA, 18 nt, Artificial Sequence
  Description of Artificial Sequence: Synthetic oligonucleotide
gcuuacaacacuacccuu

SEQ ID NO: 139828 - RNA, 18 nt, Artificial Sequence
  Description of Artificial Sequence: Synthetic oligonucleotide
caacagcuuacaacacua

SEQ ID NO: 139829 - RNA, 18 nt, Artificial Sequence
  Description of Artificial Sequence: Synthetic oligonucleotide
agacacaacagcuuacaa

SEQ ID NO: 139830 - RNA, 18 nt, Artificial Sequence
  Description of Artificial Sequence: Synthetic oligonucleotide
uaggcagacacaacagcu

SEQ ID NO: 139831 - RNA, 18 nt, Artificial Sequence
  Description of Artificial Sequence: Synthetic oligonucleotide
acacauaggcagacacaa

SEQ ID NO: 139832 - RNA, 18 nt, Artificial Sequence
  Description of Artificial Sequence: Synthetic oligonucleotide
aacacacacauaggcaga

SEQ ID NO: 139833 - RNA, 18 nt, Artificial Sequence
  Description of Artificial Sequence: Synthetic oligonucleotide
acacaaacacacacauag

SEQ ID NO: 139834 - RNA, 18 nt, Artificial Sequence
  Description of Artificial Sequence: Synthetic oligonucleotide
caaguacacaaacacaca

SEQ ID NO: 139835 - RNA, 18 nt, Artificial Sequence
  Description of Artificial Sequence: Synthetic oligonucleotide
uggaagccaugucaccag

SEQ ID NO: 139836 - RNA, 18 nt, Artificial Sequence
  Description of Artificial Sequence: Synthetic oligonucleotide
auaucuggaagccauguc

SEQ ID NO: 139837 - RNA, 18 nt, Artificial Sequence
  Description of Artificial Sequence: Synthetic oligonucleotide
cgggcauaucuggaagcc

SEQ ID NO: 139838 - RNA, 18 nt, Artificial Sequence
  Description of Artificial Sequence: Synthetic oligonucleotide
aucgucgggcauaucugg

SEQ ID NO: 139839 - RNA, 18 nt, Artificial Sequence
  Description of Artificial Sequence: Synthetic oligonucleotide
aggacaucgucgggcaua

SEQ ID NO: 139840 - RNA, 18 nt, Artificial Sequence
  Description of Artificial Sequence: Synthetic oligonucleotide
accacaggacaucgucgg

SEQ ID NO: 139841 - RNA, 18 nt, Artificial Sequence
  Description of Artificial Sequence: Synthetic oligonucleotide
cugcaaccacaggacauc

SEQ ID NO: 139842 - RNA, 18 nt, Artificial Sequence
  Description of Artificial Sequence: Synthetic oligonucleotide
acccacugcaaccacagg

SEQ ID NO: 139843 - RNA, 18 nt, Artificial Sequence
  Description of Artificial Sequence: Synthetic oligonucleotide
aggucacccacugcaacc

SEQ ID NO: 139844 - RNA, 18 nt, Artificial Sequence
  Description of Artificial Sequence: Synthetic oligonucleotide
cugugaggucacccacug

SEQ ID NO: 139845 - RNA, 18 nt, Artificial Sequence
  Description of Artificial Sequence: Synthetic oligonucleotide
aacaccugugaggucacc

SEQ ID NO: 139846 - RNA, 18 nt, Artificial Sequence
  Description of Artificial Sequence: Synthetic oligonucleotide
gagugaacaccugugagg

SEQ ID NO: 139847 - RNA, 18 nt, Artificial Sequence
  Description of Artificial Sequence: Synthetic oligonucleotide
cacucgagugaacaccug

SEQ ID NO: 139848 - RNA, 18 nt, Artificial Sequence
  Description of Artificial Sequence: Synthetic oligonucleotide
aucagcacucgagugaac

SEQ ID NO: 139849 - RNA, 18 nt, Artificial Sequence
  Description of Artificial Sequence: Synthetic oligonucleotide
gacacaucagcacucgag

SEQ ID NO: 139850 - RNA, 18 nt, Artificial Sequence
  Description of Artificial Sequence: Synthetic oligonucleotide
gagcagacacaucagcac

SEQ ID NO: 139851 - RNA, 18 nt, Artificial Sequence
  Description of Artificial Sequence: Synthetic oligonucleotide
gggagcagacacaucagc

SEQ ID NO: 139852 - DNA, 627 bp, Homo sapiens
ggaggagccagcggaaggacggtgtgcgggccggccagccctggacgaaagaagagggcccctccaggccagtctgggcaccctgggatagcggctgcaggtaggcagaggcgctgccagtgcccaggtggcctttccctccatccggcccttcccaccttcctataaccttccctccacctccctcaactcctggcctccccacccttttactgccttcaaatctctctccctaaaccctgaccccttcctgcaccccaagcccgcccctctctccgtaactcagccatcagcaggggcagacggcaggtggcctggttgctgcagctcccaggatcagctctgccctccccgcaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacag

SEQ ID NO: 139853 - DNA, 2860 bp, Homo sapiens
gtgtagtggtgttgagcactttattttggaagtgatcgggcgtctccctgacatggagatggtgatcaatgtacgagattatcctcaggttcctaaatggatggagcctgccatcccagtcttctccttcagtaaggtaagtacagggagagccacatgggtggatggagagtggtcctctaggatatgagcatgagatctttgtccggtgacatagtctgatggataatggtaaggatgaggactgaggtccagaaatgggtctgtgtctctattagcatcacagtgattgagcaaaaagacagaggagatgaagttgagagctggtaagtagtgtaagattgcttgagtgtctatagggctagagatggaggctagggcgtgagaggcctgagaaacctacaggaattagaggtgggtcttgaagatcttacagagcatgggaggaaggggtccaagaaagcttggagttagggaacaccttcattccaaaagtttgttgagctcctactatgtatatattcagccatagtgctgggtatcagctgtcccatctgtcaccatattccgggggcccagggtggctaaaagtgaacctgaaggtgccagataactccacacggtgtgtgtacaagccgtgcattgaagggataggctggagatagcctagagggctatgcaagggggtgatcttttagactcatcatggaagattggagtagctaggatacacctgtgggcttggggaattgggggcaaggaatgtcttgtcagtgctcaggttcatgtaaatgttgtatcggcagggatgggccttggttccctagagacaaggaaagcatttgggggtgaaggcaggaaggctagaagagagtggatggaagattctatggggtaagagtgaattgaggaaaaccccatgaaatttgggaaaaggaacactatttctgatttggtttgtctaaagcagagggaccttttatccccactttttctttatcatagtttactttctccctagacttgttttatttcctgtgttgcaagtgggcagaggccacatttgtgttgcatttcccatggtctagcctcatttctcgaaagtgtttggttccattgtttgtcatgaaactcactcagaagaacagatagaggctcccatgtaagtcagtagggacttcgtgtttgttatctatctgttgtttctatggataataaagtatgaccgtcggtatactaactttccgttcatctttacttcccttctgttttttaaatcagtgacttctagtttccaagggagagttttactctgtcaactttatagttaattgtgcagcttctattgaatagctgttatgtttaaggtgcttgatgaatcacattttttacatatttgagagacagcaaacagcatattgcacatgtatttccagtggaagaaatagtagagttagaggtttatcagtggccagatttttaacagaagtaaccataaaaagggaacaaatggaggccaggtgtagtggctcacacctgtaatcccagcactttgggaggccgaggcaggtggatcaaaaaaaaaaaaaaaaggggggaacatatggctttaaacttttttcttttttttgaggcagagtctcactctgttgcccaggctggagtgcagtggcgcgatctcagctcactgcaacctccacctcccaggttcaagtgattctccacctcagcctcctgagtatctgggactataggcacctgccaccatgcccggctattattttgtgtgtattttttagtagagacagggtttcaccatgttgaccaggctgatttcaaactcctgacctcaggtgatctacccgtctcggcctcccaaagtgctgggattacaggtgtgagccaccgtgcccaacctcaaacttctttcaaaagatatgtgataacaccccttctcattttgctcatccatacttctgaccccgatcagtgaataaccaagaatttattgaccaatcaatgtgagcccaacagtgccatagtatgagataacactagccaatatttatcaagtatgtacaatgtgccagctactgttctaagaattttacgtgtatcaactcatttaatattcaaaataaaccttttagttagatcatattattgatattattgtttcccccattacagtgataaggaagctgaggcatagaaccattaagtaacttgcctagagctgtaaagaggtggagtcagaatccaaacccatgtgatccacatcaggagcccacactcttaaccattgcatgtatttcttggctcttactctcaaaaaaacccattgggaaataaccaaaaactggtaagacagtgtaaactcttaaatgtaatagttaaacaatgagagagctctgtgattattcagaattgggcatattgtttccttaaattggaaatcttaacagtatatatcctctagaaaaacagaatttgggggaactgaaaaagctgacctttaatgtgattctgaattctggaattcagtgagcccatgacttttaatccatagtcacttttgccttttaatgtctacaggctagactttggaaaatagggaaaatatatctttgacaatgtgacactaaaccaaggctgtccagatcctgtggcatgattgcagttgcctcttttcactgttccaagactgatttaggacgacctgtctgtttttgttgaagacatcagagtaccatgatatcatgtatcctgcttggacattttgggaagggggacctgctgtttggccaatttatcctacaggtcttggacggtgggacctcttcagagaagatctggtaag

SEQ ID NO: 139854 - DNA, 2187 bp, Homo sapiens
agccagtgcccagaggttcaccctttgcctacacctgtcctgctgcctgctgtggactttagcttgggagaatggaaaacccagatggtaagaaagccatccctaaccttggcttccctaagtcctgtcttcagtttcccactgcttcccatggattctccaacattcttgagctttttaaaaatatctcaccttcagcttggccaccctaacccaatctacattcacctatgatgatagcctgtggataagatgatggcttgcaggtccaatatgtgaatagatttgaagctgaacaccatgaaaagctggagagaaatcgctcatggccatgcctttgacctattcccgttcagtcttcttaaattggcatgaagaagcaagactcatatgtcatccacagatgacacaaagctgggaagtaccactaaaataacaaaagactgaatcaagattcaaatcactgaaagactaggtcaaaaacaaggtgaaacaacagagatataaacttctacatgtgggccgggggctcacgcctgtaatcccagcactttgggaggccgaggcaggcagatcacctgagggcaggagtttgagagcagcctggccaacatggcgaaaccccgtctctactaagaatacagaattagccgggcatggtagtgcatgcctgtaatcccagctacttggaaggctgaagcaggagaatcccttgaacccaggaggtggaggttgtagtgagctgagatcatgccaatgcactccagcctgggtgacaagagcaaaactccgtctcaaaaagaaaaaaaaattctacatgtgtaaattaatgagtaaagtcctattccagctttcaggccacaatgccctgcttccatcatttaagcctctggccctagcacttcctacgaaaaggatctgagagaattaaattgcccccaaacttaccatgtaacattactgaagctgctattcttaaagctagtaattcttgtctgtttgatgtttagcatccccattgtggaaatgctcgtacagaactctattccgagtggactacacttaaatatactggcctgaacaccggacatccccctgaagacatatgctaatttattaagagggaccatattaaactaacatgtgtctagaaagcagcagcctgaacagaaagagactagaagcatgttttatgggcaatagtttaaaaaactaaaatctatcctcaagaaccctagcgtcccttcttccttcaggactgagtcagggaagaagggcagttcctatgggtcccttctagtcctttcttttcatccttatgatcattatggtagagtctcatacctacatttagtttatttattattattatttgagacggagtctcactctatcccccaggctggagtgcagtggcatgatctcaactcactgcaacctcagcctcccggattcaagcgattctcctgcctcagtctcccaagtagctgggattacaggtgcccaccaccatgcccagctaatttttgtatttttggtagagatggggtttcaccatgttggccaggctgatcttgaactcctgacctcaggtgatccacctgcctcagcctcccaaagtgctgggattacaggcgtgagccactgcacccagccttcattcagtttaaaaatcaaatgatcctaaggttttgcagcagaaagagtaaatttgcagcactagaaccaagaggtaaaagctgtaacagggcagatttcagcaacgtaagaaaaaaggagctcttctcactgaaaccaagtgtaagaccaggctggactagaggacacgggagtttttgaagcagaggctgatgaccagctgtcgggagactgtgaaggaattcctgccctgggtgggaccttggtcctgtccagttctcagcctgtatgattcactctgctggctactcctaaggctccccacccgcttttagtgtgccctttgaggcagtgcgcttctctcttccatctctttctcaggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccag

SEQ ID NO: 139855 - DNA, 340 bp, Homo sapiens
taaggtcatgtgcttccacccctggtcggatgtaacgctgccactcatgtcggtccctgagatccgggctgttgttgatgcatgggcctcagtcacagaggagctgggtgcccagtacccttgggtgcaggtttgtgaggtcgccccttcccctggatgggcagggagggggtgatgaagctttggttctggggagtaacatttctgtttccacagggtgtggtcaggagggagttgacttggtgtcttttggctaacagagctccgtatccctatctgatagatctttgaaaacaaaggtgccatgatgggctgttctaacccccacccccactgccag

SEQ ID NO: 139856 - DNA, 802 bp, Homo sapiens
ggaacgtgatgttctcttcccggggtacacccatttgcagagggcccagcccatccgctggagccactggattctgaggtgagccaggtgaggtgcaggggctgtgctagaggggaggaccccggctgccctgaccctcctgcccctggcttcccacagccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaagtgcagagtgggacagaaaaccgccttatctgctcagcgggggactctgcatggagccccagctctcgctaaggtgacgaccaagccattgaatgtgtctgagcagggccagagccctccagcaaggctcctggcaagcccagcctgctgccctcagcctgacatgtgggaacatgtgtcaggagacaagtgtcctgcacccagggtgacttagtgcttggggacaagtgttttgtggacacttggggacaagtattctgtacccaaggagactgggccagggaagaggctaagcgccaggtggttgccctggcaaccaggacttggttctctgtgtgtgcgttcgtgtgtgtgtgtgtgtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcag

SEQ ID NO: 139857 - DNA, 3714 bp, Homo sapiens
gagctggatgatggcctggatgaagcgttttcgaggtaatgctagcttcctgtgctgggtagggggcctggtgtgcgtgggctggccctgctgccctttctcctggggacctttcccctgattaagaacacaagccactcagaccccctccagagcaacagtcccatccctccactcaaatgcttccaggggcagggagctcactggggaggaaaccccttccagcgttgtccagagctgttagaaagttcttactgttgagtcaaaaactattcctggtggctgctctgccgcagtctgaggtgagcgaaacacactgcagctcaagttgatttcctccgacttgaggaggcgtggccttcaaaaatgggcttttttttttttttacaggctttgctccctccacaggtctgtgtttatgaacaggggaagggagaaagtgtttaatgaagctcgtgaagcgttccatagcagggaaggtcaggcacagtgaggaggtgttttggtatagcctttggtggcatttccccgttttcccaggggccatccttgtggccccctgcagcttggggacatgccactgagaaggctgtggctgaggagaggcctgggcaggtcagggttccgagccctgggtccccgtctgtcaggcctccctttctcacttgagaccctcagcagcctcctacagccctcccacatcaggggctttgtttggggttggagtcagcgatttttggtccagcgggtggggacagagtcagggtctttgccctcctgcctcctccttcctcttccttgcctccttcttgccagggactagtggaaaccccttggtccagcctggggcgagggcgacagtgacaccttccctgcctcactggctgacgacacctgccctctgaagaaaatcttttgtttgctttctccacattattttgagcatcatgtgccctttattaacaattttgaaaatcagcaaagcattaaacagaaagtaacaccatcctgtaatcccacagcccagagttttgggcttaattcatgctaatcctatacatatacattattttgcattgatcagctcatcgtatttgcattttgggatcctgatttttcacttaacagcgatgtgtcagaagcattgctccaggctgttaaaagctcctcgtaaacacctcttccattgactgcctaacattctcttaagggaagctgctataatttacttgactctcccctattcttttggacatgtaggttgtctccctttgtaaatttatttttcgaacagcacggtgttgacacagttatagccaaagaatcttccgtgttccctcccacagcttgttccccaccccacccccacccccgctgctccctttaccagccccttctcctctttcctgggcatgtcctgactgagctggggcacagagtgggtgctctggcctctcccgggggtgggtgcaccgctggctgcccctgacttttctgagctgtttgactctcaaggggaggtgctttgatctgaggttactccacctcccctgcaccgggggcttccttcttgggccatgtgccctgctgttccccactggtgccccctcgcgtctgaccctggggcgcgccagccctcacccaggctctcggctcacacagctctgccttccaggcttgcccagtctcggacaaaccctcaggtcctggacactggcctgacagcccaggacatgcattacgcccagtgcctctcgcctgtcgactgggacaagcctgacagcagcggcacagagcaggatgacctcttcagcttctgagggcccggggccagccggacacaagcggccctgacacgtgatggaccaaagccacctgctgcgggggagccagttctggggcccgcctgccacctctcccagccctcagcattgtcagcctgaagatcagagctgcagccagtcaggcaggggagagatttttcttttaagccctgctctttctctgagaaccaaaagatgccttgaatatttattcagtgacttctggcttatgctcagaagccagtctgcgtcaggcacgtctcctgctgcgtgacatgtgcagtgctgtaatcggctcccgcttgctctcctggagcaagctctgccctggctgtgggtatcaggactgtgaccaaagcatttctagtcccttctctctttctaaggacccaaatttccctgggggcatcctgcttcctgaaagctgttggatttcagtgatttttccccccaccccccagcacaggagagcacccacagccgcagaaggggaatgtgtcctcctgctctgcttcctcagggcccagcaggcgggggtttgagccctggaccccaggctcttagagactaaggggcagctcctgaccaaagacgatacagcttggcactttaaagcattaacagcaggtgtgaccctgagggctcctccatggtgctgcattgagtccagctttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaacaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctgagaagcgctgccctgtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaa

SEQ ID NO: 139858 - DNA, 399 bp, Homo sapiens
atcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtcccatgctttgcgccattggttggggaaagatcaggcctgatgtcctaggatgtttttccatcagggggccttgggcgtggaagtgcgagccaaggaccaggacatcttggatctggtgggtgtgctgcacgatcccgagactctgcttcgctgcatcgctgaaagggccttcctgaggcacctg

SEQ ID NO: 139859 - DNA, 4803 bp, Homo sapiens
cactgagtgaagaaatgaaagacaaaggtggatacatgagcaagatttgcaacttgctacccattaggataatgtcttatgtaatgctgccctgtaccctgcctgtggaatctgccattgcgattgtccagaggtgagcattttaggtggctccgtgtcttcctcacagggttgatatgaggatgaaacaagatgatagatcatggtggcatgtagtctgggacctggattgtcgtgccacagatcacagctcacagtctatgtgcaatgcccctgaatgttgcccacctgtcctcaagccacacatgcacctgtaactcagtgcaagcccagaaactccccgtggggactcctagagctgtcagtggcctcacatagcagctggtccagtctcttgtgattgcccaaggaaactgaggcctggagagcttggggtcactgctctgaggccatagagatgcctagtagaagggccaggcctagaagcaggatccttgctgcccctctgagctgtttccatttaaaatcacatgaaggccggcgccgtggctcacggctgtaatcccagcattttgggaggccaaggtgggtggatcatgtgaggtcaggagtttgagaccagcttggccaacatggtgaaatgccatctgtactaaaaatacaaaaattagtggagcatggtggcacgtgcctgtactcccagctacttggaaggctggggcagaagaatcgcttgagcctgggaggcagaggttgtagtgagccaagattgtaccactgcactccagcctgggtgacaggagagaaaccctatctcaaaataaaatgaaaggtaatgaaatgaataaaataataaatcaagtcacggccgggcacggtggctcacacctgtaatcccagcgctttgggaggccgaggtgggtggataatgaggtcaggagttcaagaccagcctggccaacatggtgaaaccatgtctctactaaaaatacaaaaattagctgggcatggtggtgcatgcctgtaatcccagctactccggaggctaaggcaggagaattgcttgaagcaggacctaggaggcggaggttggttgcagtgagccgagatcatgccactgcactctagcctgggctacagagcgaaactccgactcaaaaaaaaaaaaaaaaaaaaatcaaatcacatgaaagtagaacatagggaattccatctttcgttctaggcatagtttgttaatatgattcagagccagcagttaggagaacacagtgtgactctcctagaacttcttgattgggcttcctctgattgggtttcctctgattgggcttcctctgaaagtgggggggatggggggtggggagcagaatggtcagagcttggctcagcagtcagactgctcttcttcaaatcctggctgcattgcttactacagctgtgtgactccagatgactgaatccacctctctgtgctgcagcttcccgtctagagagatcacctggagcagagggtggtcaggagactcaatctggttactgactcacagtgcaggagtactcatcccatagtaagcatccagctagagatgttgatttctattttcaggtaataatgatgatcgtaaaattagagacagataaaaggtatgggcattaggccagggcactgcaatttctaagctgtgtgacctcaggcaagttactcgacttctctgagcctcagcggtttcatccgcaatatatggataggaaaaccgacctcagtgggttgtctgacagtggagggcacttgattaaaaaaaaaaaaattaccctggtctgaatattaccctggactgaaagaaaaatattgagctaatacaggcatcaggaatggggctgcagggagtccagggaagggagaacgaagagcctgaaggtgtgaggaggtgcgagtgctgatctgtctgctacaaagaggctgctgagcctcctgtggatgtggccctggacttggcagtttaatacctgagctgttaaaataacctcagatgctgtgttctttaaggggtaggattcagattcctgctgaaatgcttctgaaagggagggaatgagccagcccatccccagttgctttttaagatcattgggaagttctggtcttgccatttgtccctggaccactcttaggtcctcctgccccacttccatctgggtgtgtgccctgggctgtccaccacacagctacatcctgccatcttccctcctggagccactgtgccatgcatggatctgtagcttcatttttcttggcttttccctggtttttctggagcagagtctctagtaaactcccaaggaagaaaacgtttgactttatgtgtgttgggaaacgtgctttttttctattacatctcagtgataggttggccatgtctagaattgcaggttgaaaatcatttcctctcagtatattggttagtgagaagcctgggactgagacagtcacattctcacttctttgcaggtgagtgctcttaggactgtctttttatcccttatactctgaaatgtcatatgtcttggtgtaagtccttatttcagttattgagctggacaagtactggagaccccttcagtcaaagccttctgtcattctccagctctaggaaattatcttctattgttatttctgttattccttcccttccattttcttttttctttttttttttttttttttgagacagggtcttactctggtgcccaggctggaatgcagtgacctgatcatggtacactgcagcctgaacctcccagactcaagtgatcctcccacctcaacctcctaagtagctgggactgcaagcacacatcaccacacccaacaaatattttttaaaaattttgtaagatgggatcttactatgttgcccagactttttcttcctcttcctggggctcttattaggaagatgtttgacttcctgggttggattcctgtctccgtgtctgactttctctctttgtcatatttttcatcactcgttgtctttttgcgtctgctctgacagatttcctcaaattttgtcttctagtcctatcctacagtttttactttcagcaaatataatttaatctccaagagtactctcttgttcttttttcttagcattctgttcttgttttatggatgtaacattctcttggaatatttgctgtcctctagatcatcccttctccatttcttcttgggctagtttttctgtttcttcatctttctcttttatgctacttattctgggcgtgttcttggtgggttttttcccatatagcaacagaggacttggagctcagggagaaaagggtaggtgcatcacctggcagagctcccagacagtgacaggcaggctgcgggaaggatgtctacttggcggtgctaccgctttcctagaaaccctttccctggagctggttgaactgttgggttttgccctggtggtgaacgctggctccccgtgctctgcctgtttcatcaccagccccctccccttctgcctggggtccagtaatctgttgaaatatatatcttgctcattggtgagctcctgctccttcctcgttgctcttgcagatttatcacttctcgtaaggctgcgcttgtacttcgggattttctctgtgccacactgggaaacatagggtggttgcatgctgcagtcctgagcacttatttcactcacatctttacacgaagatttggtgggtgtttactttgtttttagtaagttagtctgtcatgtcctttgatcctttttttttgttttttgagatggagtctctctgtgtcctccaggctggagtgcaatgtcgcgatctcagctcactgcaacctccacctcctgggctcaagagattctcctgcttcagtctcctgagtagctgggattacaggcatgtgccaccacacctggctaatttttgtatttttagtagaggtggggtttggcatgttggccagcctggtctcaaactcctgacctcctgacctgcctgccttggcctcccaaagtgctgggattacaggtgtgagccaccacacctggccctgattaatcttttaatgcccagtctctccttcaaaagccggctcctttctctccctcgccttcctagattccttctccactccccaggatcagcctcctcctccccaccccaccactgccggggggatgtctgtggtcaggcatttatcagagaccctgaggtgggggtcctttatgtgtctgggggatggagagtctagaggaggtagcgttcagacctctccatggtgcctctgctgggctcacatgtgaccaagcacagcaaaccatgaggcaggggatggtcttgaccatgagagcccttgcagcagctgccatgggcctcagctcctctccaagctgggaagagccctgaaaagccaaggtgtttttttttccctctttatttcagtgtaagtcccttgagctttcttgaaccagaagtgggctcattttgctttagagatttcaggtgggcttgtccttgtcctagcatcccagatccaccttctgggaagtcatcagattggaggtgatgttggcagcttttgtaaacaaagggtagtgttgtaagctgttgtgtctgcctatgtgtgtgtttgtgtacttggtctcatctctgcagactggtgacatggcttccagatatgcccgacgatgtcctgtggttgcagtgggtgacctcacaggtgttcactcgagtgctgatgtgtctgctccccgcctccag

SEQ ID NO: 139860 - DNA, 834 bp, Homo sapiens
ctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcggtgagtgttgctgctgcttggcctggcagcatcctgggctctgggtcccactgccgcctgcctgactccgggagagccaggccttctccctccctcaacttcatggtgcaggcaagggacatggggagcacagggtgggggtctcccgaggcctgatctctaacggggcctggttttcagccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggag

SEQ ID NO: 139861 - DNA, 4470 bp, Homo sapiens
atgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcattgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttccttttttttttttttttgagacgagatctctctctgccacccaggctggagtgcagtggcgcaatcatagttcactgtagcctcaaccttccaggctcaagagatcctcctaccccagcctttcaagtagctgggactacaggtgcgtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggaagaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatcgcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagttggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcag

SEQ ID NO: 139862 - DNA, 1451 bp, Homo sapiens
ctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcggtgagtgttgctgctgcttggcctggcagcatcctgggctctgggtcccactgccgcctgcctgactccgggagagccaggccttctccctccctcaacttcatggtgcaggcaagggacatggggagcacagggtgggggtctcccgaggcctgatctctaacggggcctggttttcagccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaa

SEQ ID NO: 139863 - DNA, 1452 bp, Homo sapiens
gtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattagagggctccaggactcagttttcaactgggtaccccactcagatgcaaggaaatgtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacgttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcatagttattattttaaacgcttgtacagcacacactgtgtgccagggactgtgctcactgctttgcaaacactacctattttaatataacaatgctatgagggaagctcgattatttatcctcatcttatagataagaaaactgaggcacagagaggttaagtaacttatccaactataaccagctatcaggggcagagccatttaagcagggcagtgcagttccagaatctggtcctttaaccttgatgctttggtgcctatcaggtgacctttgaatgtcatcgatcttgtgagtcatgttggtaaatggagcttgggtcatgtgaaagaggtcctagaaagccaagttccaagctcagccggatgactcaaggcagcttatcttctgaatctgggcctcagcttccttacctgtgaaatgggagtcaccatccctgcaggtcctcctcccacaggcaccagctatcttgccaacttaaaagccaaaactagaggagaggggtcaacccaaggtgacttcccatcctccctccctcccaacccttccaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccag

SEQ ID NO: 139864 - DNA, 4874 bp, Homo sapiens
ggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcgtaagtaatgaccctaccccgcatcttccctgggagggcccaggactctcccctaactcataggtgggggctggaagcttcaccatccccattacacagacaggtagatggaaaggaagtcagtgggattcaacctgcatttattacctattctgcgccaggcactctgtgggacgggagtagacttggtcctgaacatccaaagatgaatgaaatgggtccctgctttctttttctttttttagatagagttttgctcttattgcccaggctggagttcagtggtgcgacctcagctcactgtgacctcctcctcccaggttcaagcaattctcctgcctcagcctccggaatagctgggatcacaggtgcccaccaccatgcctggctaattttttgtagttttagtagagacgggggtttcaccatgttggccaggctggtctcgaactcctgacctcaggtgatccacccacctcagcctcccaaagtgctgggattacaggcgtgagccaccatacccggcctgggtccctgctttctcagagcccatggttaagtgggaaagtgggagaaaagctcattatgatccagcgagtcatgtattagaatgggacaacagcagccacaacaacaacaataatggccactatttatcatgcatttttggggtgcctggtccagtgcagagtattacacaaagcatttcagggtgctgagctgactgtcgactggggagtaacctgttcttcctcaggaaggcagaggtatcaggaagcctcacattgcaaatatgacctttagaatatgacctttagactaggtcttaaagtgggagttgaattttgacccatggagacgcagggaagggtgtttcaggcagaaggaacagcatcagtaaaggctcagaggcaaggtctacggtcaggaaatcctccactgcaaactcaggaagctctgggagccctattactcagggaatggtgggttttcttctccaggcctcataccccaccaaatcccaagggcactgtcaccttccaacctccatctatgtgtgacattttttgacatttcttttattaattatccaggttaatttttttttattatttttttatttttttgagacagagtctcactctgttgcccaggctggagtgcagtggcgtgatctcggctcactgcaagctccgccttccgggttcatgccattctcctgcctcagcctcccgagtagctgggactacaggtgcccgccaccacgcccagctaattttttgtatttttagtagagtcggggtttcaccatggtctcgatctcctgacctcgtgatccgcccgccttggcctcccaaagcgctgggattataggcgtgagccaccgcgcctggccttaattatccaggtttttaaaaaaggaaatagccaggcatggtggtgtgccataatctcagctactgaggaggctgaggtgggaggactgtttgagcccccaggggttcggctccaacctggacaacatggcaaggttcctcctctaaaaaagaaagaaaggaaagatgataggaaagggaggaaagataggaaagggaggaaagataggaaagggaggaaaggtaggaaagggaggaaaggtaggaaagggaggaaggaaggaaggaaggaaaagaaaagaaagaaaaagaacgagagaaagaaagaaaggcaatacacatttggttaaaaaaaaagaagaaaaacagagtttataagaaaaattagatgcctttaccctaaagcagccactggaattcccagactcttgtgtatccttccagagagattttctgcatatagtagcaatagatatgttattttcttgctctttttctgattaatgggaacatactagacacactattttacatgttgtgttttgtctcttggcaataaatcctgtatatcttttcatattggcactgagagattgatggatctcattctttataagggctgctggctgttatttgtttaactggccacctactgaaggacttttagggattttgcaatctgcgaatacaaccaactgcagcaaaaaacatccttctttatataagtgcatgttcacatgtgactgtgtctgtaggataaattcctagaagtggactgctggaacacagagtagctgctttaaaatcttgggtacatattggcatagttccttccaaagaagttatatcaatgtacacttccaccagcagtaaaaatcactgttgaaaaaaaaaatgtatgcaggccgggcgcagtggctcatgcctgtaatcccagcactttgggaggccaaggcaggtggctcacttgagggcaggagtctgagaccagcctggtcaacatggtgaaaccccatcttaactaaaaatacaaaaattagctggacatagtggcgcatgcctgtaatcccagctacttgggaggccaaggcaagggaatcgcttgaacccaggaggcagaggttgcagtgagccaagatcacgccactgcactccagcctgggtgacagagggagactctgtcaaataaatgtatgtatgtatgtatgtatgtatgtatgatgtatgtatgtatgcatgcatgcatgcatgcaatagacaactctagtccttactctatagctacccctcatcccaattattggggtgttcacactctactgtgctgtaatacacacttggaaaaacagtacattttaatactattttaatttgtatgagaagaaacaaagatttattctgaaaatctgttagaactagatttagtttctgagagaaatagtgttctcctaaaaccatcactagacgaaattttacaatattcgataaaatgcattaaaaaatttctaacagttagaaatgtcatcaaggacttcagcctagagctgagaatagagatgcaaactgtggcccaaatagctttccctgggggatttttaacttttaaggagaaattggagaatttgagatgcagagtcaatatatgactgtagtattaggactctttcagtaacaggggacagaaccccaactcaaatggatttaaacagaaaagggaatgaattgactgaagcaatgtgaggagtccagggctgcttcaggcatggctagatcaaggggctcaaatgaggttcacacagcatttcttgactcttttcttttttgttggcttcattctcagacaggctctcctcatataggcaaagatgggttctggaagccctgggctgccatcctaccagcttagcaaccttggaaggaaaagagctcttcttttcagctactttcagttgaatgactctttttatacttgataatgtaaacttttatttattttattttttgagatgaggtcttgccatgttgcccaggctagttttgaacttccgggctcaagtgatccctgcctcagcctcttaagtagctggaatggcaggcacacatcactgtgtctgctataacagaaacttttaaatgaagtctaacataaaaagtgcccaaatccaaagcatacagttcaatgaattttcacaaagtgaacacaccaatacagataaaaaatagaatattaccagctcccagcctggtgtggttgtacccacctgtaatcccagcacatttgggaggcaaaagtgggaggatcacttgagcctaagagttcaagaccagcctgggcaacagaaggagaccccatctctccaaaaaatacgaataaatgagccaggtgtggtgcagcaggtgtgtagtcctagccacttatgcccgctgctgtttcttggcactgagatggtgagggccctgctgctgctgctgcgcccctgattcagaatctaccttcctctcttctcataaagtgctgtcctagcacttgtgtgtcccagtcctttggtggcctgctcagggataagctggtagaccagtttccagtaaagtggtaccagctgatgaaggctggctgggtctcttcctctagctaacatttgcattttaagcctgattttcaagtctggaaagctgaatataattctgaatacactgaggacatatggctcaaatttttgctctactgcgtgactctggaaaaatatgtaagctctctgagcctcagcttcctcatctgtacaatggggatagtaaatgtgccaaatcagaacaaatgctaatgcttacctgcagtcttgtactgagaaggatggtgagatcatatcttgggttggtaggaaagcattcagggattgattagtgatgtttgccttgaacacaggttaagaaagtgatggcatgtgtgctgtgtgtttgtcatcagtagattagatgatttctaagttctagctgtaagctcctctggttcagcgccatggcaatgagaaagaatcaagggcaaggtcaggggaatggacgtgggaaggtgagagtggccagtaccccactcacggctttctgtgcctgcagagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatag

SEQ ID NO: 139865 - DNA, 485 bp, Homo sapiens
gaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccaggtaagtccccagtcaagggatctgtagaaactgttcttttctgactcagtccccctagaagacctgagggaagaagggctcttccagggagctcaagggcagaagagctgatctactaagagtgctccctgccagccacaatgcctgggtactggcatcctgtctttcctacttagacaagggaggcctgagatctggccctggtgtttggcctcaggaccatcctctgccctcagcttcctccacagggcaggaccacagctcacaaggatcccaatgccatcttcctgagcttccaacacctgctccgaggaaag

SEQ ID NO: 139866 - DNA, 886 bp, Homo sapiens
agttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaataggtacaacggcgggcgggaaacagtgctggtttggtctgggctgcggcaaggccagggaaggggaaggtgactctaggtcctgtaaaaggctgtccagttgccgagaactcctgatattggcttagcctggcccagaaaattgagaatacttgaacctaagcccattcctcgcagcccccctgcaccctggacaccaagcaaccccttccatggatgctcacccaattcgattctctctacaatcctatggctcttttgctcactttatgaatggagagactgaggtcagacagactgtcaattgcccaaggtcacacagcagacctggcattggaacccagatctgccagcctcaaaccctccggcagagctcagcttctcagaaccctccccttcatgcccaggacagggttcctctgagcctggcctggaggctcatgggtggctatttctgcagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacg

SEQ ID NO: 139867 - DNA, 4511 bp, Homo sapiens
ggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcaggtgggcaaactctgggattttaccttgcaaagggtgaggatggggcttaagacaggaggcaggagaaagtggagtctagaaggtagaaccaggatgcaacagttttctgggttccagggtagggaataaagggcaagattgtccatttgttgaggctgtttattcagtaaggtgactgacagcctttactgaatgaagccattgttgggatgaggcaatccactggatgaggtaacccattgggtgaagatgttcttgggtgagaattccattagttgacattgtccattaagtaaaagtggtcattgaagtaaggctgcacagttgggtaaggctatccattagacaattagatgagactacccattgggtcaggatgtctgctgggctagaccatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagactatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaa

SEQ ID NO: 139868 - DNA, 237 bp, Homo sapiens
ggaacgtgatgttctcttcccggggtacacccatttgcagagggcccagcccatccgctggagccactggattctgaggtgagccaggtgaggtgcaggggctgtgctagaggggaggaccccggctgccctgaccctcctgcccctggcttcccacagccacgccgtggcactgacccgagactctgagcggctgctggaggtgcggaagcggatcaatgtcctgcccctggggag

SEQ ID NO: 139869 - DNA, 1962 bp, Homo sapiens
cagaagtggcccaggcaggcgtatgacctgctgctgtggaggggctgtgccccaccgccacatgtcttcctacccatctgctccccagagggctgcctgctgtgcacttgggtcctggagcccttctccacccggtgagtggccagcagggtgtggggttatgtgagggtagaaaggacagcaaagagaaatgggctcccagctgggggaggggcaggcaaactggaacctacaggcactgacctttgtcgagaagagtgtagccttcccagaatgggaggagcagggcagagcaggggtagggggtggggtgctggtttctgagggactgatcacttacttggtggaatacagcacagccctggctggccctaaggaaaggggacatgagcccagggagaaaataagagagggagctgcacttagggcttagcaaacacagtagtaagatggacacagccccaatccccattcttagctggtcattcctcgttagcttaaggttctgaatctggtgctggggaagctgggccaggcaagccagggcgcaaggagagggtaatgggaggagggcccactcatgttgacagacctacaggaaatcccaatattgaatcaggtgcaagcctctttgcacaacttgtgaaaggaggaggaagccatgtggggggtcctgtgaaggaaccggaaggggttctgccaagggggcagggaggcaggtgtgagctatgagacagatatgttagtgggcgcctaagacaaggtaagcccctaaggtgggcatcacccagcaggtgcccgttcctgggcagctggtctcaggaaggaagtcccagaactgttagcccatctcttggcctcagataatggagtatttcaggacttggagtccagagaaaagctccagtggctttatgtgtgggggtagatagggaaagaatagaggttaatttctcccataccgccttttaatcctgacctctagtggtcccagttacagctttgtgcagttcccctccccagccccactccccaccgcagaagttacccctcaacatattgcgcccgtttgccagttcctcacccaggccctgcatcccattttccactctcttctccaggctgaagccacaatactttccttctctatccccatcccagattttctctgacctaacaaccaaggttgctcagaatttaaggctaattaagatatgtgtgtatacatatcatgtcctgctgctctcagcaggggtaggtggcaccaaatccatgtccgattcactgaggagtcctgacaaaaaggagacaccatatgctttcttgctttctttctttctttctttctttcttttttttttttgagacggagtttcactcttattgcccaggctggagtgcaatggtgcgatctcggctcaccacaacctccgcctcccaggtacaagcgattctcctgtctcagcctcccaagtagcttggattacaggcatgaaccaccacaccctgctagtttttttgtatttcgtagagccggggtttcaccatgttagtgaggctggtggcgaactcctgacctcaggtgatccacccgccttggactcccaaagtgctgggattacaggcatgagccactgcacccggcacaccatatgctttcatcacaagaaaatgtgagagaattcagggctttggcagttccaggctggtcagcatctcaagccctccccagcatctgttcaccctgccaggcagtctcttcctagaaacttggttaaatgttcactcttcttgctactttcaggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactg

SEQ ID NO: 139870 - DNA, 213 bp, Homo sapiens
ctggctctggacaagtcagattcccacccctctgacgctctgaccaggaaaaaaccggccaaggcggtaggtagccccgaggccaggtggaccttagccagacccaaccagagccctgaaatttgcctctctctgcccaggaatctaagtcctttgctgtgggaatgttcaaaggccagctcaccacagatcaggtgttcccatacccgtccg

SEQ ID NO: 139871 - DNA, 973 bp, Homo sapiens
gtgctgcggctcccgggccatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggtgggctccgggcagtgccgagcctgccccttgggctcggggtctggccggagtcccgaggcgctcccccgcgcggccggctcccgggaagatgccgtggccgctgtagctcggagctgggcagaaggcaccggggcgccttgcggcggagagtgaggtgccggggtctctgctcctgctctggaccctggagagtaacccattccccggaattcagaatgacagggaggagagggaattccccgttcacccgcaggaggcgtggcccgtgcttggctactctggacctgcctgaaacactgaggggtcggggatgggggcaaatgtcgtgcgcgcgagcgtgtgtgtatatgcgttgccagaagagaagaggggtttaatgtctgtagcttttaactgatcctctttgtggagttcaatttgattagtagaaagtgagagtccgcgtcactatccatagcattctgagggttgagcattaagcttgggaattttccagtttcttggacacctgacagccggatagaggaacagacttgacgtgagcgtgggagttgcacacacaaaaattcctccctagcgtttcgtttccatcagtgggatgggaaggggatttctgaaagttttggtcttctgtttcttctgttggtgtggtgtcagcaaataacattcaggaaaatttttttaactctcatttacttcactttttaaaggttcaaaatggaaagtatttattgaccaaattaacaggtctttggagaattacgaaccatgttcaagtcaaaactgcagctgctaccatgg

SEQ ID NO: 139872 - DNA, 2398 bp, Homo sapiens
gggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgagtgagtgatgggcctggaaggggccatgctgagggtgtggctgggaggctcagctctgagactggaagggcgaactgctgggaatccctgacccaagcaagaccttgttcttgcccccagtctggtccatggcctcagaaagatgggtttaactctgtcacaagagacgtggttcccatcctccctttgccgttatgttcttaccttgggcacaagtgtttggctgtgtcttgctctggccacaggcctgctgtccaggaatgttaacctgcttagccacccaggatttctgaggggtctcccttgtcactgatgctgatcagatctctaaaggccctaaaggtcctgctctaacttcataactgaagtgagtctggcccatttctagccccctgcctgggcccccatggatctctaagtggtatcacaaaaccaccctgccccattttctgagccatgattctgatacatatagaatgtgaacatcatggcaggcccaagcttagcaatgctgtccatctgggggtggggagggccatgttgacaccccacacctcccactaagatctaggagcacccagctgctttaagagctagagggacatgttagggcctgggggcatctctgccagtctttcctctgaggcagtgggtcagtgggggaggagggtcctccccaaagcctcctcttcctcctctgtcccagtcccagagctgccctttaggccttccttttgcctcaggcccatccctactcctctcctcacacagaggggacctcaccccagacgaggtggtggccctagtgggccagggcctgcaggagggggagcgagacttcggggtcaaggcccggtccatcctgtgctgcatgcgccaccagcccagtgagtaggatcaccgccctgcccagggccgcccgtctcaccctggccctgacctcctggcctagcagtggggctgtacctgatctcccctgtgccccacagccccatggtgtccccttgagcccactggcatgaacttggggcttcatgaaacaactggagacctcctaggcaggctcagaacttctggagatgttctccccagggacaccatgcctttatagccaccctgcaggaagctcaacaccaaataggaacgtaactattgaaaaaaaaatctaggctagattctgatcagcccatagtcctccctcgagacccagtggaccaggccccatcctgtctgggcctgaataggtctgatttccaagatttctgaggggtctcccttgtcactgacgcagatcagatctctagagtttgtgcctcatggtgcacagcctcactgtgtgatattgggcaggtcacactgctgctctggttatgcaccaagacacctcagttgtgcactgtcacaaggagatgatcacacttacttcattcctctaccctcaggattagtaagaaccaaagagctacctgcacgcatttcctctaatcctcgcagcagcctgcaaagcagaactaccattgcttagtcccatttgacagatgaggaaactgaggtggagtgaggtgcagcctcttgcaaggcacaaaccctggatttgtatccggggacatctagttccaaagcctgtgttcattcattctttcttaaacacttcagaataactttattggttaagagtacctaatacattagcgagatacttcccaatactagtgtgagttctattttagatgacgtgttaaacggtcctccgtttcctcatctgcgcatgggaataagcctaccatgagtgttgttggaaacaccaggtgagagaagggtccgtgtcatttactgagctcaggccccgtccttggtgctttacacacatggcctcggcaaagcctggccgtgaccctgtgcaatagctggcagggttctttctgaaaagggcggaaactgaggccataagcagagcagttttccgcaggccatgtggttaggacatagcagttaggatttgaagacactgagccctgttttgtgctggcctcccatggggggtttgggtgggacagcaggcaggtaggctgggaggtctctccatggtgctggtgacagagcctgggtgggcatctcgcccacagactggtcccccaaggtggtggagctgtgtaagaagtaccagcagcagaccgtggtagccattgacctggctggagatgagaccatcccaggaagcagcctcttgcctggacatgtccaggcctaccag

SEQ ID NO: 139873 - DNA, 5988 bp, Homo sapiens
cctttcagtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtaagggtcacaccaaagttagggactttgcactgggagagcagcacccagggcagggcccttggttttgcagattaccaaaactaaggctgggggcagggaaggcgagcaggcttggggcaccttggaaggaggcacatgggccttgggggtcctggctagggcagctgtgcctgccactggccctctgcccaccacccctcctcactgtggctatccagtgtccagcctctcgaggggttctagggtacttattcctggagctaacggtgacccaggacaccagtgtccggggcctggcctggggcttttatggggggagctggctggctgcccagggctgtctggctctctgggggctctgcatggcatttccaggggttggtggatcagggattctgtccctcaggagaatgtgggcactagcccaaggccactcacttctgtgtacatagccacctgagggcccaggaatggagggggccaggctacagctggacatctggcactcggatgggctctggagcccccaggcctgcagcatctgcccagggactgccctggcccttggccatttcctcagggacccacagctccaccagccggcccctcccagtgctggaatagacagttcctcagtccacatctgccaaaggcggcactagaaggcatcctgccttttttactgcgttctggaggtggggtcacaaagcactgctcactgcataaaagggacagcatcctgcccctggcagccctgcctgaccagctccgcctctcccactgctatccaacctgtacaccctggtgaccatgtccaggccagtggccttaaggactgtctctgtactgatggctccacatctacctctccagccagactctcctctgaactcgggcctcacatggccaactgctacttggaacaaatcgccccttggctggcagatgtgttaacatgcccagaccaagatcccaactcccacaacccaactcccaggtcagatggaacctcttcttcccaggcccttctgttcctctcctcagcccctcccacctcccttcagaataagtctagactcttatcgctttcaccaagcctgcgcccagcatccctgcacagggattgttaggacagcctgacgccctgcttccaccctgccccaagatgcccctgctctgcagcccggcgcctccaggcttctcacctcctgctgctcacagctcagcctcactccctccctccccgcctctgctccagcctcagtgcaggtcccctgctcccatcttctggcagcagctgcccgacctggtccctcttcatctgtccccattccttcaccccccagcctgtccccaacttgactgaggttctttcctgcagatccccgcccttgagaggggttggtcccactgtcaactctgcttctgtgccctgtgccgcacctggcattcagtgagcatctgctgaagagatgagggtcagatgccctgcagggagtgtgggggcgtcctcaggcaagaaaagttgtacgtttggctgtgggccctgattatgtgtcctgtgacctcttgggtgaggtcagcaagagaaacctctgcaagctggctggggctgcctcccagaggctgccagggggagggacaggctctgtctgtgctcttcttccgaggctacacctggggcgccaggctctcagggctccccaggtaccaccacatttcctacactgcttgggaaagccctgtaagtttgcacagacacccagcatgaggctcgccagagagatacttgtagctggggtctgggcaccaggaacagcttggtgctgggcctgaagtcgggcaggatgcagcctggccaggtgagaggaaagcttggagccagtgcctgggttcaaactcctctgtggcctatggttctgtgggcttggggaagggtttgtacctctgtgtccagtttcctcacttataaaaaaaggagataataaaagtacccatgtcccagggtggctgtagcaataatagggaggggtgcccagagcaggtctggcacacaggaagtgtgcatcagcctcagtccctgccattgggcttgtcctgggagtctgtgaagccaacctctgctccacaatgtgacccccaggcttgtgagaccaagctgggtcagagcttcctcctctggggttgcaccaggaggggaacttctgcaggcccagatgcaccctgaggaaagggcttgttcccaccaagaacaaggctcacctttggaggatgctccccacatgagaggtgaacccccaggtctactggtgactgcagcctcggaagctgacagcatctatcctccaacccatgcccactgggaagtgtgtgaggggtcctcataggccctgcggtgtggacaatgcagagaccctgtagcatctggctagggcggggcccagataagagccctgtgccaggagagcctggccggttctgccactgtggggagacaggctcccccaccccatgtcccctgcttccctgcagcccacagagaatacagacctacttttacagaaatccagatttttgtgtaaaagtgtctctattttaagtagattttaagtggtggcagcaaatttaagcttttgagaatattatacagaacaaatcagattcacaggccagatgcaactttatttacagaaatgggatcaggtcctacctcaggtcccatctcacgttttcacttatgcctatacgtctccttcacgggaaaggccacaagaggccctgcggtaagtgtcccggtgttgatttaaagtccccaacagtgaatatgagggtcctcactgttgcagcaagaggatacccccctgtgtatcttggaaatgcctgcagccctcttgctgcagaacagattcttaggagagaaactgtcagatcaaagttaaacttagagaaactccaaattgccctctgaacagacggtatcagtttgacatcatccaataccgggattcctcggggagaactttctggcctagaaggcagtagagccaggacttcacccagtcagtggcagggccacacgtgggccttgatacagagggggaagacttgagcctcctcgacaccctacagggcccagcctcccaacatgtgataagagaaacaacagccaacttgtacctagctctccttattctccaagggctgggccagttctccccacagccctgcaagggaggatcactcaagggccccaactgtctgacaatacagccacactctgatcagccacctgggcataggctccatgccattgtcctccgccaagacctcagactgaaatgttggctcctcccatgaagaacctggggccaaaggaccagagtccaggtccgtggctgccaggatgggccacttggagagaggcacaagggtggtgccaggcaggtgtgagggctggacctttgcaagagcagcatcacttttgttgagagcccacaggtatcttataattgggtcctaggacttcctgccagtagccattgtgtgcatggatttgggtgctggcctcaccatggtgtgctggctgcccatgcctgcaataatgacttctgtaagcctttcttcatctgcaagatgggtgctgctggcacctcctccccggtgctgtggtgacagggcatagtgtgtgaggctgctatgtgaagcacctaatgcagggcctggcatatggaggaattcagcaaatgacagatgccttcacagttagttcctggcatcctctacattggtgggtgtaggaaagaaagacagaggaggcaaaagttgtagctgtggggcattgaggacagcctggattgttccacagagccctgaggacatctccaggggtgtgctctgcaggggcagctggattggagggttaggggtcggggagggcgtgcactcccacccatgctcacagcctcggaacagtgcctgctcagccaacatgggtgtttgattctgtgtcttttgtcacagactttatcagccccatccctttctgaccttgcctcagtttaaattttacatgtggggcctcattaagagacatggttcttaactaaagatctgtatccattaggaatgctttgggctgcaggaagacaaacacctgactcactgtggcataagtggtttgcgtctgctcccataagctgcacgtggagggtggatctggcattactctctcttccctacatttgcagtatgctaacagctttaacctccagccttgtttcttcatggttgcagggtggctatcacagcgctggccatcacatccttacacagctgtgtttacaaatttagggggacattgaagctcctcccctgctaaaatcaggcttcccttcacctgtcattggccagaactgggtgaaatgcccaactctagaccgatcatcagtaagaggagtatagaattgctgtgcccaccttagattaatcatggcgcaatgtgctccccataccaacaaaatctgagttctagaaactgaggaagaagaggaaaatggccgtcttgcctcctggctgggattcagagcatctccaaccctctgagcttatgtgtaagactgtgggcaaaagtgtgtgagtttttgtggaatggatccacggcttttatcagagcatctttcctttttctttttgattcaagatgaaaatattcttatgattatttttctcaccactgcccagagataaccagcacattaacatggccttttctccatgaatagcactagggtgcccagtggacagacacatagctgtccacacaccagcttgctggggatgcataggcagagtcacatctgcactcacggcctgtcctcacactgccatgtggagagccagcagccacaccatgggccgtccatgctcacgggagtggcagtatcagatctgagcttcgtgtgcccaggcgtctctcacatcagtgcatagggaccctctttgttctgtggcccagtgtgcccatgccacagatggcttcagtcagcagacacctccttctagacactcacactcactcctggctggcccttagcacacctgtgcagacaggcccatttattttcttgtgtaaatcccaagtaggaggactgggtctctctgacagcaatgccagctgcctggcaccctccagacaggtggctcaagccccacctcgccagctctcccagttagcccctcctttccctggctctgacctgagggacgaagcagggtgctacaggacgctgtgccacagggatatcgtcagggacagaagctactctgccctctgctgctcacccctccaacacgctgtgggctgcatttgttgagtggctggtaccagactctgctcttctgactttccagctggttttacctgtagtaaagtttgagaagatgggtcatcctgaccccggggtcagaagacagaaggaggcccatggcgtgtgggggagatgccccgtgaggccctcggtgtgcagatgcctggtgacagccccaccctgaggtccccagcctaccccctccccagcccgactgctcccatccccctccctgtgcaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcag

SEQ ID NO: 139874 - DNA, 786 bp, Homo sapiens
atgccattccgccaggcccacgaggcctccgggaaagctgtgttcatggccgagaccaagggggtcgccctcaaccagctgtcactgcaggagctgcagaccatcaggtacggcccatccccttccccatgctgcctcctaggaagtgagcctgggtgcctggagcccagggtggcctggcgccctggcccacctcttcctctctccccagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggactggagaggcagggcagggtggcctgtaatcccagcactttggaagggcaaggtgcgaggatgcttgaggccaggagtttgacacagcctgggcaacacagggagacccccatctctactcaataataaaacaaatagcctggcgtggtggcccatgcatatagtcccagctacttgtaaggctgaggtgagaggacacttgtgcccaggagtggaggctgcagtgagctatgatcacgccactgcattccagcctggataacagagtgagaacctatctctaaaaataaataaataaacgaaaaataa

SEQ ID NO: 139875 - DNA, 609 bp, Homo sapiens
ataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcaggtaatggcaagcatggctgccgtgctcacctgggctctggctcttctttcag

SEQ ID NO: 139876 - DNA, 1389 bp, Homo sapiens
ggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggag

SEQ ID NO: 139877 - DNA, 73215 bp, Homo sapiens
tgttgtacagtgttttgggcatgcacgtgatactcacacagtggcttctgctcaccaacagatgaagacagatgcaccaacgaggtaatcccattttctttactcaggggtctctgaccaccactgacacaggatccagatttaagatcctgaccttgaagatgaaataatttcactagggcttattcccagattccaggttcctgtcacagcatctggtaccagttgcttatgcatagtataggcatttattaagtaattattgaaagtctatggcttacatagttttttcaggagcatggagattcccacctttgcgcccattaaaagataaactccacagggcagggagttgttttgctgcctgttgtgtctaggatagtgcctggcacagaggagataatgaataaatttttgttgaatgagtaaatgaacgaactttcgtctttgcctatatgggtacctagggtgccaggccacaaagatggtgtccatcattctctcttattagggggcaaatatatatatatatatatattttgtttgtttgtttgtttttgagacgaagtcttgctcttgtcccccagactggagtgcaatggcgtgatcttggctcactgccacctccttctcctgggttcaagtgcttctcctgtctcagcctcccaagtagctgggattataggcacctgccaccacgcccggctaatttttgtatttttagtagagatggggtttcaccatgttggccaggctggtctggaactcctgacctcaggtgatccgcccgcctcagcctcccaaagtgctgggattacaggcgtgagccaccgcacctggccttttttttttttttttgagatggagtttcgctcttgttgtccaggctggagtgcaatgccgtgatctcggctcactgcaacctccgcctcttaggttcaagcgattctcctacctcagcctcctgagtagctgagattacaggcatgcgccaccacatctggctaaattttgtatttttagtagagacggggtttcaccatgttagccagactggtctcaaactcctgatgtcagatgatctacccgcctcagcctcccagagtgctgggattacagatgtgagccactgtgcccagccgggaacaaatatttttaagtgccaactatgtgccaggcacttgggaaatgataatagtaaaaaacagatccaatctctgcctcatgggtctgtggtttgctggtatatatgagagctggccataacacacagaattgtttcttccatctctgcaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgttgtcagacagggtggtgagtccctgtgtctctctgtctgtgggggtcaggttgtttgtagatctttcaggaaggtcctgggtggggggccctcctgctttcaaacccataccaagtgctttcctctgaagggaatgtgagggaggaagaaggggggagtttcagagacttctgaggttccccaagagggaagaggtcaaagtacctcctgagcggggagagctactgagttgaactgatttgctttgccatttgctttagcagcagccaggcccagtggcagcaattgtacgtgcatttccaggggtcagttgtccagttcatccctgagccttgagctcccagtcgcaggtaggaacttctcttctcctttctttttttttttttttttgagacggagtctcgctctgtcacccaggctggagtgcagtggcgcgatctaggctcactgcaagctctgcctcctgggttcacaccattctcctgcctaagcctcctgagtagctgggactacaggcgcccgccaccacgcccggctaattttttgtatttttagtagagacggggtttcaccgtgttagccaagatggtctcgatctcctgacctcgtgatccaccggcctcggcctcccaaagtgctgggattacaggcgtgagccaccgcgcccggcctcttctttctttcttgattgggtactgctatatcacctaggaccaggggtgtgtccaatcttttggcatccctgggccacattggaagaagaattattatcttgggctatacataaaatacactaacactaacaatagtgatgagctaaaaataaaaatggcaaaagaatctcatgttttaataaagtttacgtatttgcgttgggatgcattcagagctctcctgggctgcatgcagtcatgggccatgggttggataagcttggcctccctaggcagtcctctcaccacagcctcccaagtagctgggactacaggtgcacaccactgtgcctggctaagttttttttttgtttgtttttgtttttttttaatttaatgggtacatagtagtaggtgtatatttctttttttcttttcttttttgtttttttgagatggaatcttgctcttgtcacccaggctggagagcaatggcacaatcttggctccctgtaacctccacctcctgggttcaagcgattctcctgcctcagcctcccaagtagctcagattacaggcgcccgccaccacgcccagctaatttttgtatttttagtagagatggggttttgtcatgttggccaggctggtctcgaactcctgacctcaagtgatctgcctgcctcagcctcccaaaatgttgggattacaggcatgagctaccacacccggccttgtatgtcttcttttgagaaatgtctattaaaatcttttgcccatccttttattagattattcgtttttttcctatagagttgtttgagctcgttatatattcttgttattaaccccttgtgaaatgggtagtttgcaaatattttctctcattctgtgggttgtctcttcactttgttgattgtttcctttgctgtgcagaaactgtttaatgtgatgtgatcccatttgaccatttttgctttggttgcctgtgcttgcggggtattgctcaagaaatttttgcccagaccagtgtcctggagattttctcctgttttcttgtagtactttcatggtttgaagtctcagatttaagtctttattttgatttggtttttgtggatggcaagaggtaggggtctagtttcattcatctccatatgaatatccagttttccaagcaccatttattgaagagactgtcttttcctcagtgtatgttcttggcacctttgtcaaaagtgagttcactgtagatgtgtggatttgtttctgggttctctattctgttccattggtctatgtgtcttttttttttttttttttttttctctgagacagagttttgctctgttgcccaggatggagtgcagtggcgtggcgtgatgttggctcactgcagcctctgcctcccgtgttcgagcagttctcctgcctcagtctcccaagtagctgggattacaggcatgtgtcaccatgcctggctaattttttgtgtttttagtagagatggggtttcaccatgttggtcaggctggtcttgaactcctgacctcaggtgatctgcccacctcggtctcccaaagtgctgggattacaggcatgagccaccgcgcctgggcgaaagatggcttattttgaagtcaactttagaatattataaaacagcattctcaaactttttggcctcaagatccctttagattctttttttgtttgtttgtttgtttttgttttttgagacggagtctctctctgtcacccaggctggagtgcagtggcacaatctcggcttactgcaagccccgcctcccgggttcatgccattctcctgcctcagcctcccgagtagctgggactacaggtgcccgccaccacgcccagctaattttttgtgtttttagtagagacggggtttcaccatgttagccaggatggtctcaatctcctgacctcgtgattcacccgcgtcggcctcccaaagtgctgggattacagatgtgagccactgcgccagtccctttagattcttaaaaattattgaagaccccaagggcttatgtttaccatgttagaagttataataggccgggcgggtgacattcgttaatatcaccactgatctcatttttaaaaagtctttaagtattgggaagctgtcgggctcacagtggtcaatacacgttttctaaatttgagttttctcttgaaagtttgatttttatcattggtaacatactgttggttcttttgtttgattttgtctgagatagcatctccctcagtcacccaggctggagtgcagtggtgcagtcatagctcacttgcagcctccaacttctgggctcaagtaatcctcctgcctcagcgtccagagtagctaggactacaggtatgtgctaccatgcccagctcattttaaaattttttgtaaagatggtgtcttgtgatcttgctacatcgaccaggctggtcttgaattcctggcctcaagtgatccatctgcctcagcctcccaaattactgggattataggcatgagccaccacacccagccttttttttttttttttttttttttgatatggggtctcactcttgcccaggcttgagtgcggtggcacagtcttggctcactgtatctagccttgacttccaggctcaagtgatcctttcatctcagcctcccaagtagctaagactacatgcatgcaccatcatgcccacctcattttttaacttgttgtagagatcaggtctccctgtgttgtccaggctggtctcaaactcctgagctcgagccattcattcctgccttggcctcccaaagtgctgggattaaaggcatgagccactgtgcccagccagttcttttttgttttgttttgttttgttttgagatgaagtctcactctgtcacccaggctagagtgcagtggtgtgatctcggctcactgcaacctccgcctcgtgggttcaagtgattcttctgcctcagcctcccaagtagctgggaccacaggcgcgcaccccaatgcccggctaatttttgtatttttttagtagagatggggtttcaccatattggtcaggccggtctcgaactcctgacctcatgatctgcccacctcagcctcccagagtgctgggattacaggcgtgagccaccgcgcccggccacaaagaatatttaaaagacagatatcaaaggtggagattttaataaagttagtttttatttattcatctaggacattcttaaattggcattttattgtctttcatggttctgtggattaactgggcccagctgggtggttcttgcttgggatatgtcatgttgctatagtcaaatgaagacggggcaggtgtcatctgaaggctcagctgggctgggtgtccacgctggcttaggcacatgggtggcacttgatgctgttgaatggagtgcgtatacatgacctctctatgtgccttgggcttctcatagcatgagagctgggttctgagcagaagcattcccaaaatgaatgtattgagagattcagaaagaaatgtcaatgtttctcatgtcctagccttggaagttacacagtgccacttcctctattcccttggtctcaggaccagttcagattcaaggagaggactacacaagggtgtgaatactaagaggcgtgattcactgaggagagaaacaggcctccttggagaccagctactacttttcagcatccttatgtgaggtaatgtggtcttgatacttccaagagaaaagcacatcttctcatgattttcattcctggaagctactgttagttaggaaattcctaataggttgatggaggacattgaatgctaggtgaaggaatttgtactctgttctttgggcaatgggggagccatcagtggttttggagcaaggagtggtggtgttaatattgcaaaaaggtagattaggaatggagatagagaggataggtaggggactgcagtggtctaaatgtaaggaaattcttcttcacattaaatctgagttcctctggttgcaatttaagtgtattgattttgatatttcagccacacagattaagcacccagagccagggtggaataacccatccctaccccatatccatttagggctgttgatgcacaggagagattaagagttcacaaactttagaaggcaactaaatttaggttttattgtcaaagcacataaaaagttaagcataaattattcaaaaataaaaagcaagaaaggtgaaacttcatttaacaccactaaccatgtttcaaatacgcttcagtttcagtattatagaagcaaggagtggagccagaggaaggaatggggaggacaaattagagaatggtaggaagagggacaaaagtaggggaagaaaggagtcaggaggggcacacagcagaaagaatttgaaggaggtcagattggagcaactacttgaagctgagagaaggctccgtatggggctaacatgttagcaaagagctggtgccttctgtgtttccctgaggcactggcttctgggttttagcatctggtatcctcaccctttctttaatacagacagtccccaacttatgatggttcaactttacagtgatgtaaaagccatacacggctgggcgcatggctcacgcctgtaatctcagcactttgggaggccgaggtgggaggatcacgaggtcaggagattgagaccatcctggctaacacagtgaaaccctgtctctactaaaaatacaaaaaattagctgggcgtggtggtgggcgcctgtagtcccagctacttgggaggctgaggcaggagaatggcatgaacccgggaggcggagcttgcagtgagccgagtgcatgccactgcattccagcctgggcgacagagcgagactccgtctcaaaaaaaaaaaaaaaaaaaaaagcgatacacattcaacagaagccccatcctttagtactcatacaaccattcttttttttttttttttgagatggcgtctcactcttgcccaggctgcagtgcagtggtgtgatctcggctcacagcaacctctgcctcccgggttaaagtgattctcctgcctcagcctcctgagtagctgggattataggcgactgccaccaggcctggctaatttttgaatttttagtagagataggatttcacaatgttggccaggctggtttctaactcctgaccaggtgacctgcccacctcggcctcccaaagtgctggaattacaggcatgagccaccgtgccccggttctcatacgaccattctgttttttcactttcagtacagtattcaattacatgagatattcaaaattgtaacataagctctgtgttagatgatgttgcccgtaggctcatggaaatgttctggcacatttgcagtaggctatgctaagtaagttatggtgttcggcaggttacatatattacatgcgtttttgacttgtgacgttttcaacatatgatgggtttgtccttataagttgaggaacatttgtagccatttcatcgtctgtgaagaggcctgagtggattttgtgctggagaccggtgtgactcagctccagtgttgactgaccttctaaccatgggcttgtgactgaatgtcctgagccttcattttcttccctgtgaggattaaaatgaacctcaggaaatgctggcttgtcctctttctgtcaagctgggttctgagggggtgagcccaggtaggagtgacttctgaaccagcccagatttacaggcttgggcatagggagcccagcctcagcctgggagcctcatcttccattaaatagctcctggcattcaggggagtgcgttgcagcaccccatttttttttcattgaagtcctgtcttccagccaggcacagtgaatcacttgaggccacgagtttgagaccagcctagccatcatggggaaaccccatctatactaaaaatacaaaaattatctgggcacggtggcgcacacctgtagtcccagcacaccagagttcaagaccagcctgggcaacatggcgaaaccccgtctctacaaaaaatacaaaaattatccaggcgtggtggtacatgcctgtagttcctactccttggggggctgaggtaggagaatcactcaagccgaggaggttgaggctgcagtgagccatatttgtaccactgtactccagcctgggtgacagagtaaggccctgtctgtaaaaaaaaaaaaaaaaaaaaaaaaaagtgctttcttcttcttcttctttttttttttttttttttttttttttttttgagacggagtctcgctttgttgcccaggctggagtgcagtggcgtgatctcggctcactgcaagctccgcctcccaggttcgcgccgttctcctgcctcagcctcccgagtagctgggactacaggcgcccgccaccactcctggctaattttttgtatttttggtagagacagggtttcacggtgttagccaggatggtctcgatctcctgaccttgtgatccgcccgtctcagcctcccaaagtgctgggattacagtcatgagccacgatgcccgacctctttcttatataatttttttttttaatcgggcagccctcagaatcacagcagattcagaaagactccccagaaaagttctttcactcctaacttctacccagcctcatggtcacctcagcagctctcctgagaccgttactaagttctccacagctaatggtaactcagcttggaaagagttctcttgtaggaggatgctgaagggaggttgccaagtggtgtgggaaactgcttcatgcttaagttcacttccatatcatgatactaaaaggtatctaacagctgattttcattgctttcatttgtgatctgctaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcatattgttcttacattagaagtttactctcttcagttatctcactgggcccttgagggctttggggaggagtgatgggaaatggtttacaattaacagcatattccaatgaagaaagaaagcatatgatgtctgcacaacagaggagagtgtccacaatgtacagctcttccctggagcagttatgtttctcagggtgtgcttttccaagtcattttgtgtctggttagaagccaccttcccttagcatccagaggtgccatgtagactagggttggtcacagtgtgtagattgccattgacctgcccattcctagtgtttgacctggtggtcatggcactctgaccacatcagttttcctctccaagcccagatgggttctcagaaccctccaccccaagctgcactcatgagaggcggcacttctgccatcctgatctagagcttgttcatgtggtccagaccatttctttgcagccccctctcctgtgtaaaagcctttaggaaagtgcagagatcctgatggattccccttgaccctcagcacgcacatcctggtatgtagtgctcagcactccgttgggggcttcagactggagaagagaaaactgcccttccctttcaaggacatcctccaagggccagaatgctcagttccgtaaaattaactctccactgcctacttttttttttttttttttaagacagtctcactctgtgccccaggctggagcgcagtggtgtgatcttggctcactgcaacctccgcctcccgggttcaagcaattctcctacctcagccttccaagtagctgggattacaggcatgcgccacctcacccagctaatttttgtatttttagtagagacgggatttcactatcttggccaggctggtctcaaactcctgacctctagtgatccacttgcctcggcctcccaaagtgctagtattacagtcatgagccaccatgcctggcctgctgcctatttaaatagcaagcagttacagttaaagaaagaccctggcctggggacgctgccaaggctcctaatctgacacttctttcatgtggaccagggatctgaactgtgtttcttccaaacttttggagcttgcttccttggtggtaagctaaatagtggcccccaaaatatacccctttataacccctgtaacctgtgaatattatatgacataatggactttgcacatgtaattaaattaaggatcttgagatgaggggattatcctagattatctgggtggacccctaaatgcaatcccaagtgtccttatgagtgggggccagagagagagattggacacaggagaaggaggcaatgtgactactgcagcaagatgctacactgctggctttggaggtggaagagaaggccaaaaatgcaacgaacgtagctttggaagctggaaaaggcaaggaaactgttttcccttagaacctctggaggaagtgtggccctgccaacacactgattttagcccagtgaaactaattttgaatttctgacctctagaactgtaagagaataaatgtgttttgttttaagtcgctaagtttgtggtaatgtggtaatttgttacagtgcagtaggaaactaatacagggctcatctgcctccaggtacaagtggtggcttggctgatccctgttcttattttaaggcgtccctctcatggcacaaggagagcataggcccagcattttcctgaaccagtatttgaaacaatctgcactttgggggaacctgttggggagttcttggaagcaagagagaaagcctcatatggtacccgatccttgctttggaactctcccagcaccttcagtgatatcatgaacaaagagttctttcagaccagtgaggatgtaggattattaaaatctgattctaattccatcttcccctctcctcttccatttattcaataaatgtttattgtgtacctcctatgtgctaggcactggggatgaagggataaacaaagcagataaaaaatctcctgctctcgtggtaactgaggtgggggaagtggagggagccagagttaagtcaacagcatgtgagatggcttcagatgctctctagaaaactaagcagaaaggagggtagtggcagttccacatagagggccggggaaggtctcaccacgaaggtgacatttaagtggaaagaggagagtgaactattgtgggaagaatctcgcaggcagagggaaagcaagttccaaggccctgcactgggacacagctgaggtgttcaacgcatagcgaggaggccagcgtggctggacagagggagggaggagaccaggagatgaagttagagacgagattggtggccctgaagtgccataacagcttttactttgcttggcattttgccccttctttctcctctcctccccctcacaccacctcacgagttttaggcccatgttcctcagttcctttccatgggatatttatcccatcatacttagggactaccagcaggcaaacatagtcacttaaaaatattagaagagggggaaaaagcagcctcctctttctgaatgatgaaagcagttccatggcagtgttggcatggcactgtgtatctagcagtgcaggctggccattcaccgcgtagttctgggtggtttctgagaggttcccctccatggccttcttcagcccatgaggaagtccaacccccctggcccgctgtttctttccatttcacccctcttggtctccccagtgggactcccacagctgacttctatccccacctgtgtctaatcccctttccatggctgagccggtagataacctagtaacgatctgagtagaatatggctcccacatgttgaatgcattgtgctgatcactacatatatcactttgattcacacaacaaccctgagaggtaggaaccattgtaccccttttagagatgaggatactgaggctcagactggttaggaaaattgcctaaagttgcacagctaatgaatggcagagctgggatttgaacccaagtgattaaagcccatgtctttgatcactacatagcagggccttctaggaaggatggctggctggatctagttgttccagtttggaaagtacctgcttgactggccagactgctgttggcttcagaaaatagcagtctcttgttggtcactgagaagaggcaaaattttggcaggccttggggcctcctgcagagtctcattccaggtcagtggacagaggaggccctgagaatagtcgtgcatactggctccctggatctgctccaagacagtgagcagcccctagaaccacaagagactggccagccaagctgtgggcccggcctgtagggtggaaggaactcttaagagaaaaaaaaaatctctgctgtgattaatcaacagcttcagtctggtgaagtgaaaagagaaaagttggcccagatgtgcacatagggagagaaataagggagggaaattgcctttattcatgttctcccttaggccagtcgttaccccacggatgagatcaccttccttttacaccagcctgcaagaggtgtgtagtggtagtctcattttacagacaaggtgtaggatcagagaggttaactcgcccaagtcaaacagctaacaagtggtggaattggaatttgagccctgttcttctcagttcagtagccctgctgttcttgctgatgtcacctcagcatgggctctccaggtatgtgcaaatagttatgcaagtgttgcatccacaggcttgtgagcagaggctgaaagggagccagggctcttggtacttgccctctcaacatgggccctgcctaagctagcaggactcactatacccaaaccagcagtggcattatatttttctcttttcttgcaccttgccatccccgatttatttttagagagccttttctatttctgttcccatttcttggcttggatgcaggggctggggtgcagggatggcgctagaaatcagaagaggcaggcatagatggcatctcactggtggccttggctggtctctgggaactgtgcccatctgcctgccctgctggctcctcctcaggccagctgtaggccccagggatcatagagctcgggtagctagaggctgggagggcaggcgagacagagaaacagccacacttctcatttctttggcttctcagagggggatgagcttcctcctggaacagagaagggagtagctcactgcctgtttctcagggttaggttacggacttctagggaatatggggtagtgcttaagagccagactctgtgtggcatgggggtgataactgtagaccctccacctctggggattaaatgagctcatacatgtaaaggcacagaggaggcactcactgaatgatgattgtttcattagtgtctttagaccctcagcacccagcaccataggtggatgccagtcattattggttagaccaaacagaacttcaaggcagctgggcatggtggctcacacctgtaataccagcactttgggaggccaaggtgggagggtcacctgaggtcaggcatttgagatcaacctgggcaacgtagtgagacccagtgtctatttatttaaaaaaataaaataataataaaaaaagaaaaataactttaatgttatttttgtcgtcctcttcatctgaacattggcctgcgtaggtattaacctgagtccagtgattgtttgtggagccccacagggtacttcccagtgacagcagcctggagtgtgctcctgccagcccctgcctgggccctggaaaaggcagggcagtgcagcgaggaatcttctggcctaaggatgcctgtaaccaccaaaccttatgtttagttttacaccttgctgagggtctggcttttggatatgagctctggagtggtaggggtctgtgtcccatggggacaggtggttctgggtgttgggcacgaggtgatggaggaagggcctgccacttgcaagctgtttatctgactagtaataaacagtggatgacacctttaggaaactgtatttgggagctttgaaattaatcagatgccaccaatggcatttttaatttagttaaaaatgttttagttatataaataatgctcattcgttatagatgattagaaaatacagataagcactgaggagaaaaaagtaatatattatcacacataagtggctgctttgatatatgatttttttttcttacctaggttcttttcaaattgtgtatacctagttattttttctgtctttcgaaatgggatgctgtttaacatttagttttgtgacttgcctttcccatttttcaggtggttttgtggtgtctgcttgtcctccgacctcctctcccatttgtgggaaaggcatttggcctggagggaggcacttgggaagaactgtctggttgttccttgatgttattgccagacttgcagagggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggtgctgtcttgagtcagtgagaagaagctgcgtgggtgatgggttggggcggggtaggcagcaggtgactgcagggacctctctgaaacagcaagcaagctggccaggaagacgcctggagaataaggggcccagataggggccagacataggggagaagaaaatgtgtctcagtggcacctgctcctccaccctggccccactctttccatgatctttccagagattctctctttttctgcctgatctgcttccctcacctggcagtgcccagccccagtagtttgacacatctggtatatctggctactgtgctctactgacacctgtgtggcagcagctgcacagcttcttggcatctccctgggcagtaggcagggatccgagcatagaggaagatgttccatgcatcagtaactcagattccgttccagaaacgcatctcaaagcaagggagaaaattgaagatggggtattttgtggggaacaagctatgccttcctgtcacttcttacagaataaaatggggtctctggcagtaggcaaggagaaggcctttctgagcactgagggtcagtggcttctcaggtcttttctgggccactttggcctgcacacaggttgggctaggaattcatgcttaaaagcaggctgatttccataggctgtgcgttcctgtgggcctgcctggatcatatctgttctgctgtgatcccaggcctggtgagacccactggcttcctgtacgtcccctcaaagcctgcgccaccgcctctcccttcaccactcccaagctataattaagttcccatgtgaaactgtatccctcagctgacacacgcttgtaactacagccctggccattggacggctcatctggggtgacttctggggctggtgcctcagcctccagacgctctccagtaggtctgagtaggtggtgtggacccaccaggaaagggtggatccagtgaggcgggggccaggccttgcccaagagtcagaaagtgggaagtcacgggggagatgaagggcgagtgagcagctagaaagtgccaggggacacaaaaatgggggagacaggcagccttttggggctggagggcatggacagggtgactgatgcctgagccacaggcagaatgtgagcagtttattttattttatattctacatatttttatagcataaaattaagatatagttcacataaccaaattcaccactttaaagtgtgtactttgatggtttttgtatattaactgtgttttatatattatattaaattaatatatttatatattatattaacggttttatatattattttagctgtgttgtttatatattatattaactgtgttctattaaccactaattccaggacacttctatcacctaaaaaaccctttacctgtcagcagttactccatcccttggctgctaatctacttcccttctctatggctttccctatcctggacatttcatatgaatggaattatataatatgtagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggttctcttgggaatatacttagtgaaattgctgggtcatatagtattccatgtttaacttttttttttttttttttttgagacggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggcaatctccccgccttggcctcccaagtgttactctttgttttttgtttgtttttttttttgagacggggtctcactctgtctggagtgcagtggcgcgatttcgcctcactgcaacctccacctcctgggttcaagtgattcttctgcctcagcctcccgagtagctgggactacaggcgcatgccaccatgcccagctaattttttgtatttttagtagagacggggtttcactgtgttagccaggatggtctcgatctcctgaccttgtgatccacccgcctcggcctcccaaagtggtgggattacaggcgtgagccaccgcgcccggccccaagtgttactcgttaggcagatacctgatacctgtctgctatactcactggtctgcaccttgcttcacttattatatcttggccatctttgcataccagacatgtagagcttccttattcttttttttttttttttttttgagatggagtctcgctctgtcacccaggctggagtgcagtggcgcgatctcagctcactgcaagctccacctcctggttcacaccattctcctgcctcagcctcccgagtagctgggaatacaggtgcttgccaccacacccagctaatttttgtgtgtgtgtgtatttttagtagagacagggtttcaccgtgttagccaggaaggtctcgatctcctgacctcatgatccgcccgcctcggcctcccaaagtcctgggattacaggtgtgagccaccacgcccagcccctcattcttttttttttaacagttggctcatccattgtatggatgtgccagtctcttcttttttttttttagacagatttttgctctgtcacccaggctggagtgcagtggcatgatctcggcttactgcaacctctgcctcctgggtcaagcgattctcccgcctcagcctcctgagtagctgggattacaggcatgtgccatcatgcccagctgatttttgtatttttagtagagacagggtttcactttgttggccaggctggtcctgaactcctgatctcaaatgatttgctcatctcggcctcccaaagtgctaggattacaggcgtgagtcaccatgcacggcctggatgtgccattctcttattcattgatgaatgtgcaggtgacttctagtcttttttggcaatgaataaccttgtcattttacacacagataaacagattgacaatgcttctgtgtgataggtgcagtaatggagatagacactggggaactagggaaggcttccagaggatagttaagaaaggctcagggtgagtgagcgctggtatctgagtgggccttgcaggcctggcagaatttcagcaggctgagatgttgtaggaagggcaaatatgactgaagaaaagaacaacagctcaggtgtgacaggggaaatgaagagtattagttatctattcctgcataacaaattaccccaaaacttagtagcttaaaacactatctcgcagtttctatgggttaggagagatttacacaaatatgtgaataccagaaggtgaggattgttgccagccattttagaaggctgactctaatagcaagttgcagtaaggataggattggccaaggcaacagatggagccatgattgtggacaatcttacatacttagctgagaggttgtcagagattgatctgagaacagtgtgagccatggaaggtctttgagcaggagaataatgtgatagttgctatacaggacaattaatctgatagcatttatgctagaggggtcaaaatggagagagatacacaggcagaggcctagattaggagatggctatagtagtacaggtgagaaattcctggcctgtagtactaaatacttttttttttttttaagacaatctcactctgtcacccaggctggagtgcagtggcatgatctcggctcactgcaacctctgcctcccgggttcaagcaattctagtgcctcagcctccttagtggctgtgactacaggcgtgtaccaccatgcctggctaatttttctatttttagtagaaatggggtttcacggtgttggccaggctggtcttgaactcctggcctcaagtaatccacccactttggcctcccaaagtgctgggattatgggcgtgagccgctgcatccggcctctgtattaaatactttagctgcatattctttcttcgaaatgaccacaaaaagaaggtattactgattaatatgcatatggtcttgcgtatggccagacttatgacttgcgtatggtcataaaggtagtaagttgcagagcagcactcagacctgcctggctttgatgaccgtgccttgatggcactggaagtggaaaggtgggggtgactggggaggtgaggttttgtccgttccctggatgctaaaaggaaatggaggagtgtaagaggttgattctttgaacctggatggctggggcaaagataacactgtaacaggaagaagagaggccggagggaacactgatgtgatgggagaaggtgagtgatttgggaacatggggcatttgttggcagggtccttcccaattatagggcgagtataaatagttcctgtgctttgtgtatgaagaggtacccttggcccaaaaagactctaaatgtggaaaaaggatatggtggtgtggtggtggtttgaacattgggtttgcgcagatagtgatggtaactggcactggcctgcgcttcagactttcacagcccgttcacttctgttgaaactcacacaaccctattcaggttatcatcattccctatctgattgatgaggaaactaaggctcagaaaaatccatttgctcaaggagaaacagtgtttcagttacctactgctgtgtaacaaatcacctgtgaaactcagtagtttaaaacaaccaccatttatcctttctcttgattgtgtgaattgggtccagatgcttggttctgccccacatgatgtcggccaagcttgcccatttgtctgtgtttagctgcactgtaatgtccaaggcagcttctctttgcatggcctctaatccttcaagagtctatcctgaacttcttgcagcatggcatctgggggccaagacagtggaagccagtcgtgttgaggcctgggctcacgtcccagaacatcacctcaatcatgttctattggtcagagctgtcactgggccagcccagattccaggttgggaactagacgccacctcttgatggaaagagtggcaaaaggtttgtagccatatttaatccacagacagccggtagtggatacctggatttgaacccagatctgtgtgactcagactcacagtctgtcatgccatactgcatccctttctgcttctggttccttgggagttgcaaagcttgctggctcttttgtgtggttggagagggctgatttttcttgtggtctcccacagtggaagttgtactagtcatcccccttttcacagatgagcatccaagatcactgtgtcttagggaaccttccaaaataggtttgctctagggatttgctagcttcccccaagcttcagcagtgatagccagacatgcatggaatttccctgtggagtttccctttctgcgcttagtggccttttgatgcacagtgctcactgggtgggattcctgctgcattgtagccagatgtggaggctagccctattttgagttatcccagatggtatccagcccagtgagtcccatacttgactcaactggcatattcaccagggagttttggggaaaatgtagattcctgggccttcctcatgcctattgaattagaattcccagggatggcgtccaggaacctgcctttaaagctccccattgatttgggagtacagcctggttgggaaaccaatgacttccagaggctggcaccctccctcagcccagtcatttcagaaagatgcctttgaagtcactgatcagaggaggccacatgggagagaatgatttgtccagagggcctcacacttcacaaccaggaagtgactcctgaaagtgtccaggaagtttctatttgaatctgctcaaatctttgatgttgttttgcatgctttgatagtatctgagctttatggtggcctctgggtgtttttctttgaaagtgtttgcagagagtagcaagctcttccagcagtcagcagacactccctaaccaggagctacttggtctgatttatttgaaatatgaaattcctttgcttggctgtctggttggtatctttggtgtgaagaatatgacaaccctagagatacctaggttagcacagcagttggacctttctagtcttgtgccttggacatacttaaggtacacttggaaaagtagattttaaaaccctggataatttggtttgccagttaaataaacttctatattttagaatatttggaaaataaagataaatataaggaagaccataaaattacctagaactttcctctcagagaatttccacggttaatgttttgaatggctattcatccttcccctcatgacccttcacaccccctctttttgaaaaccatattgaagtcatattgaatgttactttttagcagttttgttgagatgtaagtcataaagtccacctgttgacagtgtgcaatttgatggtttttagtatttacagagttgtacaaccatcaccacaatctagttttagaacattttcttagtcccaaaaagacatcttataatccattagcgtgcattcccgcctcgatgccccatcccgcccttactccagcccaagactaccactcatctgctttctctacgtacagatttacctgttctggacatttcatataaatgggatcatacaatatgtgatcttttgtgattggcttctgtcactggacataatcatggtactgttttgaaacctgctttaaacatttatatcctagcaatttgaatatagttttcaagaatgcacttttaatagcagagcggtattcattcttatgagaatatctaatcttatttaatcagtcctgccaacagacgtttaggttatttctcatcttttgctcttatagccagtgctctctgcactcagaaattattttgttgatttattggttaattgtccgaatctgtgactagaacaaaagctctttgagaacagtcaccttctctgtctcccctactacttggcatagttcctggcacttggtaggtattcagtttttaaaggatgtgtatgtgtgtatatgtgcaaattttgaatgaatcaaaatgtaaggatattaataaatgttgccatattgccaaattctagaaagttgtactaatttaccctctcactgcagtataagggtacctgactccctgttcctttgaatctgggttaatttgtacaggaagtcctgtgatcttttgaatgatgatattctctgacctgtcaaccagttagtttgggaattgatgctgtctgtgtcctgaccctgtctgtgggccaggaagggtctggctgttgggaaagatggtggtgtgtgggagctctagctgcccgggtcctcattgtggctccgtggtattgtatcgtttcctgttgcccttagaaaggctgcatcgtgttgtctggccacttcctctattgtgtgcaggcatgttggggagtgagtagagttgggtggataaagtatgtgtaagaagatactggttatggctgctgattggagtgccttttgaagtcgtcaggagagatgtcactctggaagttcagtgtcttcaaaaatagaaatgaagaaatgcttccaggaagtctgatgcaactggcccagtctgcccccatctgagggtggtgggcacccacatggctggtaaacgcttcatgagtcacccactggccacagtccctgctcctctccacacacttcctgtctggaaaagcctgctacccgcccatggtgaagagtcaccccagagaacttgccagggatgcagggcaggtcttcccaggtcacagcagcagcctctcgctcatgggtttcacagcagttcttctccccaagatgagttgtggtaactgctttttagataaatatgtggaatggatggttgggattggaaaaaaaaagagcggctagatggcaaggcagctcttgtgtgtagcagggagctcacacgagccccatggtggggcagttaaggccccagaattcaccttctccagcagctggctgctcattcttttcttcttctcgtggttttcccatcacatttcccttggggtttcttccaggccttcccctactcaccccacaccctctcagaagatgctgcctcatgtaacttggccaagctctcaagcattacagatgcctttaccttcttttctttgcatcttagaaatcactcacatgttggtctctctcacataattgctttttattattacttcagcggttgccaagtgcctactctatgcctagtaccttgttagactcgggaatgatgcagaagaaagagactggaccctgccccctaggagggtaaatgtctgttctcccatggcctctgtttcccttcctctctgactgcgcctttgctgccctggttcctcttcctctttccgctgcctgagtgtcaacattcttcaggcttctgccctctctcctctccctccacgcgcttgtcccttcctgtggctgtgaccatctgctcttatagctaccaaatactaaagttcttttctcctgaaaaccaggtccctgtgtccacctgcctgctggagtgtgcagccttaaaagcagagtccatctttgtctctgctctttgcatatcccctttctgttaataatccgtcattctctcagtttcccggagccttactgacagctttaaacctcattcctctgccatgcacaggtcgttcctcccgttcttttgagtgtttctccccactgattttcctgcctgtagtgagttggatggttgcccctccaaaagatatgtccaagtcctaacccctagaacctgtgaacatgaccaccttgtttggaaaaaaactcattgcagagattctttcctatgctgcagacgtacatgaacctgtgctcattgacctcctctctgggcctggccttgttggtctctggcttgaaatagtgactgtacttctagtccacacagtgattacatatttattactctgtttgagctcccctagtccaaaggcaaagttcactgcctgccctttccactaactcctaggtcagacttgctaggttgtgtgcacagcagctacaagtgtggtttctaaggtgggtctgggtttgaatcctggttctgtcatttattagccaagggcctttgacagattgtaacctttctgggcttcagtttcctcttctggaaaatggagctaatggattgttgtgagaattagattgcatagtgtctagcactgtgcctgacactctgagctttatttttatttatttttattttttgagacggagtctcgctctgttgcctaggctggagtggagtggcatgatctcggttcactgcaacctccacctcccaggttcaagccattctcctgcttcagcctcccgagtagctgggtttacaggctcccgccaccatgcccggcaagtttttgtattttttagtagagacggggtttcaccatgttggccaggttagtcttgaactcctgacctcaggtgatctgcccaccttggcttcccaaagtgctgggattacaggtgtgagccaccacgtccagcccactctgagctttataaccagagagatgctgtggctagccaaatcgctcaacctatacttggaggatcccaagcttggatgagtgtaagagctgtgacttaaatccagcctacttgtatgtcattctgccacagttgtctttgtctctccacagtttgtcctggagctgggcatggtgagggctaagacaatggattacagagctacaggtctaggagggcatgtggaattatgcctatatgagatagatgacaaagtgggtaagagcatgtgctctggagttagacctgggttcagattcaggctctatgaccctatctcagtgaccttgggaaacttttctttgcatctctgggtctcagttttctcatctgtaaattgggaataacaatggttcatacctgtcttagtctgtgctgctataacaaaattcctgagatgggtaatttataaacaaaagaaactgatttctcacagttctggaggctgggaagttcaagatcaaggcattggcagacttgatgtctggtgaaggctgctgtccacttccaagatggcaccttgttgctgtgtcctccagaggggatgaatgctgtgtccttacatggcagaagggtgaaagtggcccagctagttccctggagcccttttataagagcactaatccgttcctgagggcagagccttcatgacctaaacacctccaaaggccacacctcttaataccgttgtattggggattaagtttcaacatgaattttggagggttcacaacattcaaaccatagcaatgtcttatagagtaatcgggatgattaaatgaaagaatgcccataaaacattgaacacatgcctgactctttgtaaacaataattattaggtatcgctattatagagaccagcttctgctgtggagagtgttaagtgccttgatgccacaagccactggacacgcagctgcatggatcaatgtacccctgtaattatgtaacaaggggacatggagaaaaaaacatttccaatgttgcctcctctgtaacatgattgtacccctaaactgcacagaggagctttctgttctttgaactccatagctgttggtacgtctcttgtggggtttgccatagtctgtcttatactatgactgttcttcactctacggtacatttctttctttctttgtttctttctttcttttttttttttgagacaaagtctccttgtgtcatccaggctggagtgcagtggtgcaatctcagctcacagcagccctgacctccccaactcaagcaatcctcacacctcagcttcccaagatgctgggactgctggcatgtgccaccacacctggctaattttttttgtattttttgtagaaatgggatttcaccatgttgctcaggctggtcttgaacttctgggctcaagcagtccacccatctcagcctaccaaagtactgggattgcagtgtgagccaccacgcctggcctactgtatgtttcttgaggtcaagattgggcactgggtaactgattacttgaattgaaccttgggattcagccagtgaaagtggtccacctggcagtagtgaacctctggctcctgacctctgctgctggtgaatctgtttctcctatggctgcacagacacagggtttcctgcctccaaagagcttttccactctgtacatgggacctgaaccggctccagaaaccttggagcctggcaccacttttcacatcacccagcaggagcagaacttagatggaccaggcatagatgggaaacatgggtttattgctaaggtcatggttagttctcggcggtggggcgggggggtttagtgggcaattgctttttggatttttgttttgttttagaagtaaaaaatatgggccaggcgcggtggctcatgcctgtaatcccagcactttgggaggccgaggcgggcggatcacaaggtcaggagattgagaccatcctggctaacacggtgaaaccccatctctactaaaaaatataaaaaattagccgggcatggtggcaggcacctgtagtcccagctactcgggaggctgaggcaggagaatggcgtgaacccgggacacagagcttgcagtgagctgagatcgcgcccctgcactccagcctgggcgacagagcgagactctgtctcaaaaaaaaaaaaaaagaaaaggaaaaatatgtacatttttaatagtggtagtaagaattttctgtaactacttacgggacatcttcactgaggggtctccagagctcctaaaactcagcactcccccagtgattcttacattttcctgccagacttgctcttcttcccacaatccccaccttaatggaatcatccacatccccctggtcacctgacagttgccctctatttctttattctcctcagcctcttttaatcagccaccaagtcttgtttgtccttcctccctaatgtcactcctgttttttgccgtgaggtctgatggcactagtgctgcctggggttgctactgcctcatctcttcaacctttttgtgtcacgatgtttaggagtttctttcataaacagaatgtggctggatttaaatcaaatctgacaatctgtcttaagtaatttatgtacatttttgggatttaacttaacgtattactgtattatattttttagtactttccatgtatttccatttttgcctatttttctccttccgagtttttttttttttttttttttttttggagatggagtcttgctctgtcacccaggctggagtgcagtggtgtaatctcagctcagcgcaacctctgcctcccaggttcaagtgattctcctgcctcagcctcccaagtagctgggactacaggcacgtgccaccacacgcggctaatttgtatttttagtagagacagggtttcgccatgttggccaggctggtcttgaactcctgacctcaggtgatccacccacctcggcctcccaaagtgctgggattacaggcatgagccactgctcccggcccggaattttctttatttctatacattttacttccgttgtttttttcttttttgagacagggtctagctcttttgcctaggctgaagtgcagtggtgtgatcacagctcactgtagctttgacctcctgggctcaagcaatcctcccacctcagcctcctaagtagctgagattataggtgcacaccaccatgctcagataatttaaaaaaaaatgttttctagagatgggatgttactgtgttgcccaggctcgtcttgaactcctcactcaagccctcctcccaccttggcctccaaaagtgctgggattacaggtgtgagccaccttacctggcctttatttctgttcttactccaacattttctcatcttttctcccatccttttacttagaaaaatgttaaaattagaggaaatagtacaatgaacatgagtattctctttaatcttattcaattaatatatttctctgtatatgtatatatgcttttgtttggaatcatttgaaattaagtgtggatttgttctccatcttcttgctcaggatttggtgtgctgcttttatctgaggactcatttataaaagaaaaaacaaagaaaaagcctttttactttaaaatgattgtagataaacttagctttacacagagtttctgtattccttcacccagcttcccctaatgttaatctcttacatttaattctttcttaagttctggaaaatttcagccattgcctctttggctttctcgttttctctacagtggcctctggaatgcctcttagacatattgttgagcattttaccaccaaagtctctatatttgttctttctgtgttcctttatctgtttaatcatccaagttttcttgtgtagtttctttgagactgtcttatttctgattcttgggatgctacttctctttttgtgtctgaggcttgcccctcttggtggtttatttccttgtgtggtttgtaactttgggtgtgagttcatctccaggagggattctcttttctggctgagacttgggtcctgaattatgaaagtatacctcagagcagcttgtttgcctctggcggggccatgagtgtttcagtggtcctggctcagtttttgttcactgcttagtgcggcacccctttactaccctagtagtgtaagttcagttttatatccatgggcaggactagcttggtggcttaagaaagggtgacctcccgccgggcatggtggctcacacctgtaatcccagcactttgggaggccgaggcagggggatcatgaggtcaggagattgagaccatcctggctaacgcggtgaaaccccgtctctactaaaaatacaaaaaattagccgggtgaggtggtgggtgcctgtagtcccagctgctgggaaggctgaggcaggagaatggcatgaacccgggaggcagagcttgcagtgagctgagatcacgccactgcactgcagcccgggcgacagagtgagactctgtctcaaaaaaaaaaaaagaaagggtgacctcccacccatacctgacccacagagccttggagaagtgttcagcttcttgttgctttcctttactgggcagccctttgaggctctcttcttgatactggggctcaaagccacaggcaggctttaaaccgcttcatttgtgggtgcgaaagtccacaggccattgtggtgtcagttccactcactgtttatgtttcaattcttctcgcacataggcatttctctttccaatttggctgcatgtctacggacgtcatttgttttattttatctggtatttttctgtgatagtggtggaaaggggaagctctttcacgttaatttagtcccgtatcctactgaaagtttgttcaaatgcttagcgtgtcatatgaagcttttcatgatgcagcccattctacctctcctgcataaacttagctcttaaattttacacttcagcaaattgaactatttgcataccatgtactgtaatgtttaaaagcacaggttttagggtccagctgtttggcttggaacctgtcttttcataaggtatgattttggacaagttacttatcccttccataactcagctttctcatctgtaaaatggcagcgtccggcatgcagtaaccctgatccctgttggctgcctctgtggttgctgcccccagcagttgaggctgccaggcctctgcgcaattgcactgtttattcctttgctggaattgcctgtctcccctcctctccttgatccctcccaggagagcagcctttactccttcagagcttggggtctctgtctgtagtaactatcactctgtgggtcgctgcttgtttacgtatctttttttttttgagacagagtgttgctctgtcgccaggctggagtgcagtggtgcgatcttggctcacggcaacctctgccttctgggttcaggccattctcttgcctcagcctcccacgtagctgggactacaggcgtgcaccaccatgcccagctaatttttgtatttttagtagagacggggtttcaccctgttggccaggatggtctccatctcttgactttgtgatccgcccgcctcggcctcccaaagtgctgggattacaggcatgagctactgcgcctggccacgtatctccttttttcagccgactctgacccccttgagagcagggtcttgtttttcttggtacttgaaactccttacattctacctgtcatttggtgggcattcagtgttggtagtttaattgcattgaatttctctggctgagtagaggcaagtgctgggagtggtatgggacgcagaggcagggaatgacagcaggaaagcttgttttttggcacattttgtgccaagttgatggaaatgtgaatcagtatggctgggacacaaggtaacaattcttagtctagctgaggatgccagagacttaaaacaagccagtggccagaaaaagccactaaatcttgcaaattaaagtggtttccagacttaagaatgcatgccccacattcccttcccaaactcagcgtctctgagtgccaggtggaggaatacaaactaattataatcctagtgggccctgagaatctttaattttagaataaggctgcacttctgaaaggcgcagttgctttaggagtaggtgactctgtatgcccggggcctccgaggagaccaggatgtgaaaactcagtacctggcatttagagctgtgtcacccatcacttctgacctcgttaagatttctaccctactgcgacttaacaactaaaaagggcagatgagataggtccggggcagagcttaatggcctgtgtcattctcctcagctttgcctgaattctctggactcttgagactctatcataggaatattctcagaagagaaggcaatcgaacctttaaagatccccagattatccatcagataacagtctcatgagagtgatgaacaatgacagcaccaactctcaattcccttggctggaatttcaggaatcagcttgaactcagaggtgggcacagggttagggcttggagtaggcgtcttttctttctttttttttttttttttcttttttgagatagcgtctcactcttgttgcccaggctggagtgcaatggctcaatctctgctcactgcaacctacgcctcctggtttcaagcgattctcctgcctcagcctcccgagtagctggggttacaggcatccgccaccacgctcggctaatttttgtatttttagtagagatggggttttaccatgttgcccaggctagtctcgaactcctgaccttgtggtctgcccaccttagcctcccaaagtgctggtattacaggcatgagccaccgcgcctggcttgcagtaggcatctttgcccaacccacgtgaatcccattagttctttcttgacagctctcagtctgtggtcatatattaagcaactatgtgttcagtactgtgctgggtgctattgctgaagatacggaaatagtaatgccacaagtccctcttcttagagaggagagcttgcactctagttggagagaattcctagcacacagaaagctgcaaccagtggtgcccaacagtaatgctgtctgatgccactgcatgcaagtgtgtccctttgacaacttggtgcttttgcccaaaaggagctgttctctttctgaggcttggactattcgtttgttttttctcagatgacttgctggcactgttacagactggtctgaattaactaggactaccttttatctgtttctgaggaatagccccaaatgtgctctctcttggtctttatgaacttttcctttcttccatttctccaaattatgatagattaactttgcagtgtcatctgctaatctccaaggtcttctaggggcacgtcatcagcagttgctgcttttgaggtatcaaggtttgtcctgtggagtctcagatagtttctttacctgttcaatgaatctgattttccatttttctaggagagtgtatctcaaagtgattgctgaatcagaatgtctgggagtgtgacttggaatctattactgaagattagaggaaaatgtagcaaattgtgatctgaagcatttatggatggattgatggattgatggatagggattctgactgagttaggtagtctatagtctcagacagttgtggaagctccattaggtcatgagcaacccagactccttccaattctgtgccctgccattcttagggtgtggctgctgtcctcatggtccaaaatggttgccgtggttccacatctcacagtgagatagaagaagacagaagaatgatgtctcacctcccttctaaggagacttcagcaaagcctgcctctaccactttctgtgactgagggaaagttaattcatactcagagccaattaacctcgtgttttttttttttgtttgttttttttttttttttttttttttttttttgagacaaggtcttactttgtcgcccaggctgtagtgcagtagcacaatctcggctcactgcagcctcgacctttcgggctcaagcagggctcctccctgctcagcctcccgagtagctggaactacaggcacatgcaccacacccggctaatttttaaattttttcgtagagattgggggtcttgttatgttgcccaggttggtctggaactcctgggctcaagtgatcctcctgccctggcctcccaaagtgctgggattacaggagtgagccactgcacccaaccagttacctcatttgtaaaacaggcatggtaacacttagtgcaggagcaagaggatcagggagcacacatacatacaaagtgcttggtgctgatgcccagcctgcagcacctgttctctaaatcatagcagcaattgctgctgcagcacacttctctttctcctctctccaccgctccatctctccagggtctctaccttgcctgtcaggctccactttcctttgctcctgccttttgcatctgttcctctctgcattctcccctcatctcctctcttccgtgcacctcattttcctgctcccctcctgcctctgtccctcatcttcttttcagagacttaaaaccagccagtggccactggcttttcagtgtctcctcctcctccttgaactacctcttccttctagtgcttctgtccttccctcctcctgacctccagtgaacaataattatttgtaacgtaatgacaaattatcgttacgttacaaagaccagaggttagaggtggtgattggccttgtaaactgtaggtcagcgatgagtaatttaagaaaactaaatttaattggtttactcatgagtcagttaggaattctatttggcagctagaacagaaatagcagtggcttaaaccagtagaaattttttctattgtgaaaagaaatctagggggacagtctagggcttgtctctccgctctgccatccttagtgcagggcgtccaaccccaaggttgtatcatggtctaagatggctgcgggagccccaaccatcatgtcaggttctaggaagaaagcaggaagaagagaggaaaggcaaaaagaacacatgctccatcttaaggagctttcctgcaagtcccaccaaatagcttcagcttctcctccttgcctccattagttgcaagggaggctgagacatcatttagctgagcacattgctacctgaggtagaattgggattctgtcaccaagaaagaaggggagaatggatattgtgtaaacaattagcaaggtctgccgccattcattcaacattaatttagcacctacaatctactagttatgaagaacagtcaaggtgccccattccagagggaagacatagataagtaaacaagtacagtacacaggatgggtgaggaagagggggagagtggagaaaggcatgaagtgggtatcttacataccctccaagggcgcattctagagttcgtcatgcagacattcttgcctgtggtttgtttcctcttctgctctctcctttttgtcattgtcgccattgttgttgttggggtttgtttttgcccctccattctgacgtcagcagtagcccctagaaccttaggaaacagaaacagttggcctagtgggaagctctgggatgggagccatgtgtttgaagagccaagtcccagggccattaggcaattagaggcctgtggcaggagagcattcgttcctggacatgccgtggcactgccaggagactttactccaggaatggggtcgttgtcaggaggcatgttctaaccaggcacctggcatcacctatactgtgcttgccataaaatgaaattttggagcagtaaaattctccaggtcccgtgaaatgggtataattgtttcacccacattaatttaaccagaggtcttggtatgctatagtgttaattatgtgtaaaaatacttctacttactataaaatgtattgacagttagacattgatattccttcttagaactcaaaaattctaggaataacttgggagacccacattatctttcattttgatcccaagaacatctattgctgtttcctttgggaagttagagaggcaatgggaagcctgctgcagagattttctaaacaggcatatcccagcccctaaggagtttgaaagtgtcagagaaggctaaaggattaaaagatcgtttgttctggcacagtgcaatccttatgaggttgtactgtgaccctgggcaagttaccatcctatcctcagtttcttcatctgtcaaattttgatcctgtggaccctccccaacagggctgtgatggaaatgaagagacacatgggaagcattcagtatgtgttgttgttattatcatcattattgttatttttattattattagtgctactggtagtgctagcccactagcccactgggcagcgactgcacccgtatcagagtgtggaaagccttggatgccacattaaggagttggattttgtgggcaagggtgtgacaggtcatggctgggcttagaaatgtcactgacaggagtggagaggcagatctaggtgaggagtgggcagggcttgaacctggccagtcaaggaaaggggagaatggatacctgagtggtgagggaggacccactggtgctggagttcagcctgtgtgcccaagggatggtgtcccattgacttgggtgggaagcactagaggtggagcagttggggtggcaggaggggaaagaagcatatggtgatcagctcagcaaacaaatgggtaacttgcgcactcagtgctcggtggtgcccaggctggagtgcagtggcgtggtcccggctcgctacaacctccacctcccagccgcctgccttggcctcccaaagtgctgagattgcagcctctgcccggccgccaccccgtctgggaagtgaggagcgtctctgcttggccacccatcgtctgggatgtggggagcccctctgcctggctgcccagtctgggaggtgaggagcgtctccgaccggccgccatcccatctaggaggtgaggagcgcctctttccggccgccatcacatctaggaaggaggagcgtctctgcccggccgcccatcgtctgagatgtggggagcgcctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggcagccaccccgtccgggagggaggtggggggggtcagcccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcccggccagccgccccgtccgggaggtgaggggcgcctctgcctggccacccctactgggaagtgaggagcccctctgcccggccagcggccccgtccgggagggaggtgggggggtcagccccccgcccggccagccgccccgtcagggagggaggtaggttcagccccccgccaggccagccgccccgtccgggagggaggtcggggcgtcagcctcccgcccggccagccgccccgtctgggaggtgaggggcgcctctgcctggctgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcctggccgcccctactgggaagtgaggagcccctctgccaggccagccgccccatccgggagggaggtgggggggtcagccccccgccgggccagccgccccgtccgggagggaggtgggaggggtcagccccccacccggccagccgccccgtccgggaggtgacgggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaaaaaacaaatgggtaacttgctgcctgccagggactcctgtggcctggcatgaagataattgactgtgttttgaacgcattataaggcccctgcgaggcctccgtgtggtatttagacagtcagcaggagagaggccccggacagtggtgtgggatgcagtcccggtgtgtgaaattgccagtggttggattgtgcagcggatggattgagcagggaagccagccaagaacagaatggggtggggagggcgttgggggtaggaaaggaggatcatcatttcaagggcgggtgagggaagaacaagcagcagagtgcaaagcccccagagggaagggcgatccttatgaggttggactgtgaccctgggcaagttaccctcctgtcctcgggaggaagtggttgacagaatcattgcagcagtgagatggaagcaggaccagggcagcagccaagggcctcttagatggcggggcgagaggaggtcatccaggacctccaagagaactgtttcaaaatgggaggagaaagcagtgttcctctggtggtggttctaatgctttgtatttgtagttcttagtcgttttcaaggccctttgcattctttgcatcgtgctctcttaccacgatgcatagtgagaccccacctctacaatttttttttttttttttttttttcagtgagccaggtgtggcagtacacacctgtagtcccagctacttgggaggctgaggtggaaggattgcttgagcccaggaggttgaggctgcagtgagctgtggtcatgccactgcattccaacctgggtgacagagcgagaccccatcttaaaaacaaacaaacaaacaaatacttggttcatttggtacttggctttttggatcttggggaatattggagatgacggaataacttcaaggagactaacttcaaggtcaagactcctgccaagactccaccagacataaaataggaaaatgatgatagaatctacctcactgttggcctggcagtgggagtttgttgataaccctgaagatgaactcctcaaggtgaagagcaaggcttcagaatgggctgctctatagatgtgagagacagagacagacctagccttgcaaaaaggttgctgtagtctttctcctaccatttccagcacaggatggtttctggtcccaggaggccctgtcttgtgctgtgtgggacccttagtgctgtgaagactagcagcaccctggaggtctttgttccttctgccctttcccttagattgcatctcctaaccttggtttatatatttgtcaggaggtgggggaaacctgctttcccccacctcctgacaaatatataaactggaaattgatccagtcctggatcagtttgggtcacacaacagggtcggcagtgttggcccacagagggccctgggccccttatttcccctttggccctaggctctgagctctcaggttttggctaccaagcaaaaggtggagttgcatcagttgttgctctttaccaggcccccaggggttgctgtcggtgagctcacaggatgttttcttctctctgctttgacttgtgctgaatttctgactgaccccatgcagcatctgcgtggcttctggggcccgagcccaggtttcagcaagctgcccatggtttaccctcaggatgaactctaggaagctggggagcactgtggtggtggtataagttcagcccctcattttagtttatttttatgttaaaatgtttattaatacaaaataacacatagatcagaatgttgtatgacagaaagggactgactggactcaggatctcccaccccagccccaggggtgaaggtgaaggtgattggtttcctgggtatcgttccttccacggtttttccatgcacgctctcatgtgcgtgtgtttttatcctcatcctgctcttcaccgtggcagtggggagcacactaaattgctctgacacctagttagttttttttttgattgagtgtatcttgggaatctttccatatcagcatatacagatacactgcattctttttttttttttttttttttttgagatggagtcttgtgctgtctcccaggctagagtggaatggcacgatctctgctcactgcaacctccacctctcaggctcaagcgattctcctgcctcagcctcccaagtagctgggattacaggcacccaccaccacgcctggctcatttttgtattttgggtagagatggggtttcaccatgttggccaggctggtttcaaactcctgacctcaaatgatctgcccacctcggcctcccaaagtgctgagattacaggtgcgagccaccacacctggccattcttttttttttttttttaaagcttttttgttgtacatatgatgtatgttaggtggactgtggcttataaaacctcttcatagctgttttccagtgcgatccttctagccctgtgaggaagacagaccagaagaaattttttgcagcttaggatactctgcaaacaaggaggaagtgagaggagttggggctcatttaatgcagactaaaacaggatctttcctttgagagactgagacaggatgaggagcaggctgtagatgtgcacacatatccactcagagagaacatgagaggcagcatctgcagaggagcctggtgggcagcacgtgccgcgggggcaggaaggggagagcttccgggaaggggatggaacttgagccaaacctttttctcaaaaagaggggaggccgggtgtagtggctcacacctgtacccagcactttgggaggctgaggtgtgcagatcacttgaggtcaggagtttgagaccagcctgggcaacatagcaaaaccccatgtctattaaaattacaaaaagtagccgggcgtggtggcgcacacgtgtaatcccaactactcaggaggctgaggtgggacgatcacttgaacctgggatgcggaggttgcagtgagccgagatcgcgccactgcactccagcctgggtgacagagtgagactctgtctcaaacaaaagaggggaaggtaggaatgagacaaaggaaaaggggaggcgggcatttcaggcaggagagcagcataggcagaaggtgcaaacatgtggcagagggtcggtgtccatggacacgcttccaccacctggtctaatcattgacttatcagacatctaaatgcctgctgcgtgcccagcactgtagagggccacaaggcagcaggaacctctcagtgcctgccctctgtgggctctgactccaaccaggagaaactggacgcacaacagcaggcaaaactagctgatggtgatagaggtcagaagagtggtttacagccaggcacagtgactcacacctgtaatcccagtactttgggaggctgaggtgggaggatagcttgagcctaggaggctgaggctgcagtgagctgtgatcaggccaccactgcattccagcttggcctggacaacagagcaagaccctgtctcaaaaaaagcggagtagttacttattgtggagattagctgttcaggggcacaaagaaccttgtagggtgctggaaatgtttactgtcttgacctgggtgatgggtttttttggtttgttttttgtttgtttattttgtttttttgagatggagtcttgctcttgtgccccaggctggagtgcaatagcactatctcggctcactgcaacctccacctcctggcttcaggcaattctcctgcctcagcctctcgagtagctgggactacaggcgcctgccaccatgcccggctaatttttgtatttttagtagagacaggggtttcaccatgttggccaggctgatcttgaactcctgaccccaggtgatccgcccgcctcggccttccaaagtgctaggattacaggcgtgagccaccgcgcccagcctgggtgatggttttatggtggtatataaatgtaggaattcatggggcttattatgtttaagattaatgcagattgcatactctaaccatgagtatgttataccccaattataaatcaagcaggcaaataaatagcatattccccaaaataaagaagtaaaatgcaatagcaagaaagtgtgcaaagagctatgcctgggaaaatacaggaactgtatcattttgaaagggtgagagatgagatttcagaccctcaccctctctcactgtgtcatttctgaagggccctggtgactttctttgcccctctccactcttacagtcattggaaccagagggcagaaccccgggcctcaaaattaagtctatacaccttagaaactaggaattcaaggctagccaggtcctggccctttatctgtccttcagagagtggggtgccccagccaaagcggacagctcgccattcccagatgtgccctgtgttctcggctgcgttgcctgactcaccttggccttccctgggagtgccttttctagttttctggcccagctagaagaaagggccattacacctactccagaatcatccctgctgctcccaagttggaatatttcttcctccacagtggccacctcttatgtgccctccatcacacagtttgtatacttacctcttcaagggcaggctgtgttttactccttttgtcatctctccccataggggtctaggtcagtgcttttgtacatggtgcctgaaacagtcccataaatgatattttatttgagtggggctctctggctggagctactaggtggaatgttgccatgtgggagcaggggtcataacgaaggctggccatcaagatgctggtacttccaaattcccaacagttattaactttcaggattgaggaacaagtaatagaaattccctggaatgcccaaaatcataactttttctatatctttcctaacactttatgagtttttaaataaggagtggtcataataataaatggaattattttttctgtgataaaatttcagaggtgtttctgtaaaaaaaaaagaaagaaaagaaaaagagaaaaaaagatgtaacattaaatgcgtggtttggtggtttggttgggcacagtggctcacacctgtaatcccagcactttgagaggccaaggcaggaggatggcttgagctcaggagtttgagaccagcctgttaacagagaaagattttgtctctattaaaaataaaaaaaattagccagcatggtggcatgtgcctgtagtcccagttactcaggaggctgaggcaggaggatcactggagcccaggagtttgtggctgcagtgagctatgatagcaccactccgggtggtgacagtcttggtgacagagtgagaccccatctaaaaaattaaaataataaaaataaaataaatgcatagtttattgttattatggacaaatatattgtgatatatgattgtatatatttcattagcatgtaaaaatgatctctatctgatatagacatctgataatagaaaatgcggaagagagcattaacacaaaatgaataccaaataaaaatcacttaatgatttaagagtaatactacacatatttaatatttaaaagttactcttaaaggttaaaactagagaaaagttaaaagaataaaacaatgaatttctgtatttccttcaccaagattcaccagttgctaacagtttggcgcatttgcttgatgtgtcatagattgtccacattccatatctgttggattgtttccttgtgattagattcgggtttacgttgttggtgggaacccacatagatgaggtgtgcttcctgttgcttacatcaggaggcacagtggtgccagttggccctagtaaaagtgatgctaacttgattcacctagttaagttggcatctgtgaaggctacttttgtattaaggcagtgaacttcgaaaggaacttttccctgactttgggaattgctgacagccatttaggaaaagagacgactgttttctctgtcacgtgtagctgcagttaagaaacatcctagtatagtcagacaagctctggaagccagtatgtcaggacctgggaccaagctctacagccatctctccctgtgaccatagccaagtcatttctgagctatgtgagactgtacgtataaggaaatagacactcagagaagtgaagcagtttgcccaaagctactcagctagtgagtgacagagctaggattcaaacccatttttgtctggggacaaagccctgcccttgtccttatgccaagctgcctcctttgtgaggcagctggttgttatgattgtggcactgaccactcagatgttgtgctcggaaccaagcagaagagcaccaagccttataggccctgacaggtgagagggaagagagaggtgccttccttcatccatctggactgcccttggaattcctgggccaatttggggaaccctggcaccaaccctaacatgggccagtgccagcaccaggtatatgcagcctgtacttcccagtctgggcaggcaaaggctggaaccgcaccagcagctctcctctgtaacgcagcacggaagtatttatttcaagggtggctcagagaagtgaagcagtttgcccaaagcaaactggttcctcccctgcatgtggcaggctgtcctgcaagctgggaggcgggctgttggacgctccccagccacccttgaaataaatgcttccatgctgtgttgcagaggtgagttgctggcaccgttccagcctccgcctgcccagactgggaagtacaggctgcacatacctggcactggcccactttagggttgatgcatgggatccccagattggcccaggaattccaaggccagtccagatggatgaaggaaggtattgcctcagcctgcctgggttcctcgggggagagagggagacaggaagcattaatgggggaaaggtgtgccaagccttgccaagcaggtcattgtgggtggggagacaccgcctacgtgctcgggacgccccaggatttgggtggaggttcttgaggaggcagcgagaaaggagagctgtgacagcgactctggagcactctagaatggctcttagtgaccttctgctctggtgacccaccagcagcccaccaacctgtcatcttccagttagcagccatccccagggccagtagcacctgagcacttggtaagtagaaagacccagtgtctgctcctcatgttaccctggtgtccttccccagagcagttgttttgggaaaaactggctccggctgaagcaggaaatggtgctccttgtcaaggtcatgttgtcctgttgctatagaactgagagaccctgaggatcagccctctgaggttcctgttacctctctttacactattcatcctcataggcctccaggaagggggccaaattcagggccaggaccagggccagtggcttggtgaggcataggctttgctgtatgggccctgtggggagctctggggagttcttattcccctggctcatggccaccatcatggagagacccccagggctctggcagccaagtgggcaggagcggagggagggggcatcttgggagggagagccccgaaaggaaacagggtttatagacagactcccggtcatcactgcttgtaatgcttgctcagtgaacagtggcagtgcttttcctgactctttcaagagagtcccttctctctcctgctaggtgggctgagatccagactggttagaagcctaacatgacctggcgtgtgagaccttgcactctctgaatgtattccccaagtgtcatcaataagtcactccggttctggcatttccctatcttatcctgcatacccctcctcctggctctgagtcctgaggagtgagattgcagtttttgacccatgttcttactgagaagtgggctgtcatgcaggtataatataaaatccagaagctgctgtcagaattatgtgagaattgggaggtgacagcatgggccaattttctgaatctctagggtgctttgatgcttaagaagtctttctgggctccctgagatttgaaacctcttgttttatctgtcctttcactctggttcttcctttcctttcttggggacttcatgcttctcaaatatttgttaagtgggtgcttatatgggaccttagaaagcaaccagctaggcatgcacttggaaagggacaggaggactgagaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatctccccaccagtccccctcattctcccttccctcctgttcttagactggtttcccctcccagtagtttaggttgtggggcaagtgtgtgtagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttcatcttattttctacaatcatttatatctgcttgtaaaacctttttttaaaaaacttgcttactagacacagcacatgttcattttagaaaatgtagaaaaatcagataagcagccgggcatgatgactcatgcctgtaatctcagcactttgggaggccaaggcaggcagatcacctgaggtcaggagttcgagaccagcctggccaacatggtgaaaccccatctctactaaaaatacaaaaattatctgggtgtggtggtgcgtacctgtagtctcagttacctgggaggctgaggtgggagaatcacttgaacccaggaggtggaggttccagtgagccgagatcatgccactgtactccaacctacgtgacagagtgagaccctgtctccccgccccccccaccaaaaaaaaaaaaaatcagataagcaataaaaaaagtagaaatgacccctaagaggtaacattttggtgtgtataatacaaatgtcttttacatttgctccctcatctcagcattgccactgccattaaagaaggcacatggtcattagtcccatctcacagatagaaagcctgagccacagagagggtagcaggttgcccagaggtacacagcatagtaaagacagagctgggggtgtacctgtcatataactcagcactaatgctctctccactgtagcccacttgctgtcttcgcaccttgggacagagaggggggtgccaggcattggatttcagatgcattgaactgccttatccgaaggttaatagacagatgactgcttgaggaaagcccctgattgacttaggagaagaggtagaagacacgctcttcaggtttacagacaatatgagacaagggattgtttgcgctttagagaacagaatcgggcttagaaaaccctcaaagagctctaatgacaggtcaggagcaacaggataaactttggaaggggtggatgtaaaggggcccccttctatttccgtaagcacaggaaggcctgacttgatgttcaggcagtgatgactggtctgcctgggagtcatagtggactgtaagcagggggacatgtcatttcaacactttaacttcatcttacttcctgggagtgttaggagccacacatcaagaggacgtgatgaactaaggaagagggtttgggaacctgtcaaatgacaaatgctgcagtgacagaggtttcacctagagaagatgggtttggggaggaaaaggtgcaggccaagacttggtgaccagggccaggcaggacaggaccaggaatggcagttagttgaagggagagtctaattggtcaggatacagaacacctttttagcattagagttcaggaatagtagcgagaggcagtacagtagagtggttaagagctcctgctctgatggcttactggctcccggctcccagagtcttggaagttacctcactcttccatgttccaattttctcatctgtaaatggggataatgggtacctgccttatagtccacttgtaaaacctaagggagttactccatgaaagcagcttagaataatgcctggcacacagaggtgctgtgcactgtttgattcacacggaagctgggtaggctccatggaagaagagttgtagaaggtcttctgcatgcatttggtatgacctgcttacccagccttttccattccctgcctccctgtctccttctttctttctccatcttcctctcctgggtctaggatcctacatttcccctacctaggacaccctacccctcaatctttattttcttctttgaaactcttaagtattttatttcttcttcttcttctttttttttttagacagagtctcgctctgtcgcccaggctggagtgcagtggcacgatcttggcttactgcaagctccacctcccaggttcacgccattctcctgcctcagcctcccgagtagctgggactataggcgcccgccaccacgcctggccaattttttgtatttttagtagagacagggtgtcaccgtgttagccaggatggtctcgatctcctgacctcgtgatccacacacctcggcctcccaaagtgctgggattacaggcgtgagccaccgcgcctagccctatttcttcttctttaaattgtttttattaaaaaaaaaaaaaaaggccaggcgtggtggctcatgcctataatcccagcactttgggaggccgaggcgggcagatcatgaggtcaggagacagagaccatcctggttaacgtggtgaaatcccgtctttactaaaaatacaaaaaattagctgggcgtggtagcatgcgcctgtagtcccagctactcaggagactgaggcaggagaatcgctttaacccaggaggcagaggttgcagtgagccgagattgcaccactgcactccaacctgggcaacagagtgagactctgtctcaataaagaaaaaaatgagacagggtctttctgtgttgcccagggtggtctggaactcctgggctcaagcaatcctcccatctcaacctccctgcccagctgctgtgcccagcagtattttctataattagcatagtgtacttttcagattatcttgaagacccagctctccttgaccttgaaccttccctgaggcctccagaggcaatttcctcctcaggactcagctgcccttcactcttccctcgtgcacagcctgtcctgtgagtaggtgcaggtactgactggtcttatctttcgccctgaaaatataaacgttttaaaggcacctgaggatttgtcagcacctccccacccccaccctgggtctgacctaggactctgagtcagggaggcctccctccactgagtaatagtagccttgggatctgctcagcaagaggattgtatagtttaagggaggaagaagcaccagtgctgcctccccatgggaaaaatgaagccccccctcccgcaaccaccaccaccacagaaccaccaaccccaacgtcacttggcagattagcaaaagaactagccagacgctgctaggcccctcaggcttctagattcgctctccaccacatttctaccaatttatgctcatcttgataagctcctcctttgaagggtctggaatggtctggagtggtctggaaagcagggtcagatacccctggaaaactgaagcccgtggagcagtgatctctacaggactgcttcaaggtgcgtggtgaacagacgtctttttgcaattatgccagttgctcctctgatacttgagggttatgtgaatctaacaacagacaaaaatctctgcctcctggggcttatattctttgggaagagacaagcactaaacaaataaggaaatatatatacactctgccagatagccataagacggatggagaaagttgaagcagggaagggagatggaagtacctgagggtggactacgcatatttgaaatagggaagccagggaagacctcactgagatggccacatttgagaaaggacctgaagaaggtgaggcagtgagctgtggaggtgggtaactggggagggggaagaactttagctagagagaaaagccgctgcaaaggcccactgaaggcaggatatgcctgctgtgtcgagaccagcaggaggccgtgtgcctggtacttaatataccagaaggagtggagcaggcaggggtaccagttccagaaggacttgctggcaggtattaagatgggctttttctctgtgataggaagctccaggaaggatttgatcacaggagggacagaatctgaattgtattttagaaggatcactttgactgctgtacagagagtgggtggtgaggtgggaggcagaagccagaaagccagttaggaggctgttaagtaatccaggcaggagatggtgttggctgggaccagggtcatagcagtagaggtggtgagaagtaattagattccgtatatttattaaaggcaaagccagcaagattccttgactctaacttaaaggttggagttgtcatttactgagatgagagagaccatggggggaaggtaaagggctcggttttggatgtgttaggcttgtgctgccattggacatccgtgtggaggtgtcagagaagctggcctggagaaataaattggggaatcatcagcatactgaaggcattggaaggcacaagctggcataagatcagaaagagatggagcgtagatggagaatgaaagagacctttagagattaggaagaaaattactgactgagaccaacaaagtagattgatacggagcagccagtgatatcagagcaaaacctgggaggaagccaaatgaagagaaggcgtagaggaggagggatcgagcagtcatatcactatcacatgctatcgtgggtcaagtaaaataaagatcataagtgttaccgaaagtttcaaagtacagtgacattggccaggcgcggtggcttatgtctgtaatcccagcactttgggaggccaaggtgggtggatcacttgaggttatgagttcaagatcagcctggcccacatggtgaaaccctgactctaccaaaaaatataaaaattagccgggcgtggtgacgcatgtctgtagtcccagctatgggagtctgaggtgggagaattgcttgaatccaggaggcagaagttgcagtgagctgagatcgagccattgcactccagcctgggcaacagtgagaccctgtcccccaaaaaaaaggccgggcgtagtggctcatgcctgtaatcccagcactttgggaggccgaggtaggcggataacttgaggtgggttcaagactagcctggccaacgtggtgaaactccatctctactaaaaatacaaaaattagctgggtgtggtggcaggtgcctgtaatcccagctactctggaggctgagacaggagaatcacttgaaccggggaggcagagtttgcactgagctgagatcgtgccactatactccagcctggacgacaaagtgagactctgtctcaaaaaaaaaaaaaaaaaaaacaaaggctgggtgcagtggctcatgcctgtaattccaacactttgagatgccaaggcgggaggatcacttgtgatccgggaggagttcagttcaagaccagcctggccaacatggtgaaaacccatctctactaaaaatacaaaaattagttgggtgtggtggcatgaatctgtagtcccagctactctggaggctgaagtaggaggatcacttgagcctaggaggtggttcagtgaactgaggtcacacctgcaccccagcctagtgacagagcaagactctgtctcaaaaaaatcacctaccaccctcttcatacaggggaactttcttctattctttttctagtcattttcatgagaatcatgatctttatgtaaattcgtattgtatttttcacttatgttattaaatattctatgaaaacatgagtttaatgactaggtaatactcagttgtctgggtgtgccctaatatatttaaccattcctctattattgggcattgggccatttctgattttttgttattataaataacattgcagtgaacagctcagtgttttcctataaggggaagtatagggtcaaagaacgtgaacgcttttaggtgagacttgaacttgagatccctgggttctcctggacagaccgaccaatcacagcttaactgtgggatttttccatgtctcctctctccctgggaaggttgagaagtctctctgccctgcagatccctattcctgcctccccgctgcaattgcacgtcccatttctcctgggccagtcagagtttcattgcctctcatggggcctgctggccacccactcagtggctgcccttctccttaccaccagccttcgtcccctcacctagagcattcacaggcgagcaagagccagtcagagcttccctcagagtagggggtgtagtgataaatgaaatagccctgccttcactcatctcactgggtcgattaagtgatgtgtgatgtacctgaaagcacttcaggaacttaagagtctcatgctctaccaactgagctagccaggtgcccttaaagggctgtcctagtcttaattgtttgtaaagaaataggtagctgggcatggtggctcacacctgtaatctcagcactttgggaggctgaggcgggtggataacctgagcccaggagttcgagaccagcctgggcaacatggcaaaaccccgtctctacaaaaaatacaaaaatttgccaggcgtggtggtgcacacctgtggtcccagctactcaggaggctgaagtgggagaatcacctgatcctaggaaatcgaggctgcagtgagctgtgattgtgccactgcactctagcctgggtgacagggagatcttgtcttaaaaaaaaaaaaagaaaagaaaaaggtataagtggtggtgtccacattgtaaccacagagcccctaaagcagggctgttgacctatggttggcatcctggtcacaagagctctgtgtcagatgtgtgaggggcttgggtgtagttgtcaagcctgggaatgtggctgttagtatcgattggcctcatgccaagcagtgccaagcgccacgtctgctccccagatacctgtgtttgtatgtgtgtgtcatagtcgggaatcactgagaccaggacctctgggaggctgaaccctgggagggcagagcaggaacaggccttggagatgatctaattctgacattttactcagtgaggacacaggtggggcagccagagaggtactcagctctgagtcagggccccatccctcaactcctcagcctgagtcttcccaggaacacaacaggcagctgcttcccagaccttgcagggctccaggtggccttcccctcctgccgactcccttgccaggtttgctgtaactattgctcctccgagcctggctgaaatcatcttcagtctgttatcaccttcagtctgttctcatcttcagtctgttctccacagcagcctgaaaagtctttgtaaaaatgcagctctgttcctccccatcctcttcataacccccttggctctctgctcctcccagaataaatacccacatcctcagcttacccttcaagacgctgagtgacctctagccacagcccttctctctacccacagacagcccaggtcctcattccttgggccttttcacatcactgttcccatcaccctggaatcccactcagcctgcctgggccagaggctacgtaaggtcctcaggaaagcgtctcctggccactcgcacctgactcatgtgctctgagtgccacaccttgcttggcatttgtccttcatagccctggtcattgctggctaatgtagcctggcacatggtggtaggtacttgacaaatatttgttgaacaagtgaatgaaaccagctggcagggaccagaagggcagaggggcagggacagtgtccacaaccatagcccctgtggtcttagctgagaagggctctggctcggtctctggtgagtctctctgctggccggcagaaccaccctaccctggaagccctctccatgtagtgtgaggggtctcaggcccattcaggcttcagtaggagagatctgggtctcttctgggacctgagcaggcctttcctttacctcgttggcatctctcagcattttatttggttttaaaaatgtctcccccttcccccgaccaaccccagattataaaggtatcccacgctcactgtgaagaaattggataacataggaaaatataattaagaaaatcgaaatcacctacagctccacccctcagagaaaagtacccttaacatttgtggccatgtcttttcagttttgtttttatgcatgtgtatgtgctttgacattgctgagcttctctttgtgaaaaccacagatttttcgcagtcttcagtggctgcggtcagaggtggtcagcacgttagtgctcccagtggagaggtgatgcagggatctgggtgcccctttctccctactgcaggtgggtgggtgggcacacccaaggcccccttctgtggcagctttcctatccctggtgaagagtaccctcctgtctctggtctcttctccaggacattctccagccctggaggctgttcctagggggctgcctcttggggcaatgggaagaattgtggaatgcgtgggtggcctcctggctgtcttttctctggttccagcactctctgaacaaaaccagccccaggccactcctggggattggcctcaggtgactctctgggctgactctggccagctagaaggccacccgggcttctcctgtgtccttaagagggtggggtgacctggattggcaaatagtaagcagagaacacggcagagttgctggcctagaaaaccaggtcactaggtcagcacttggattaatgattgataagaaaggttgggagagaatcagccagacccattctcccatgacatccctcacttctgatcccaaaagcacctgccacggagacggggcaacctctgtcttgtatccagaggctgccccttattccgttgcagtatgggaggaaggaggtgacagcaactgggtcacctgcatgtggggcgagaaggggaggaaggtttaggcccttctccctgaaaaaagaagcatgtgcccagagtagggggctccctgccggttctctccccacaattgatggtgaggcagggaactgggaagttctgtctgtggaggtcccttgggtttcagcaggctagcacatttctaggactggaatatcaccatacaatcccttaacacaagccatgggtgataataatagcagcagccactgtggtccttatttgtaggacccttactatctacctggcactgttaagcagttactgcatcgttatttattccacacagcagcctctcaggttaggtggtagtattccagttttaatgtcttccccaagtcataggatgggagggatgagccagggtgtgaacccaggcctgactgaagccggtggaattcacttctttggagtattgcatctcgatggcagtaatatatgaaaactgatacagtggcaagtgctacaactcagaatagtgtggctaaggctcatgtttttagtatatttattcatccagcaaacgtatgttgaggacccactaaatgccaggcaccgtgccaggtgctgggacctacctcagtaagatacagggcattctctgggaaactgataacatggtgaggccagagcagttagcagacattgcagtttggtgtagtgattgcagatctggagggcccgggtcagggttgtggtgagaaggaacagaatggagctagtccaggagagcttcccggaagaggaggtgcagacaggtcgcgaaggagagaaggttttagctagtggaggggatggcattcaaggcaggtgccagttcaagcctccatgctcagggagtgatgtgggatcatgaggcacataggcaggcagagcaggaggataggcctggagagggaggcagggacgagagcctgtggctgtcttcagcacacaggagtcattttctggcagtaatgtccagaagggctttgaccaaggtgttcttgacagaaacagctggggactggcagccagacagaggattcagaggtgatggctccagactgagactaaggagccccagctgggcaaggacatgccagctcctggtccagtcttacccagcaccatatatgaggcacacagtagagtggctaagacttgagccaacctgccttgactcaaatcctgcttctctagttactgtgtgaccttgagccaattactttgcctctctgtgccataatttccacgtcagttaaatggagatgataatagtacctgcctcttagggttgttgtgaggattacatttgccaacatacacagagcatggtgtgtaataagtccttggagaagggaagctagtactattgtgatggaggtggtgatccagcttaggctctggtacagtaagaaggtccatcaggctgtaccatgtggcagatggagcccatggaggatggaggcccctggcacactgactgtccccactcatcccctgggtagggcagaagtgttcccacaccgtacagcctgccagtgggcatcagggaaacacctgagtcaccacgaggagtacgaggcacttgggggttgcccagctgaccaggagcacagagggctgccctgaaagtgagcccctccctactcctagcagagacggggaagggagacaactggacttggtgggaaggactgggccccaggtggcttagttgctctggccccagaccaggtctctctagagctctgggccatttgggttaagcttctaactaccactgcccatgaaattcacctgccaatgggcaatggatggagtcatgcccctccctgcacctaagttctctgaagggctgagtttcttcttggggccagacagtgggtattggaatgggagcatgggggctgcatgtgcactgcaggctttgtgtgtgtgtgtgtgtgtgtgtgtgtgtgtgtgtgtgtgtgtgtgtacacacatacatatatgtcagaattggaatagtccaggggtttgttttgcaagaaatccttttatttttattttttgagatggagtcttgctctgttgccaggctagagtgcagtggtgtgattttggctcactgcaacctctgtctccctagttcaagcgattctcttgcctcagcctcccaggtagctgggattacaggtgcgtgccaccacacccggataaccaggggttttgccatgttggccagggtagtcttgaactcctgacctcaggtgatctgcctgcctcagcctcccaaagtgctgggattataggtgtgagcccccttgcccttcccccatgccccatgcaagaaattattttgctagggactactttttggtgaggggctacattgctgcattcgtgccccctcattctggctcagggcccttgtgttgtctgggggtctgaagctccagcctcttaagtggggcaaagctgtgacatgatcagagggcttctggctctggcatagtgctggggcgtggagaggggagatagccaacactgggagccagaccaaaaaaaaaaaaagccagggttttttgccggcatacaaattaaacttagtgcctggctgtattgtggttgttgttgttgttttgagacagagtctcctctgtcacccaggctggagtgcagtggtgcgatctcggcccactgcaacctctgtctcccaggttcaggcgattctcgtgcctcagccacccacgtagctgggattacaggcgtgcgccaccatgcctggctaatttttgtatttttagtagagatggggtttcaccatgttggccaggctggtctcgaacacctgacctcaagtgatccacccaccttggcctcccaaagtgctgggattacaggcatgaaccaccgcacctggacttttttttttgtttttgagacagggtctcaatctgtcctcaggctggagtgcagcagtgcgatcttggctcactgaaacctctcccctccgggttcaagtgattctcgtgcctcagcctccgagtagctgggattacaaatgtgcaccaccgcacctatctgatttttgtgtttttagtagagacagggttttgccatgttgcccaggctggtctcgaactcctagcctcatgtgatctgcctgcctcagcctctcaaagtgctgggattacaggcatgagccatgcccagcccagcctgtgctatctttagtgccagggcttaagaaaggaagaggagaatagggttcattgcaggaattgtggtgggtggggtggcagctacctgagaaaatctagacagtgggcctaggtccagtgggtcaggggagagagcctaggggtcaaggttgctcctggctgggcaagctgagaacagggagcaaccttggctcagggtagatgacagacctcagctgtagatggagcaaggaggccatatgaaaatggcaggcttctggcaaaatgcagggatgggctgcagcacagcagttcaatctaaataggagcagcccaagggacgtgggtaggttttagaacagccaggctacagctccccttcctcttcactggtgtccttgagaggccacagtcagaagagacaattccaggctagggagagatgtcagcgtgggaactagagaccctggtcccaaattcagaactctagccagagtccagaactgcatctgagtctaagaggcaaccacttacttacacctcccgaaactgagaacagttttaccggttctggtgaaaaaaacccactaccagctcatatgtgggagtgggagctgaggctctgctgagtaacacggcccagtgcacacagctgtcagggcctggcccggctcgagtcctgctgtgtccgaagctctgccgttttctgcttcgtcctctagcatgttctgagatgccctgttgggatcctcaggcctgtcacttttgtcatctgcaaggggggcctataaggccttaatgggggctggcgaggcttgagtgggagcgtgacgcatagtgggagctcagtcagctccctcccctccctccaggatttggtcctgacagggagctccatcaggtcttccccagggtcaccagaggctcagatgctgtgttgtcaagtatatataccaggcagtattgtagcttttcctcctctgttactgcctgctaagcggggaccccacatcttcacgtcctcctcttcctggctctcatcaccacagcctggtgtgcattgccccgtgtccactgacacccacgccacatgggtccaaaaacagagtgtgttctcattgcctcatcccactcaccctgggctctgccgccactgcgctgtggctctcgggggtcccaccatctgacccttgtcacccgtgctgctccttctcttgggactcatcccttctgaggcctcccgtggccccttctcaccctcccctacctcctccatctccaggctttcaatctggtggagcataaagaatcagtgtttctggtacttgttatttggataatggcacctaatgctaaatgacgagttaatgggtgcagcacaccagcatcgcacatgtatatataggtaactaacctgcacattgtgcacatgtaccctaaaacttaaagtataataataataaaataaataaataaataaaataaaataaaataaactttgaaaaaaaagatttcagctaaaattagtttcctctccatgccgagtctgaatatattataaaaataaaagaataattgtctttcacacaattaaaaaaaaaaaaagctgactaatgccactacagtcacacactgctgttggtaattgctagggtcctttttccagtattgtggccaacttccaccccagaaccccactctactcttgagctaagtgtctttatgtctcctattttaaattaggattgcgttcagttgcatgcaacagaaatccggcaatcagtgcctggtaaaacaagtttgattttttcacctaacaagcagtctggaggccggcattgcagggtgggtccagcagctttgggaggccacagtggccaggtgctttcggacttttcacccaccctcctaccctgtcttctgctgctccgaaggcagctgctacacctctaggcatagtattcctgttccaggcaggaagatgggaggggcagaagtttgtctctctattaggaaataatagctttttcggaagctcctcctggtagatttctgttcacatattgctggtcagaattatgccaatgaacactgtagctgcaagagagcttggggaaattgagtgtttaggtaggcacagattgctgatccagagaagactgagactcagaaggaaggagaatggagctggggagaagtaggagtgactgccccagctgccacttggagaaagccacggggtgagcaggacagcacctgtgaacatttcctgtgctctgggtctggtgcttctcaagtttaacacccaggggcgagtggtcagggactgatccttgaggaactgatgtacattaaacaaactatcaagtccctgcaatgcagtgtaaatgagtaaagagcctgcaggggagaaactgccactagtggagaccatgcgagtgggcagccgattgcttggctctgggggtgggtgccagaggcatgcaggtgcccaagggccaggtctgcccaattttcaagagaagccagaaaaccaaaatttttaaaggttttttcgttctaactctattttgaaaaaagttcggtgttacagagtaagttgcagagattgtacagagtccccacatatcctttacccagctcacattaaatcttacataaaggaacactggtacaatactattaaccaaagtcagtgtgttgttcagaccttaccagtttttctgccactgccccctttctgcttcggggatctggtccaggatcccacattcatttagttgtgtctctgtggtctgctcctgtctgtgaggcttcctcagtcacaaagctagaggtttacgtgaccttttccaggttttcccactctaatgatttggaaatcatacatcggcatcttgagacatcttttgagaagtaaagggacttgagctgattgaatgttgatcactccctctcatcttccacattattaagttttgccttcttattttattataatttaaattatttttaagccaggcacagtggctcatgcctgtaattccaataccttggtaggccaaggtgggcagattgcttgagcccaggagtccaaaaccagccggggcaacatagcaaaaccttatccctaaaaaaaaatacagaaattagctggtgtggtagtgcacacctgtggtcccagctacttgggtggctgaggtgggaggatcccttgagcacgggagataaaggctgcagtgagccatgattgcgccactgcactccagcctaggcgacagagtgagactgtctcaaaaaacaataacaacaacaacaaaaaaacccatcagaaaacagctaagagttttgtggtggtgttttattttaggttcagggtacagatgcaggtttgttatgtgggtgaacttgtgtcacaggcgtttattatacagattatttcatcacccaggtactaagactagtacccgatagttattttttctgctcctctcctcctcccagcctccaccctcaagtaggccccgaggttattgttaagtccaagcaagggaaggcctggtggaaatgaatgtgtagccttaacatgttttgtacaaacttggctgtacattacaatcaccaggacaattaaaaaataagaaacccaatgtccaagctgctccccaaaccaatcaaaggagaatctctggggatgggaccaggcatctgtctttttaaaaactccccagtgactacagtgtacagccgagttggcaggtctagagcagggagagagagcagaaggagtctctgatcactccaggttctggttctgatgagtgggtagacaggcaggtgggttgctaaagtaaagattactagaggacgaatgggtttggggaaaatgatgggttctgtttggatagattgagtttgagctgtcggtaaaatatctgagagttggggtcccacagatgcttaacatcttaaagcagatcttttcttctcctgatccttccacaaggtctggtgcagacatttccccgctgggagactctccacagtacctcatgatcttatcatctctgactgtggcatttgtggataatgttttacttgctaagggttggaactgtctcctcctgggtgatgtggacgtggcatcaccacccagtaagttgtcaccttggaaagactccaggatggagcacatcttcctttttctgatgtctctgctattgaggccatggttgcagatctgctgtcaacatgagccaagaacagcagggctttatgtcttttttccacacccaaccactgaaaggatgggactcaccccttcaggaacagtagcacagcagagccgtgattcttgggcctgagtgctgatagggacagggtcggggatgggaggcgtgatgcatatctggatctccaggtgggctggagagttgggaaaagcccctcaagtcattccaatgtgcttcctggagactcagaacagaaggcagcagaggaggcagggaagggtggcacagtgatgtgtcacctctctagtttatggagcctgctccgaaccccacaaacccactacaagagccaggtgggaagggtgatagggcaggtgacttgtgatacaaggagcagagaccatggtatagcactgcaggaactagggaaggagcaggagcagaagaaccccctccatgacagcagcccccaagcgtgccccactcgcaccatcctcttccttgtcactgcctcccctgacctcttcctgtcttctcctctgcccaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacaggtgaggagaggactggcaggggacacggggcagaggaggcacagcccagtgcagtggggatcctggccctctgcaaacgccatcatgtggggcgcagagtagcagagtgctgaaggactggagccggaagcctgggttcacgcccagtgcggtggggatctgctctgccactcaccagcagtggggcctggagcaagctgcaccacttccttctgtaaaacaggccaaaggatggtaggtgatgtggatatgggctttcgtgagaattaaatgagtgggcatctgtaacacatgtcatcatcattattagtattcccaccactgttaacacaaggcatctgagaccaatctccactaacagcacactagaaagatcagctgtacctgggattgttatgatcagtcgaaacacacagttcaattggtctggtaataattatacacatcatcattgagccgtatcataattagataaaaatgctaagcagttagtatgaataactcaactaatattatttttatgcagccaagcagttgtagcttctcctgtctcacttattggttcccctttatttatcagcagtgcagacagttttctctagtaccctgtactgttctgtcatcttcatcatcatcatgttatgtttaccttcaaaagcacccagaatccatgcagcccctggctttccctgctgcagttccccctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccgcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtgaaggctgtggaggtagcgcaggctcctgtttgggtctgcagctaagatgggtctgaatcctggagccacaccaccttgaacctgcaaagcaagtcccagaattttgcagaagttcttcctcttcagtgtatagagttgggtggagggagtatagagccatcattcagtccttctcatctcacccaggatcacctgggagtgaccaaagtaggccaaatgtgattctagggccaaagtgaaggtgtccgccattccccgagtaagcaacttcctgtctattggctggtaactgggatggctttggagacacagcctgtctcagaagagaggaacagctaaccaggagtgataattcactcagtgccagtagcacatactgttctaaatctgaagaaggtagggagggttagaaagcaaagggaagacagtggggactaagaatgagtgtgggatgtcatgaggattcaggggagaatgcaaggagaagagacggccacagggtttgtggctatgccgcctgccgtggcccacctcatccccacatctgagcccaggcagatggaagtcccctgcagagcagtgttctgtcctggagtttcctccacaccccttcttgggaccagggctgtttcccaaatagcatcactgttcccgtgcaggccaggtgaggtgcctgggagcaggggtagggtgaggcaggcatggcggtgacctctcaggcagcttcgttgtgggatttagggcacagcgggaaacgtccagggcagaggttgcctcaccagtcacatggtactatgtaggcggtggtgtttaatagattctgtttatcaataagtggatgaagtggagatagacttccttgttcagtcattgaaacaggagagagggttacttgacataatcactttgtgttaaagctgtagtgtatgaaaagttcccaaaaattctacaagacaagcaacctagcaggaaaatcagaacaggtaacagtaagacaaatacgaatggcctgaaatcccgacaggtttttcagtctaaccaactcaaagaaagcaccttaagttgcaatgccatttcacctgtcagatgggtggggaggacttggtcctcccaccaccaggggtgaaagggtagtgtgggccaacacttcttaatgtgtgattctttttttttttttttgagacagagcctggctctgtcgctcaggctggagtgcagtggcacacgatctcaactcactgaaacctctgcctcccgggctcaagcgattctcctgcctcagcctcccaagtagctggaattacaggcgtgcaccaccgtgcctggctaatttttgtatttttagtagagatggggttccactgtgttggccaggctagtcacgaactcctcaggtgatcctcccgcctcggcctcccaaagtgttgggatttcaggtgtgagccaccacacctggccaagtgtgcatttcttttaccctgcattcccacttctaggaacgtgtcctgtgtaagtacttgctcagcatgctcagagattcccatgccagcttatttactgcaggactgctcataagagcaaaaataggaacgtgcccatctgtggggaactggttatgtaaactgtggtagagccatatggtggaatactctggagtcattgaaaaggataaggctggtttatatatatattaaataagttcctgacaagttggggatcccattgtttaaaatccttatgtttcatagaaggcaccggaagagtctataccgaaggactcaggggctaactctgaggagcaggatcatggttaaggaggctgtgtcataagatcctgcatacccttctgtgtttttctcaacaagtctgcactacttccataatttgaaaggcaactgtactttttttaagggtaaaattaactgtttaaaaggggggtgaggatctggcaggtgaggggccctggagacagagcctgatcatgtgtccagagcagaagggcttggagatcacagagaccagggcaggcatcccaggtctgtcactgtgagctgtagccctcgccagtgccatcacttctccaagtctcattctcttcacctttataggctgtgtcctacccagcctgagggccagccaggtgagagtcagtgggggtatgtgacacatcgcaggtctcagcacctgctagttctctgccccatccccatgagttattactttggcctcgggagtcccctgagggacccataaggacagcgcacagctttgagccctgaaacagcaggaaggctccacagtcacccctgaccaccctcctcagcagttcagcactgactctcagtgcagatattgagctcaacacctgccatgcaccttctcaccctccccccagccaggcaggacagaccttcccatcaacaaggaaactgaggttaccagaaacccacttgccagggtcccctgggcgtgtaggagtagagacagctagagccaggattcacctcccattcccattctcatccctcctgcttcagtgacatccatcccaatcacccttgagaaagaggaagataaagtgtccttcctcctggcctcagcacctcctcacttggcaagcacttggtgggcatcaggctgggcccagcactgtgcccagggctggccatacagtggtggacaaggctgagtgcctgtcccaaggagcccacagttcaggcaaacaggacagcagaagtaaagaggctgctcagtaacccagcctcaaatccctgcagaatttggcctgacttcagaagctgctgggtgcttgtttgcctgtgagctctgccagcaaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaacatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccacagtggggccacggtaggcactcagtcttttttcttaaggccttcagttgttggatgagggccactcacattatggagggtaatctgctttactcaaagtcttctgatttaaatgttaattgcatctaaaaaatatcttcttagtggccgggcacagtggctcatgcctgtaatcccagcactttgggaggccaaggtgggtggatcacctgaggtcaggaattcaagaccagcccagccaacatggtgaaaccccatctctactaaaaataccaaaaaaaactagctgggcgcctgtaatcccagctactcggggggctgaggcaggagaatcgcttgaacccgggaggcagaagttgcagtgagctgagatcgcgccattgcactccagcctggggaacaaaagcgagacttcatctcaaaaaaaaaaaaaaaaaaaaaaaaaaaaaaaaaaaacaccttcttagcacattgtttggtcaaacaactgggcaccgtggcctaatcaagttgatatgtaagaccaacatagccgctgccagcaagttactaacacttctgagccttggagcctcggcttccttgcctgtaaagtgggggtaagaagaccatcttgaaaggttgttttgaggttttacgtgagatgaaatgggtgtccaatggagtgcctttagcaggacacctgcttacccccacctctacccaggacatcatgatgcgggggaagtggtggaaccttcagaacccagcccctagtatgagaagaattctgccatcacctttctttcagcagagagggaagcagtccccttccgtgacagtcacatgcgtgagtgatggctccttccaatatcctgcacttcttactgccccttacctggcgttgctccactctgtctcatgttctagttttcttatctctttctctttttttttctattttatttttttcctgtaggcacaagtgagttacagtaggttaagttacaccttacctttccttgtttttcttgtttatttatttgtttatttatttttttgagacaaggtcttgttctgtcaccacaggctggagtacagtggtgcaatcacagctcactgcaacctggacctcccaggctcaagtcatcttcccacattcaggcaatcctcccacctcagcctcccaagtatctgggactacaggcatgtgccaccacacccagctagtttttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttactttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcgtgatccgcccgcgtcggcctcccaaagtgctgggattacaggcgtgagccaccacacccagccctgctgttacctctttcttacctcagctatttgaggatagagtctaggtcctgtcctgcatatagaaggtgcttatcatgtgtcttttgagtgaacacagagggtgacattgtcacgtgcagtgccaacagaaaccaaatgactagacacctgctgaccttccatggccacagggaggatgagaaaggcacctccaggaggtgtgaataatctgagggtattggccactgtggacaagactcggtggtggaagtgagctcagagatccaaagggaacgtgagtagagacatgcagagtctcgcagaggaagcagacgtgcaggccacaaagacaaaattacaagaaatgccccaacacgagcatatgctcacggactgcacagattcaaggaggaagtgccagaaaccctgcctgccccagcatctgcacaggcatccacaaagggtttctgtcatgttatctctttttcttccaacatccggtgctgtgagttttattgtccctgttataaatgcctccaggagtggcaggtcctgcccagccccatcagccagttggtgctgcagtcaggacacccaggcagcctgaggactgccagatgtgcagagagctatcgcgtgcctgctgcgtgcccagcacctcacacagctctcagtgtctgaccacgctggtgccctggtggacaaagttcctgcccttgtggcccttttgtctagtgggtggcttccaacaatgaacacacacaggatatgtcaggcggtgacaaaggctactgagaagaccaaagcggcttcaccctcccagagcacagcttttccctcccaggcccgagagatgtagggagcccactgtcccagtctgggtcaagaggaacagttacaacaccttggaatgactgaagttgggagctaaggtgccaggacaagacaggccattttaggaaccagagacttgtgttacccctaaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttcggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcctgaagtcatagccttagcaaactgcctttctcgccaacacactcaacaccccgtggttcaaacatctatacgtctgatagaaaaacttggagaaattcagtgtgttgcttaatcaatatgactgatacctaagctgttctactcaagaagttttcatgggaatgaacttgagcttcttgaagagattgtttacagcatccctggagtctatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaag

SEQ ID NO: 139878 - DNA, 5024 bp, Homo sapiens
gactgtgcaggtgtgattctttactcagctgagtgtgccacacaggtagccctggacggcattcagtgttttggtgagtgatccccacttcccagtcccggggctccctcactcctggggcctgtggctgcttcagaaagcagtttcagggcgggcgtggtggctcacacctataatcccagcactttgggaggccgaggtaggcagatcacctgaggtcaggagttcaagaccagcctggccaacatggtgaaaccgcatgccgggcatgatggtgcatgcctgtaatcccagctacttgggaggctgaggcaggagaatcgcttgaacccgggaggcagaggttgcagtgaacaaagattgcaccattgcactccagcctaggtgacagagcgagaggctgtctcaaaaaaaagcaatttcctctccacttctccactcctcactatgtgcttatgctaggcccagctgagctgggaccttcgggctctttctgtcccagttacaaggaggaaatggaaagcaaatgagaaaactgctagatgccaggagttgctgctgccttcggcaacacccccctctcatcctccccgcctcatagatgctaggaaatgggaaagggagatgtggctgggcacagtggctcacacctgtaattccaacactttaggagactgaggccagtgaatcacctgagatcaggagtttgagaccagcctggccaacatggtgaaaccctgtttctactaaaaatacaaaaaaaaattagccaagtgtggtggcaggagcctgtaatcccagctatttggaaggctgaggctggagaatctcttgaacccaggaggcggaggttgcagtgaccggagatcgcgccattgcactccagcctgagtgacaagagtgaaactccgtctcggaaaaaaaaaaaaaaaaaaaggccgggcacggtggctcacacctgtaatcccagcactttgggaggccgaggcaggtggatcacctgaggtcaggagttcgagaccagcctgaccaacgtggtgaaaccccatctctactaaaaatacaaaaattagctgggtgcagtggtgcgcgcctgtaatcccagctactcaggaggctgaggcaggagaatcacttgaaccttggatgcggaggttgcagagagccaatatcatgccactgcactccagcctaggccacagagcatgactccaaaaaaaaaaaaaaaaaagctaaatggaaatttctagaaatagttcataagtttcaaatccacaccatcctgaatagcttgaagtgttgtgccatgctgctctgtcatgtttggtacgtgaatcgtccctttgtgcagcctatctatgctatgtgggctacctgcccgttagtagtcacctagggtatccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatggggttcggtactatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcagggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgttggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaaacaaaatgaaccatg

SEQ ID NO: 139879 - DNA, 293 bp, Homo sapiens
tgctcaacgaagagcagacacagtttcttaaagagctggtggagcctgtgtcccgtttcttcgaggtaaggaatgactcggggcttggtccctggtgaggtgtttggagatgttaagctcaaaaggagcctggatgtgggatcctgtgccttccccaggaagtgaacgatcccgccaagaatgacgctctggagatggtggaggagaccacttggcagggcctcaaggagctgggggcctttggtctgcaagtgcccagtgagctgggtggtgtgggcctttgcaacacccag

SEQ ID NO: 139880 - DNA, 2210 bp, Homo sapiens
gactttgaaatggatgtggtggcaatggtgaatgacacggtggccacgatgatctcctgctactacgaagaccatcagtgcgaggtcggcatgatcgtgggtaagggctccttgcacccctgccccttccagactgctgaggctccctgtgtacaacaggcttcaagggccctgtggggtgaggaccaaactacttaacaaccggtgatgtcagagcagagcctggtgctacagcctgggtggtcttggggtatcaagatggaagcaccgtgtacagtaggaagcatttcaacgccatgatgccacattcctgcatcagatggtatgccagctgcatatccacctcacccatcaggattataattaaaacacttatctggtaaattgaccaactggacagattggtccaagtggaagaggataagcaaaagtggtaccatctccacccgaatggtctttccacgggcctgcccctgcccctgcccccacccaaagtgaaggcaggtaccaggaaagggagcagcagtccgcccctcccagcagaggggtcttccacaccaactcggacctttctcagaagttccggaggtcattataaccagccttcactgaggagcaatccaatcagatcagttatctgctgtgcgcacagccgtgtggttctatacttctcttacttccattttcacctttcagaaggaacgttgtctttaaatccagcatctaaacgtgagccccagccatccctggctgtgatccccccagccctttccaccctatcctctggaactgcctggggctccccaagacacttccacatgaattcccaccaagccaagctgcagctgctgggcccaggcataacccctcctggggcagaggtggcaaggagtgacccaccactcacatctgccccacatccactcttgactctgctcagtgtttaaaaacatgtttataacaattaccaagatctgaaaattaggagaattcacatcaaagtctggatttctgtttgttcataaaaaactagaaggcagccaggcaaggtggctcacgccagtaatcccaacactttgggaggctaaggcaggcgggtcacttgaggtcaggatttgaagactagctggccaacaaggtgtaacctcgtctctactaaaaatacaaaaattagctgggtgtgatggcgcatgcctgtaatcccaggtactcaggagactgaggcaggagaattgcttaaaccctggaggcagaggttgcagtgagccaagatcacgccactgcactccagcctgggtgatggagtgagtgagactctgtctccaaataaataaataaataaataaaaactggaagtctaagcatcactgagccctgattcctatgtggcagctcgactgaccagcatttgagttgctgtccctgacagctttgggggtgtgcagcccacacagtcatgctagcttgaggctctgctgtcagcagtttgaaactcttaataacttgtgaacaaaagactccatgttgtcactctgcacaggggccagcaaattacaaaattccatatccggaattgtctacaggagcctctgggctgctcccaagggcccacaccatgccttactcactttgggttgccatccaaacatgtctcatgacaaagaagctcaaacatgtgcatggacagtgccagaaaacaagggtcgtacatagacaaaataaaatgataacgtcccacaaccatttctttgatacacactgtttctctcagtcctcccaaccacctaggtaacaggcagggaaggtgttactgttgcctgttaggaaagaggacagccctgaaagctgtccctggccactgaagcaacccaggtcttccagccccagggagagccgcctttccattgttccagacaaagcagagacaggcatgggggagcgggagagggactcctgtgggcaggaaccaggccctactccggggcagtgcagctctcgctgacagtccccccgacctccaccccaggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagct

SEQ ID NO: 139881 - DNA, 2313 bp, Homo sapiens
gtccgtggggggctgcccctggtgacgtgtgcccttcgtcccacgggcatctacggtgaaggccaccagatcatgagggacttctaccgccagggcctgcgcctgggaggttggctcttccgggccatcccggcctctgtggagcatggccgggtctatgtgggtgaggactgggctaggcagggggaggctgagaatatggcaggaggacttgctctagaagggggcaggacccacatggccctgggagagaagtgtggactctggctagaaaaatatggtctatacatgggccaaggtagactgtgattatgtctccacagcctgcagagaatacaggatccatgcaagttgggacattaaaaagtgtatcataggctacagagaagattgcagctatgggagcagccattccccaggagaggagaggagagggacagtgtgtacacagcactaaaagggctgggttcagtggctcgcatctataatcccagcactttaggaggctgaggcgggaggatggcctgagcccaggagttggaggctgcagtgagctatgaccgcaccactgcactccagcctggatgacagagacagaccctgtctctaaaactttttttaaaggaagtagcatctacacagggaataaggtcacctgccactccatcctgcagtccccaagcctctcagggcccaccacgcaggtcctggtttctctatcctctccccaggttctttgcagatgcaggctggcccaggagagcaagtgactaccagggcgagggagaaggcagcctttcccaggctgctgtggggatgtgggcggcaactacctgggcccaaagagggggtggcccaggagagcagcctcgatgtggtgttgcaagggcactcaggggtgtgtccgcctctcttccgccaccggcaggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 139882 - DNA, 1193 bp, Homo sapiens
gtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcaggtaccacatggtaaccggctcctcatccagaagcagctgtgggctcagccctagctgggagaagcaccccaggcactcccagactcacagccagcccgagacagaatctcctggggagcaatgaagtcctcgacttgggccagttctcacccttggctcctctggtccggccctggggcactcgggctcaccctggagctggcaaacctcaggaaaactggcgttttaaatctcactcctggccaggtgcagtggctcacccctgtaacttcaacactttgggaggccaaagcaggcggatctcttgaggccaggagtttgagaccagcctgcccaacatggtgaaaccccgtctctactaaaaatacaaaaattatccaggcatggtggcacattcctgtagttccagctactcgggaggctgaggcataagaattgcttgaacccgggaggccgaggttgcagtgagccaaaatcgcgccactgcactccagcctggggtgacagggtgagacaccatctcaaaaaaaaaaaaaaaaaaagacctcactgctccccatgggcacttagggaactctcccagcccagttctgcagctgggccattgcactagatcctcagttggtccctgggctctcggtgactgtccagggcaggagtttcccattgacttttccctggttgacctttgaccccttccacagttgacactggtgtccccaggtgtctggtggccccttgtccagctcccttagtcccttgtgccttccctcctcctctttgtaatatccgggctcagtcacctggggcccacccagcccaaggccagcctgtgggtgtccctgaggctgacacacttctctctgtgcctttagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatg

SEQ ID NO: 139883 - DNA, 1992 bp, Homo sapiens
ggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttagagaggcttggcattgttagcgcttcagtgacatgtggctaggctgtgagctggggctgctggacagcgctccttcctggccagggccctgcagcggcatgcctaactggcatcacacactccgcatagggtctgtactcagtagccggaggagaagggtcagacctaccctttcccattgatgtccttcagtcttcctgtactttcgcccatccactgcatgtgagtaactcattaactcacgtttttgtaaaatattttaaaaatgagttattcatttttagcattaatgatgctaagaaaaaaaaacaaaacatctgaatccactgatggaatcccgactcagtagagagaaggcagttctgcttgagtatgagtattttctcccctgaggtgtaactgaaatctgacatggtggagcactgtgggagagccagcacagccatcatgtactaaccagaccaggggcatggatttgttgtttggggtttttttttgttttttttgtttgtttgtttgtttgtttgttttgagaaggagtcttggctctgtcacccaggctagagtgcagtggcgtgatctcagctcacggcagcctccacctcctgggttccagtgattctcctgcctcagcctcccgagtagctgggattacaggcatgcgccaccctgcccagctaaattttttgtttgtttttttgagatggagtgtcgctcttgttgcccagggctggagtgcaatggcgcgatcttggcttactgcaacctccgccccctgggttcaagtgattctcctgtctcagccttctgagtagctgggatgacaggcacacaccgcccagctaattttgtatttttagtagagacagatggggtttcaccatgttggccaggctgctctcgaactcctgacctcaggtgatccacctgtctcagcctcccaaagtgccaggattataggcctgagccaccttgcctggccaggggcatggatttgatcaacagttaggtttgctgtctgcctcagccatataccacgcctatcactgacagcccaaaaaagtgtactttaattacagggagcatccagggagggggagctgtgcagctccttctttgttgacaggaaaaaattcagctagcattaaaggcaggtcagtagtgtcaacctgttttcctgcccacacctcccaaggccatccagtctcctggctttactgggtggagaggtgctcagcagcttctgtcactagctctgaatggcctgtctcctggacaaagaagctttcacggactactctgcagggaggtgacattggaccagagctgactccacctgggggaaagagtaattctctggtttctttataggtgcctgtgtagaaagagtcagggagggattgggtgacttctagaccaattaacttttcttctttcccatccaagggagtccagagagggaagggaaagatctaacaactctagcctttgtggttggcctcgtggatggggtgggagtcctggcagctccacttctgactggaaggggttcacttgatccttttctttcacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggctggtgctggccggggggcctcttgg

SEQ ID NO: 139884 - DNA, 1648 bp, Homo sapiens
gaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccaggtaagtccccagtcaagggatctgtagaaactgttcttttctgactcagtccccctagaagacctgagggaagaagggctcttccagggagctcaagggcagaagagctgatctactaagagtgctccctgccagccacaatgcctgggtactggcatcctgtctttcctacttagacaagggaggcctgagatctggccctggtgtttggcctcaggaccatcctctgccctcagcttcctccacagggcaggaccacagctcacaaggatcccaatgccatcttcctgagcttccaacacctgctccgaggaaaggtgcgtttcctgatgcttgtaggagggtccaccctctgcgtcaggcgggccccacccaccacagctgtccccagcagaacctctctagtcctcacactgaacgagctcccaaacaggacttctggattgttggagacaaacttcactgcctcagccagaactactggctctgggcttctgaagtggcagcagggattcagagccaagattcctggtctgctgaaccaaacctccaggtccctggaccaaatccccggatacctgaacaggatacacgaactcttgaatggaactcgtggactctttcctggaccctcacgcaggaccctaggagccccggacatttcctcaggaacatcagacacaggctccctgccacccaacctccagcctggatattctccttccccaacccatcctcctactggacagtatacgctcttccctcttccacccaccttgcccacccctgtggtccagctccaccccctgcttcctgacccttctgctccaacgcccacccctaccagccctcttctaaacacatcctacacccactcccagaatctgtctcaggaagggtaaggttctcagacactgccgacatcagcattgtctcgtgtacagctcccttccctgcagggcgcccctgggagacaactggacaagatttcctactttctcctgaaacccaaagccctggtaaaagggatacacaggactgaaaagggaatcatttttcactgtacattataaaccttcagaagctatttttttaagctatcagcaatactcatcagagcagctagctctttggtctattttctgcagaaatttgcaactcactgattctctacatgctctttttctgtgataactctgcaaaggcctgggctggcctggcagttgaacagagggagagactaaccttgagtcagaaaacagagaaagggtaatttcctttgcttcaaattcaaggccttccaacgcccccatcccctttactatcattctcagtgggactctgatcccatattcttaacagatctttactcttgagaaatgaataagctttctctcagaaatgctgtccctatacactagacaaaactgagcctgtataaggaataaatgggagcgccgaaaagctccctaaaaagcaa

SEQ ID NO: 139885 - DNA, 5280 bp, Homo sapiens
gagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacgtgagcagtggggctttggcgtccgggcgcggggagggagtggagtggagtggagtggagtggagtggagtggagtggaatggagtggaatgaggggcgggatggaggcttgtgccatttttctcttaagattcgttccgtgagagtgcctatgggctcgagtcccgcctcgtaactttctagctgtgcacgttgtttaacttttcagcctcattgtccgcaggtttgctgagaattaaatgcaaaatgaaatgaatcgtgtcactctcccagacaagcagagcaagcaggattctgttaccggaagctgcagcacacaggcatgctgcctactccgaggtggttgcggtgtgtttctctcgcccaagaggccaggtcagggctggtggttcatctcgctggatagcccctaaccctagaacccgggaaatgataacccggtatgcgtagcaggtcagaggggcacgcgcgtttcttggcttagagttgtgagatctaagatggcaagtgtctctgcctatagctgaaattctttcagctcctggtgtgggctccctggcattcccctactgatcagaagaaagagggcagggaaacaaactttgactaagtcagtgtagtctgattggtagaaagaagtatttgaaaactgggggtttatcagcaaatagataataagaggttccctaggttggaaaagcagattcccttggatttgttgatgatatttttggcttagatttctgctcccaactttaaaggtaaactcctgattcatctctgtaagccatagaaccccagaatcaggaaatgtttgctaaacgaggggcctggcagttggcttcttcttggaaagtggggttccctccttcccccatggcttgtcattggatgcaagtggctggccttttgtgggcctgtctgcggtaagtgctttggtctagaagagtcaacttgtggtttcacatctggccgggctgaccagatgttgcaaggatacagaaagtggacactcaatcccctggaggacacaatctgaggcacattaaatcttaacttgtgatggccaacaacctttctgcagacagagccctccctctgccctcctcaaacactttgccctcggcagatgtgtcctccctcacctttcctgggagcacaaatccattagacagaaacatttgtgagaggcaggcacaccccagtagggagctctgacttgctttctcaggggaatcgaattaatatccgttagagtgtggctaggtgttttcagacaccatgtcccgctgtttcaacatcagaatgtgcagggcagccactacagatgtctggaagagagagccccattccgctgtcctctgatacagtgctgggggtggagagttggccctttggccttccagctgaacaagcctcttctgaagctttctctgcaggcattggacattccaaccgtgatggctgccttgccaggcaagactagttgccaaggcaaaacctcccttcccccatgtcagcagtcagcctttcctaatttgagtggaataacaatgaatcctgccatcactttattcatttttttttattcagcgaatgcttatgaaccccaactctggtccagattttgcctgggctccgagttggcatcaaagacacaggagacgccttccttccatttctggttgatggactagtaaggtgtacaggggtgctctctgtgaaggtaggggtggtggcctctgagaacggggttgtagtagtgtggagctggttttgccgggtgccttgttaaagtccccgtggtctggctgtgctgctgcctcctggcctctgctttctccagccacattggctgcctttgagtctctgagatgtgctaagagcagcttcctgccttcaggccttagcacatgttgttccttctgcctggaatactcgtccttctgctctctatatgcttggccccttctcactctttgggactcagcttaaatgtcacctcctaagcaccctctctgaatgagctccccgctgcggcccagccttggttatctctcaccacaccctgtgtttccttttgcttctggagagaaggaaccacgtcactgttcccagggcctcagcagcctttgtgtaatgctggtactgagaagatgctctctaaatctttgtggcatgaatagcgtctaccctgtgtctgttcttgtggtgagagatttacagatattaattaaattctcacaataaacctactgtgaagttattgtccccattctacagatgaggaaactgaggtccagagaggcaaagcatcatgctccagatctcacagccagtaagaggcagatatggggttgatccccacatctgtcagcctcccaatctgtaaggtccagccctacggggcttagcgggttttctccctgtgtgcggaaacgagagattgtaagaaataaagacacaagacaaagagataaagagagaacagctgggcccggggcactgctaccactgagacacagagaccggtagtggccccgaatggctgggcacactgatatttattgcacacaagacaaggggggcagggtagggagggtgagtcatccaagtgattgataaggtcaagcaagtcatgtgatcatgggacgggggctcttccctctaaggtagccgaagcagagagggaaggcagcataagtcagcattttcttctatgcacttataagaaagatcaaagactttaagactttcgctatttcttctaccgctatctactacaaacttcaaagaggaaccaggagtacaggaggaacatgaaagtggacaaggagcgtgaccattgaagcacagcaccacagggaggggtttaggcctccagatgactgcgggcaggcctggataatatccagcctcctacaggaagctggtggagcagagtgttccctgactcctccaaggaaagggagactcccttttgcggtctgctaagtaatgggtgccttcccaggcactggcgttaccgcttgaccaaggagcgctcaagcggcccttatgcgggtgtgacagggctcacctcttgccttctaggtcacttctcagaatgtcccttcagtacctgaccctatacccaccggttattcctaggttatattgtactacaataaagagtaatattaaaaactaatgattaataatgtttatactaataatcgataattgtccatgatcatctgtatatctaatttgtattacaactgtatagcagtatagctacagtttatgccttcagtctcttgcctcggcacctgggtaatccttcgcccacaccaatcccatgcttccccctctatgtcaggctgggagttgggtaatgctttcctttggacaactttatatcagatatgaccaactattttaaaacaaaggcaatgcacattcattctcttgaagttagacaaatgcggtctccctccttagtttgtttccctcaagttgcagatgggaaactgaggcccagagacttgtccaaggtgataagatggtgaatgagggagcagacttggagcccaggaatcctggatctgacctgtgagccccctctagttttgtgctgaagaaaataactcccaaggttgaaagtagagggactcactctctcagactttttctgggtcctcaggtcatagtttgaagcacaagtttgaagcttctaggctttgtttgcatttgaggcagcaggcagctgcacttgtgaccccattttggaagttgcttactggtggtgactccttcttgccttcagctggggtgtggggaccagggtcagagatgtggtccaagggtctgccctgcacattccctgaatggaaagccacttggattcaggtggttcagctctttgcctaaagcagatttgccattttcaggaggggaagactgaggcccagggagttggcagtggggctgagaatgagtaactaagctctccaggcagcctcttctagggtaggctctgctgggacctcagatgaggagtatggctctggtctaccccgattccaagagctgacatgcgtggagaaatggtcatcttttctcagcccaccccagtgagcagccaatggagataaggccagccaataatcccaccactaagctcgctggcactgaaatggccaagctggtggttcaggagagctggaagcctggctcaggacagagccctgggaagttgagtctgcaaacatgccctcgggttcttgttgacgagcaaagctcagggttgtggggacaaagaccaggacttaacaaatatttaagacatctttgttgatgctgggattttgtggtacagaaaggaacttgccttgcatgttctgagcagtctggcttcctgcagctcccttacaacccgagctctcctccatttgagctacaacagagctcattaatccaagccacctggccctcagcactgtgtgttgggcactcatgctccaccgcacaactgaactaccctagtcaaggcctagaaacctggaaaataatccaacatcctggtaaggtggtaagctcctcatcactggaggcatttatgtaatgcctagggaactttgcaggggtctttgcccaggttaagtggctaggaccaggctgactgctcttcccccagtccaagggatatttgatttctttcccattcagggaacacagattatttttccttttagttctggaagcagagatggcacaagggagctggggcaggatgctgagaacatggttcttcagtccgctctgcatacagggccacctaaagggggacctgtggactcttcaatagataggctttctgagtaaatgagccaagcccagccaggggctttttctggtgctgacggtgtcgtcttcctcctagccaagaccgaggataggtgtggccattggcgaccagatcctggacctcagcatcatcaagcacctctttactggtcctgtcctctccaaacaccaggatgtcttcaatcag

SEQ ID NO: 139886 - DNA, 2370 bp, Homo sapiens
aaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaaggtcagcctgtagcacggctttccccatcctgagagatgaaagtagtatctgtttactatttcacattgagagaaaagcctgagagccactcaagacagcagtgttaattacatagaataggaagtcaagtataactgggaataacaacagtagcaacagagtagccaccagtcatataatggaacgctttatcaacattacttgatttaattgcattaacaactctgtgtggtaggtgcttatcattcccattttacagatgaggaaactgcagcaggaggagattaggtaacttgaccaaacgcctgcagctaaccagaggcagagctgggattcacacccaggtagccaggcttcaggacaaaagccccaccgtgacatctgtgggattagtggtgggtcctgtgaccctggggagtgaagagtgagtgacggtgtttgtgaagagtcttccttttgcccaacttactaacctctggccttccacactttcacctatttaatcagtatttgctgggcactcactgcgtgtgagccctgcactgggttctggcgatggtcatggtttccagccgccaaggagcccaccagggggaaagacagacagtgaaaaagtaaatagcaaagctgactgagtattacgagatactgagtattgactggtggtgcttgacgtcctggggacacttgaacaggggccaatcctagacttggggtgctcgactcagggacaagggtgctgcaggtggtcagggaagcgaatacgaacgttcatctgagaccttactgttgagtgagagctggacaacggagctggggaagagtgttccaaaatggggacagaaggtggaaagcacctgtggaggtggaacttcccctccccgcggtatccccagcatctaacctgagacatcaagtgcattcagaagttatctgttgaatgagcaaatgaggaactggaagaaaatcattgagagagaggaaccagagatgaggccgttgagggaggggccagaatccaaaggctgaagatttagtaaagtgttctgaacgttagcctagaagccacgtaggggatggcatacccacgtgatgtgactggatcgtgtgttgggaagatcattccggctgcagtgttaaggttgcgctgaaagctggcaagaatccctggaggaagatgagttaagtgtgttgaaggaaggaaggccaccgctcagcatcagaaacaaaaagctgaattattgtttgcttgtaagggagaaccctgcttgtgggacatggtctgagaagagcaacctgctggccttaaatgggtaaaattatacacttcaggaattactggactttcagaagcagggctcagggctcgactggccctggtcatggaagtgcaggtacctgaatgtagctgctgcccatatctgagcccagaggtgtggggactctgcagactgccattgactaagtgtgaccaacttaaaactggctctgggggtttgtttgtcattatggccatagaatagtcctttcctttcttgaactcagagtgtgaggactctattcccagtagcttttgcacttaggcaggcaaaaggaagctgaggttgggctcggcggatggcagtggacagggaggcaggtgtccctcagggtcctgactcctgacctgatgtgggggagtatgtggatggtgtcactgtctgggggacagtgctgtgccatctcctgtacagccgactgagggtttctggctttgcctggtcaaggtcaagcctcagtgtggctggtttgactggacacatagggaaacagtttctttgcagtgggagttgttgaaccctgagattgaacgacagaggatcacgttaggaagctgtgcaggtgtcttgtttcctgtctgaggcaggttgggtgaagttctgcctcaggagtgtgactatggaagcccctccatctgtattgtggtcagtgagttgtggttgtttttggcagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagag

SEQ ID NO: 139887 - DNA, 749 bp, Homo sapiens
gttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaag

SEQ ID NO: 139888 - DNA, 1031 bp, Homo sapiens
gggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgagtgagtgatgggcctggaaggggccatgctgagggtgtggctgggaggctcagctctgagactggaagggcgaactgctgggaatccctgacccaagcaagaccttgttcttgcccccagtctggtccatggcctcagaaagatgggtttaactctgtcacaagagacgtggttcccatcctccctttgccgttatgttcttaccttgggcacaagtgtttggctgtgtcttgctctggccacaggcctgctgtccaggaatgttaacctgcttagccacccaggatttctgaggggtctcccttgtcactgatgctgatcagatctctaaaggccctaaaggtcctgctctaacttcataactgaagtgagtctggcccatttctagccccctgcctgggcccccatggatctctaagtggtatcacaaaaccaccctgccccattttctgagccatgattctgatacatatagaatgtgaacatcatggcaggcccaagcttagcaatgctgtccatctgggggtggggagggccatgttgacaccccacacctcccactaagatctaggagcacccagctgctttaagagctagagggacatgttagggcctgggggcatctctgccagtctttcctctgaggcagtgggtcagtgggggaggagggtcctccccaaagcctcctcttcctcctctgtcccagtcccagagctgccctttaggccttccttttgcctcaggcccatccctactcctctcctcacacagaggggacctcaccccagacgaggtggtggccctagtgggccagggcctgcaggagggggagcgagacttcggggtcaaggcccggtccatcctgtgctgcatgcgccaccagccca

SEQ ID NO: 139889 - DNA, 500 bp, Homo sapiens
ccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgcccca

SEQ ID NO: 139890 - DNA, 1122 bp, Homo sapiens
gtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagaggtgtgcggaggaggagggtgggtgcaaagggcaggggctggggacgcccgggcactgcagacttggtctcagggcgacgctgagtcccaggcccggggcgcagggatgggaaactagggcctggggcgggattccgggcgtgggcggggcccggggcggggcacagggggcgggggagtgggcggggcccgaggccgggcgctggaggcgagggcggggcagggacgggtccaagggcaggaggctgggacaggacggggatgcaaagggaggggcggggcccgagacggggaggagggggagggcccaaggggaggaggcggggtccggacggggatgccaagagcagggatgggagcgagcctgcgtccgggcactggtccccatccgtgagtcccctcggtgctccctgcccgccgtggccatcctctcacatcactcacaaccccaaggcgcggcatggttgacacccccacgttaggacggagaccctgggcttagttagagggggcagtactaaccagtccctggcggaaacgctttggctgggtgaggtgagcgggatcgcccccatttctccagagaggggtcccggctcagcgagggaaagaggccgccgctggggggacggctggccggggcccctccctggagaacgagaggccgccgctggagggggatggactgtcggagcgacactcagcgaccgccctacctcctcccgccccgcagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccag

SEQ ID NO: 139891 - DNA, 3429 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttccctctggggattgagggactcaagacaccccgcgcctgcgcttttcttttctttttttctttttttttttttgagacggagtttcgctcagtcgcccaggctggagtgcagtggcgtgatctcaactcactgcaagctccacctcccaggttcacgccattctcctgcctcagcctcccgagtagctgggactacaggcgccagccaccaagcccggctaattttttgtattttttagtagagacggggtttcaccgtgttagccaggatggtctcgatctcctgacctcgtgatctgcccacctcggcctcccagaatgctggggttacaggcgtgagccactgctccctgctgcctacgctctctgggtcgcagcccagccttctgggggctgggtagcctcccagaagggcaaccctgggcatcctccagggcaggctaactggagtctagtggggaggggtaccttgaaagaggaaagttgtttcctcctcctcctcctcctccagtgtttgggacccttcctgggggctggagtgcatccctggacaccccccaatcccatcctcttctctagtttccactgacctaggcccaccctcccctctccggctcagtactcctggaaatgagattccgtacatttgaatcttgtcctaatgaaatatttgtccatgtgggtacctgtgtgtgtgtggtgggggtgcagacggagggtttgtttctcactagctggaactactggggtgtggtatgcttcctgggaatttgtgtgccacagtcctggaggcgaggagggggttgtgagccagtaggcaggggctggggcaagtagcattgtgaagctattgacacccagacgtccccaggcaggagattatgcccccattagcccccttttatctgggcttccttaacaatggactctttgccctgcctgccagagccagcagggagtgactgttcagtggtgaggaagcgggcagaggaagccctgccattgggtaggagcagtgggcagcccctgggctgactgggaggtggggattagggattagacagtcctggctgtctgccttcccctaagccagggggagaggagcaaagggcacgaaatgtggcctccaggaggattagaccgccacatgatcatttgcacaccctggggtttagcaacaataaaagtcagcttttttgtatcccaaggtggcctgtggacacccacatggacaaatgtttacactgggacagaattcaaatgcagaggtcccaggagcctaaagtacactcactctggtatagaaaggattccttactgggcagaggacaggtgcagcctggggctttcccaggcaggacacagggaggctcaggaaccaccaagtccctggaaggtggatctggaggcgttggcaggagccactccctgggttccagggctccaggttcctgctttaaccccctgtctcacagagggctgtgcacttgggggctgctgagcatgtcccagaggctgcatcctggacacagcacctcagtgcatctgagctgaggctaacttggcaggagggacaggcagaacctgccagccacgtgcaattccacccctctggccactcagggaaggagagctgtgagtcaagatcagatttgggtcaggacaggctggggcctgcctgtccctgtgcatcccaagatttatggctggccaggggttgggctgggaggggtggtcttgcatgccaggagagtgcagatcagcctgagaggccaggccagtaagtgaggtcagatctcctgcacctgatagcattaaggccatctacaccaaagctctaatgctgatatgttcctggcctctatgtggggcatggaggtggggcatggaggtgaggcctgctcgcctgggcttctggaagtgggagactcattcctgtggctgaggcctacagcagtgctgtgtggtaggaatacactggaagccatgatgtcattgtgcattttctagaagccacattgaataaagtaaaagacacaggtagaattaatttcattgagcccaatatatccaaaataatatcattttcacatctattcaatataaaaatttactaatgagatatttcatactaagccactgaaatccagtttgtatcttacacatctcagttttgacgagccacatttcaagggcgtgatagccacatgtggctcccatagtagacagtactggtctagagaaatgttggtggcatccttgctgtctggtttctggccttgccaaaagtattaccatcccagtgtggtacattctttcatgtatttgtctcctgtccccagagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggat

SEQ ID NO: 139892 - DNA, 5480 bp, Homo sapiens
gctagactttggaaaatagggaaaatatatctttgacaatgtgacactaaaccaaggctgtccagatcctgtggcatgattgcagttgcctcttttcactgttccaagactgatttaggacgacctgtctgtttttgttgaagacatcagagtaccatgatatcatgtatcctgcttggacattttgggaagggggacctgctgtttggccaatttatcctacaggtcttggacggtgggacctcttcagagaagatctggtaaggtaggtcctttaaagaggttttattttttctctttctgggttttcttgaaataagccatagaatataaccaattatttactttttttttttttgagacggagtttcgccctttttgcccaggctagagtgcaatggcgtgatctcagctcaccgcaacctccgcctcccaggttcaagtgattctcttgcctcagcctcccgagtagctgggattacaggcatgtgccaccacacccggctaatttcgtatttttagtagagacggggtgtctccatgttggtcaggctggtcttgaactcctgacctcaggtgatctgcccacctcagcctcccaaagtgctgggattacaggcgtgagccaccgcgcccagcctatttatttttaagtgactaatttttaagttaaaaattaaagacagaaaactgtagtgtaaacaattttgtacgtgtctaataatatttacatatccatagaaaggggcagaatagtctatcctaaactatcagcaatgcctctttgcaagggattatcagagacttttgttttgtattttaaatttttctttctttttttttttttttgcgacacagtcatgttctgtctcccaggctggagtgcagtggtgctatcgcggctcactgcaacctctgcctcccaggttcaagcaattctcttgcctcagcctcccgagtagctgggattacaggcatgtgccaccacacctggctaattttttgtatttttagtagagatgtggttttgccatgttgcccaggctggtctggaactcctggcctcaagtgatccacccacctcggcctcccaaagtgctgggattacaggcacgagcccctgtgctcagtcagtattttcaatttttctatacttaagattctttaaataagagtgcattctttcatagtaagaaaaaatgaatgacctcgtcataggggggatagaaaattatttggaagaatataaacatacttggcaattgagagctaagtagtttaggcagggctgagggagcataaatgtcccataagcatctcaagtacaagcttattccagatcctctctgattcatgactgagacatgccttggcctgttgactccatcctgctatcatttcagaatttagattgtgtagctcatccaagctgtaggtatttcttacctagctacattttacatcatgattcaaacaactttggtgcttaattagagaacttccggaaacacagtcattataggccttctctcaggtataaggaaagcaaacaattcaaccttgtttccataaatacctatcacctctcccaagtgtggctgaagattcaaagaggattaaggtaatattcccttcctgaagaaacgtacagggctgcagtcctcagtggtgggtagagccctttgttaaaaaacaaacttctctagtgggtataatttggaaattttaaaaaataataacttagtctcatattttacagaactggaactagaaattgtctttgtccagccctttatttcagggataagggaatgaaggtacagaaaggtttagtgatctggtcaaggtcagaagcaaatctaggcctaaagaccaggtttccaagtgcattatccaacctactttactggttaatattccttgtgttttcctgacattgagactgtcatttcttgtttatttttgggttttgaacataattttgagagggggggaaaaaggtgtggtttttttgtttcttggttgttttttaaaattttttgtagagacaggtcttgctatgtttcccagcctgatctcaaactcctgggctcaagtgatcctcccaccttggcctccaaagtgctgggattacaggcatgagccaccacactaagctggaaaaaaggttttaaacttttttttccctaagttattcttggccttggccttaattttctaatcctttccccccctcctcaggtacttgcaaatacccttttcacattcttctttttgtagctcttttcccacctgccatgcagctgctttgttttcaaaatctttaaaaacatttttactgattatgaaacctatatatgctcataaaattttacaaatatgtataactcaggcaactttccccctaacttattggtgtatctaagtaatctttccatgtctttgtttcatgtcagtacatatgaaagagtcactttatttatttgtttgtttgtttatttttaaaaggcaggatctcactatgttgcccaggctggactcaaactcctggggtcaaggtgttatccagttactccaccgtgtagttattaataccattttcccccaggtaaactagtaagcaatttttaggcagatagaatgttttaaagtctaatcttatatgaatacttttttcttttgataccttcccattttattcaattgaatttattcatggttatagaaatacaattttgttttttagaaccctctgtttagaatctctaatgatgttcatttgttaccttgaaaatttaataatctgcttgtttatccatctgcactgatgtctgcctgccactgttcattctatttttctgatattttgggagtttgtgcccactgatttatatttcactctgtagaagaattcattgttctttacagatcgaagatttcatttgttactgtcagagagggtttaaaaaagagggctggggtagcaccaggctgtggtggccaccgttagcacttgcctggagaaacaagtcctaacctaggtcttttgagggaggatgggtaggttaggagaatgaaagagagagaacagtgatacacagtttgggtttgtgtatatgaaacacagcttccccaggagccaaggaaataaagagaagtaactttgagtataaattgatacatgttttgttagatagtttgacaatatgtatcaaaattggaaatgtatactgtgtatcctttgacctagctgtttcatgtctagaatgtatcctaaggaattaatcagatgaatgtgcaaagatttgtgtacaaggatgtttactaccatgttgtttcttagagcagaaagttggaaactacctaaaagtccatcaataaaggatgaagtgaatcataacatgactataaaatggaatttttgcagtgagtctttgccagagattataaaatggaatatcgtgcatgaatggaaaggcagtgtaggttttaaaaactctgggttcaaatcctggctcttattagctgcatgactctgtgcaagttgcttaacctctaaaggacctcatttgtaaaataggggtgataaaacctacctcttaagattgtgagaatgattttttatttacaaagcacttaaaacaatgtctgtaacatagtgaagtgctatatagatgttggctgttattattatttatatttcctattaagattgttacctaacagtatgtatggtgtgacctctgttacatagagcaaagtttctcagtactagtgttgctgacatttggggctggataattctttgtcctgggagctgtcctaaccactgtaggattgttcagcagcatttctgatctttacccactaaatgccagtagcagtcccctagtagtaacaatcaaaaatgtctacagacatggccaaatgtcccctgggtgggagggacgggcaaaattacccccagttgaaagctactaatatgaataaatgattgcaaggaaattctcggctaaaatgttacattgttacctctggacagggagattccagacgacttcttacttttatctttatgctttttcatgagaactttgcatgaggagcatgaaacattttccactaaaaacaaaacaacaaaaatccagtgctatagtgtctctgcttgggcaggaagaagtatggggaaaacaagatagttctggccttagactggagaatcaggtaaaggtgatccatccagaaaaggccagaggatgagccacgttggctgagggtggaggtctgagggcctggaaaatactgagcagcgttctcagctgagtgaaaatgagcagcatgacattatatgtatctgaaaaggacctgtgcctagaaagtttatatcctaagtttctccgttactgtaatccagcccatcaatccctcattaacttcagttcagccttcccttcctttttcagagaagatgctgtgcagacttctgtgcagggagggttcctacgaagcaagttaagaatgatgcatctgtgagctagcagtttcagtaaggaaggctggtcatggtaatgtgtactgagatctgactttcaaggacttcatctttatagagcacttagtctggctttaagaatacaaaggtgcttttcaaatatcaaactaaatctgatgacacttcccacctatggaaaacataaaatcagagagtgatttccctttcattccatttctgatgcttttttatttttttgcagttctgtacacataattaatttcatcagtagcaccctacttaaagtacagaggaaatccacatttgccaaattataaacagacctaatcatgaccttcagggtttgggggcttttctttcaatgttgttaacttgttaatggggagtagatttgtagatacaactgggtagcacctccagagcaatgaaatggtagcaaaaggaaacaaagtgtcctttagggctttttcttttgagtgactttgattagacttacttagaaatatgaagctctggccaggcacagtggctcacgcctgtaatcccagcactttgggaggccgaggcaggcggatcacgaagtcaggagatagagaccatcctggctaacacggtgaaaccctgtctctactaaaaaatacacaaaattagccgggcgtggtggcgggcgcctgtggtcccagctactcaggaggctgaggcaggagaatggcatgaacccaggaaggggagcttgcagtcagccaagatcgcgccactgcactccagcctggacgacagtgcgagactccgtctcaaaaaaaaaaaagaaatatgaagctctgaactaatcttcagaaatggttaaagcacattcttatatagttgaaaaagatatattgaaactaattaaattctatattcttaggtcagcagcacagtggccatggaaaaagaaaaactctacagcatatttccgaggatcaag

SEQ ID NO: 139893 - DNA, 383 bp, Homo sapiens
ggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacag

SEQ ID NO: 139894 - DNA, 4440 bp, Homo sapiens
atgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcattgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttccttttttttttttttttgagacgagatctctctctgccacccaggctggagtgcagtggcgcaatcatagttcactgtagcctcaaccttccaggctcaagagatcctcctaccccagcctttcaagtagctgggactacaggtgcgtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggaagaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatcgcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagttggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaacgtcatcgttgccaacacaatgcccactcacctcagcaacggacagatgt

SEQ ID NO: 139895 - DNA, 15775 bp, Homo sapiens
gtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccaggtatggtcctgactccacatctgcctggaaggaaggatgggatggtaggagagagacacagaaccaagggggaggattccagactgggagcagtgtggaggatttgtaccctcatcccctaacccaggaacgtccatggccctgatgggtgaatgacgttccaatcagagaaggagaatccagacgacctcaacaaggtgagaggagccccgtagagtattaggggtagtccaaggctgcctaaagaccagatctcttatctctctcattttgcagttggggaaactgaggcacggagagggaaaatgacttgcccaaagccagtgagtcagcaaactgaagcaggtcaagaatccagagggaaccctgaagttccctgagcagaaaacaatcggttaaaatctcattgccacttctgccttgaactccaaatcctccttcctgagctccaggcatggggtcccctccatcccctcacccagagcttgtctcatcggccatgcttccctccctgcctctcatcctcctcctgacttcccctgccacccgcaccacctgaggctggcagagagttcctggcaggttctccagtgctgacgggcacagccaccaggcccccactattccatccaggggacaccttcccactgggtccctatctggatgacttgggacattctttgttctacacttcatcctctctttgggatttctgagtccagacacagtgaggaccccgacagcccccctcctcacctcttgtcctgggaaggccaggcctgcatggcagagatgtaaccagactccaaagctttctgggccgggcttcatggaaggccgtatcggtgcaggggcataaacacaagctctggagccaggtagagatagttctaacaccattgccttggctcactgggaaaatgatgtttcttctctgagcctcagtttcctcacctgtgatgggagacgagaacccttccatcctcaaagcttgctctcagctgctatggaagcatctccaggttgtgatattaaatgaaccaaacaagatacagaacagtgtaagagcagaggctactcatgtatgatcttacatgctatctggtctgtataaagaaaccttggcagatacatctgtaagggatgtggttccccatagtgaggaagtcaaggagaacaggtgaacaggagacagctggaagcaagacttctcaatttacaccttttatgttttgattctgaaccatgcgaatgtagcaccaattcaaaactaaatgtaaagatgttcacaaattaagtaaaatattaaataataataataacacatacctcaataatatgaccggtgtgcagtcaagatttaggcccaggtactagaaattgactcaaagcaacagaggaggcctgtcttcaagtcaccgaatccttgacctagaaaggccctttattttgtcaacgtcaaattgcccataacaacaataatagtcttggtagcaagaatcaggagctccctacttggggaacatggtgccaagcactgtctgaacattatctcatttaattggcattttgattttgtgaggaaacgatcatcattccctctttacagatgggaaaactgagcctcgctgaggttttgactagtaagttgtagtaagtgatagaacttgatgccatcgaaggctttccaggttcaaatttgaagcccccctacagtgggtctcaatattggctgcacaaaaatatagacgcctggcacctccccacccctaccccaagattcgatcattgatctgtgatagggactgggcatctgtctttaattttaaaaaatctttttaaaaaatagacatagggtctcactatgttgcccaggctggtctcaaactcctgggttcaagtaaacctcccatctcagcctcccaaagtgctaggattataggtgtaagccaccatgttcggccaacatctgtatattttaaaggtttcagatgattctatttcatcttcagagatgagtctctgctttgttagacaaaacttctccaatgggaaaccaaggccagggagggaaatgaccttgcccaaggacacacagtggctggaaccagagctggggcaggacacccagcagcttacatgaagccctagggcaaataagaaaaaggcaccccactctgggcaggcagagctccatgggcacttcgcttggcaagtggaacaagggctgggtttccatccctacctgccctcttggctggagaacctttgtgcagtgagcaacctgcacaactgtacagggcagtaactctgatctgagcctcaggacttccaaacacttcaccttagtgacctggcaaatccctggggcccctcagaacaagagtatggggagaccaagggtggcttctgggatgtgggctcagccctcactccccaaaccagagtctgggtcaggcaggggctcccatcagccttcaggccccacaagggccgggaaggccgcatctaattcccaaggtcacccctgcagataaattcaggaacataaacaggagggatgaacataaacaggaggacagcaacaccctcagcccagatgtcataagccacctggcaggaggcagcctgcggagaagctccacccacacagatccaagtcctcctggcttccttcctgatcattctccagaccatactctctgccctacctccggagccttacagtcagcatctcccacagtgccctgctctctgcccttctcctggccatctctcactggcatccctggaagggaagggtagccctggagttagaggcacagactctagagacagactgcccaagttccaattccacttcttgtttctcatcagctgtgtgagcatgggtatatggctcaacctccctgtgcctctggtgtgtaaaaaattggtgaaaacattgcctacctcccagagtggctgggaggatcaaggaagtaacacatgcaaagctcctaaaacagctgcatatccagtggccatgatgatcaatgtgtatattttgcttcatttcattttcatgacaaccctggaagttaagtattataattcccaatttacaggtgaagaaactgaggctcagagaggtggagagagtcagggcagggctctacatctttttttgtgatagggactgggcatctgtctttaattttaaaaaatctttttaaaaaatagacacagggtctcactatgttgcccaggctggtctcaaactcttgggctcaagtaatcctcccatctcagcctcccaaagtgctgatgcctccagagacaggacgtggctgagatggattataacgtagtctccggtttgcagtgcctggctgctggtcatatcctcacagggcccatgggacacagagccaggtgcattcccctgacttgggtcttccaatggctctcaggcacctctctgcttccagccagccctgggaggagggggagaacggcatggcaaggcgtttgcagagccgtcttgttcaccaatgtctttcaagacattgcccgggtccacagagagcccaccattcattcccatgctggctggagcccctgaatacccgaggtgaccttctgtccttggacaagtcacttccccctctgatctccatctccccatctgtgcaatgaggggatggggctgaatcagtggttttccaaccctcaaataaaatattaagactacatgtaaaagggagtcgctggttgaagctgggcctgtggatgcatacccttggctcctgggagcctcggaacccagcttgaaaaaccccagcccacatcctcctaaagattctcctggctctgacactgcagagttctagaaccccaagctcaaagctgccgcttcccatccctgtttggaaagctctcccccagctgcctttatctctctttggtaacagagcaaatttgctcaggacccagcacagggggaacaagcagactgttgactcttgagcaaagcctcttctttggagagcagccgaggtggccgtgggctatgcgttgggaggccagcggcctcttgcataaccctggaggcctcctgcccacccaggccttttcagggttaggggtgaggaaaaccgcaaactcatgcccagttaattttttaaggcaaaatcaacaggctcagcaatgattagcagctgggtaagttggtcttaatcaggctaaggacagggagggaggaaggaggcccagggatggggcccagttatcagttaaccacatgaatgttgcttccttccaaacccactggccttcagccccaagctccctcatcttcctctcggaaatactcctgtgacaagccagtggccacccatcatcgggtgaacaagccagtggccacccatcatcgggtgaacaaacacaatgccactcatggtctgtgatgaagtagaaagtgctcgttgttaagacaaagctcacccaccaccgctgcgtggacttgagcaagtccctttcaccctctgaggctccgtgaggggccccaggtctgggccccaagtctatggttcagtctgtggccagctgccactcccctgacggcctcagtgtttccgtccactaaatgggtgggttagccaaggcatcttttccagtcttgaagctttgtgggtgcctgatttgattaagccacagtggcctttgccgagtgcagagggtggtatgagtggcattttaggagctcaaggaagagaaagggaggggacctacctggtatctgccgttggtatcagcaagtgtcagatcccagctccaggaagagggctgtcctctcagatgggaggcaggggtccagtggggtggctgtggctgcagggacagcctagcagagcctcttggtggcccagaccccctgtccctggaccttggaagccgctaaaggaagcagcaagaccaggccagctggtggctgcctggactggagtttggtcagtggttggggacctatattgtgagatagttaggactttgtccacaaactggaatttgaaatttcaaaggggcaaaactgaagggccctaccccagagtagagatggctcttggcttctttcctccacgacttttgttctttgtcttgataagtcccagttttctctgcacctctcccggagtggtgggtggggaagaaaagataggagataatggtgtggtgagcgccaaggggaagtgaagatgccaagcagccctggggtggccaggcgtgtggaggatgcccctgcccctgcctataccccgggataaggtgctttacttctcaggtccttgagttcccctgcaagactgaggcagtgaaaccaccagctccagtgccttagaattccgaagtcctttcagggattccaggagtcatgatgcaggcaatgcgtagaggggtgaagccctcaagctctggaggcagactcgggttcaaacaacagcccctcccttacgagctgtgtggctttgggcaagtcacttcacctctctgagcctcaatttcatcatctttaaaatggggatgacaatagcccctatctcaacaggcagataatatgagaaggctagaaggtttttagcaccagggctagcacaaaatttctctgtaaacattagaccttattataatgtaaaagagaaacaatgtggttcgtagtggcagctcccttaccaccgtccacagcagaggcacaagctccctacacatgcctccccaactgcaggttgcccagggcaatcccttcccgtctcaactgggtctctctgtgggctctgaggtcctctgctatcccctggaatctgctgcctcttgagctggggcccgacagcaagtgagcagaggtaaagaacagctgctaaattgatggcattgaggctagtgcttgttcatggctgggtgtgtggtacctggagctgtcctgagcaggggtcctgattccaactgattatgtggccagtgtgtcatgcaatcaatgaccaatgacagtgattgctactattgtactgtatgcctacacgtggtcatttaatgcttgaaccatccctacaaagaaggtatcaacccaatttttctgatgcttaaactaaggctgagaaaagtagaagttgaggtcacagagtttggtacattggcactgcctggattttaacctagatctatctgacccacaaggtctgtggtttattcccctaaagagaggtcaggggaagagaggctaagaagcttatctactctctcatttaatcttcacgacaaacgacaagttagaccccttgtacagaaggagtaaccaaggcttcgaaataaaaacttgccttgtgcagacagctggccctgggcttggaatataaatagtcactggtatacaggcaccagagaccaatacccacaggctaacacccactcagtccacagaaagaagcttaatattttttataagcatagaaataaaaaccaaaccaatactgtgacatttgctctgtgacttcctgtatttattatgtgctcatatgaaagcacctaagcattgtcaggataatgttcttcctcactggagggcgttatgaagttgctttcttttttccactagttaaaaaaaaaatcccttggaggaagggaatgaaactttttataattgatacataataattgtacatatatatggagcacatgtattttgatacatgcataccatgcaaagtatttaggatatccatcacctcaaacatttatcatttctttgtgttgggtacatttcagatcttctcttctggctattttgaaatataaagtaaatgattgttaactataatcgctctactgtgctataagaactagatcttattccttctatctcacttatttttgtacccatgaaccaacgtctcttcatcccctgaagaaaacattctttttttttttttagacagagtcttgctctgtcacccaggtgcagtggaacaatctcggctcactgcagcttccacctcccaggttcaagtgattctcctgcctcagcctcccaagtagcctggactgcaggggcatgccaccatgcctagctaatttttgatttttgtatttttagtagagacagggtttctccatgttggccaggctggtcttgaactcctgacctcaggtgatctgcctgcctcggcctcccaagatgctaggattacaggtgtgagcccctgtgcctggcctgaaactttcaaggtctcaagacactgtacatttaaagtaccccaatgttttccttttccacctcccgttctttctccttatctaacatgaagaacattgtattaaatctgatttttaaggagtttttgtctgttatgtgttaagggtttgtttggtaccccaatgaaaacattctgcattgcagaccaaagtgtgcttatttcaggggcatgggatcattgcgttcttagccattgtcacaaaatacatggagtcatatttaaaatgtaaagttgtaacatacatatgtttaaaatggaaatacaaagcaaaaagatggatgtacaatgtcatgtgtattcagttctctgtacttagtaaatgtaacaaactttctgtctattactgaactataggtgcaaggacacgtctccagttactttgcatctgtaatccacaaagattctgggcagctgtattatcatagcttggtttaaataaactatgtagtaacaatgaacaacaagaacaaaagaaataatagcttgcctgaggtcacagagccagcagatcttataggtggtgcgtcatttatatgaggaatgtgtatctaggagatactgtttggcgttggctaagggtggaatgaatcatgtatgtaatagattatgcaatttacagtgatgagtggatagatttacttatggggtaggttataatgtggtgggatgtgaatctagaatgtgcctcctaggcagtcatgcagattgtgcatttggtaagtcaggtatgtcatgattcatgtatctaatagctcttcatttgcagtgtccacctagtagctcttggatataacgggtcatggctgtggcatggtgtggttgatcttggttgatcgtagaccttatttaattgaatctaagatgtcatctatggaaaaatgcattgttatttttgttgccaatgaaattctgacatgacattgatcacattccccgttaagcaatgtggaactgtgcctcagagtggaagaggccatgtattcctggattgtgtggggagtagctgtgcctgtggcctgccataggtgccaggcaggtggcagaggcctgggctcagcccttggaggctcctcccggagctgccctccacatctcttctgtgtttaccccttggtcggatcttctgtttcttcccacctctgcactgcccccaaggccggtggagccaggtcagatactcctgaggtaggcatgggaggaacccgccggtatttggtctctttcagccccttatcaagtctcatagtgtgggttgcagggggctgcctcttgctccctccctcagagtcttgtcctggctaacagaaaactgagccaggatcatctttctattttacagagggagaaattgaagccctgagaagagacgatgtaaataaagttatcggaatagtgactgagctagttcctaaccccaggtctcctgacatcaaatctagcctctcttgtcctccacaacagttgctccctctcccctttccctacaggcaatagcactccccagtcatctcagcttcagaggtcagatcaagtggacagaataaagctaagcagggcagagaaagggcttctagcagtggaaagaacatgaagatgcctcctcataccactcgaacacacatgccctgactcccgatttgctcactcattaatccacccacacattcactcattcactcactcattaattcacccacccattcactcattaattcacccacccatttgctcacttactcagtaatttaccctcattcgttcattcactcactcattcatgcattcactcaactcactcattaattctccctgtctctaattcactcactcctaattcacccactcatcaattcccccacacactcactcattaattggtgctcccactaattcgcccactcttgctcacaggtgtcaccgaggccctccaacctgcccttccagccagcagtggaggacaggctcccaggcctcccaagtctcaggcttttcttcctctgccctcactctctgccttctacatcaagactttacttccccagattgattggcagcccttgaaaatgtctgcacagaaggcaatgagggctggagggagtgagaagaacagagtgcaccatgagcttcagacagccaggaccagctgtgtaattttcagggccccgtccaaaacaaaaatgcacaatcccttgttcaaaagtcatgatgaattttaggacaaccacagcagagcactgaaccaggaaccaggactttctaagggttgggttgcctgtgactgcactggcgatacccccacaaagcccactctgaaggtaggagacgggtggagagaaacagggggatggcaagggggatacgaaacagggagagggaggagggggaagaggatggacgtctaccaggccccacttggtgcttgatttatgccatctcatttccttctcaaaccaccctttgaagttgattgtacattttacagaaaaggaaactgaggctcggagaggagaatcatttacccaaggtcccagttagtagacggtaggtgcctgaatgtaaatccaggtctctgcctgctccgggagggggtgggggtgagggaaacaggagaatgtgatgggaaaatccgagatggagccagcctgggccagaaacactgggagctgtgggagacggagaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcag

SEQ ID NO: 139896 - DNA, 501 bp, Homo sapiens
aattgctcctcgtggtcatgcttctcctaactgcaaggctaacgctgtccagcccggctcctcctgcttgtgacctccgagtcctcagtaaactgcttcgtgactcccatgtccttcacagcagactggtgagaactcccaacattatcccctttatccgcgtaactggtaagacacccatactcccaggaagacaccatcacttcctctaactccttgacccaatgactattcttcccatattgtccccacctactgatcacactctctgacaaggattattcttcacaatacagcccgcatttaaaagctctcgtctagagatagtactcatggaggactagcctgcttattaggctaccatagctctctctatttcagctcccttctccccccaccaatctttttcaacagagccagtgcccagaggttcaccctttgcctacacctgtcctgctgcctgctgtggactttagcttgggagaatggaaaacccagatg

SEQ ID NO: 139897 - DNA, 2807 bp, Homo sapiens
gtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccaggtatatatgagaaagtgggcagacctctcccttccatgctgtgtgtggccctcagatattctgcccgctaagcgcaaacatagtgctttagcttggtttaaatggcactttattgcagctttcctgccccacccaggcagttgctgctttttttctctcttaatgaccagtaggtggggcttggggcccccccagtgtgggggactactaagggcctggtttcactgtcagtttcagttgattgcaagtgatcagaactggccctggaatagcaacctccttgctgcaaggtgtggtgaactctgtgtctccaatgtgcatattgtttaggttaatttacgtttgttgctggaagcaacaactggatcacccttgagcccatgccactcttgagtgttctatcttaaaaggtggagatatggtccttgtctttcaggaagttataatttaaaagagaaaggcatgaaacgtctgctttggtggtgatattaaggaactagctgtgtgtctggtgggaagtgtgccctctatgtgtatattttggaatataaaactaaatccctgtcctaatattggaatgtttaggggctatttgggggcaagcattggtaggctggatttttttttttttttttttttgagacagggtctcaccctgtcacccaggctggagttcagtgatgtgatcatagttcactgtagtcttgaactcctgggctcaagcgatcctcccacctcagcctcctgagtagctaggaccacaagcgcctgccaccatgcctggctagatagggtcttgctatgtgcccaggttggtctcaaactcctggccttcaacagtcctccaagctcagtctcccaaagctctgagatgacaggtgtgagccactgcacccagcctgaatttgtgtttttctatattttgtttgattataagtgtaatgtacacttattattaacaattcaaaccgtactgaagtataagaagaaaagaggaagatgccctttcactgatcacattctgcctcccgcccaatctcattccccagtgttgctatggtgatattaatagttgggcattaatctctccaaatctttatatagagaaaatgcacacttgcgtgtatgtgtatgtatatgttcacgtaatacagatacagacttttttaactgaaatgggatcatacaagatagactgatgtgcagctggctttttcacttaactatgtattagacatcttttatgccagtgggttatagatagagcccattctctttagggaatggaatgccttgtgctgtctacagtacaaatgagtcgtgatttttttccccaacttttcaccattctcttattagaggacatttgtgttgtaagcactgggttttaaaggtctcacatgctcttggtcatccattcctgtggacagtagtcctctgaatgggaaagtatatttcataaacgcccatcacagaggaagaagtactgtcacgactgtgcacaaagctagaggctttgccatccccagggcccttggccctgtgtcgctcattgaactctcctccctacttgctggcagccttcactgtccttgtctttcagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaaggtaacagcagcttcaggttcagaaaagagctgctccttcagtaaacaaatctcacttcctctgaacaccatgtttagaattactaattatacacagcatagagacagacttaaagaaataggaaacctccatataattaaggtgctctagtcactaatctccaaattggtcactacttctgaaatcccagctaatctggttaattattaaaaccatcattcaggtgtattgtgtaaactaaagaaacctggccttcagggcagagcctacattgtctcttggtgcaaaactgaatatgtagttggtctagacatccatacatcctcctcaaggtcatgccatttttaacacccttcattgtccccaacactgaaatgtatcttacaagagaatggaactcaggccctaaaagaaattagattgaacctaaaagaaaatggtcagtgggaagactgatgtttgtttccagtctgaaatgtaattcccggactttagtggcacaggcactgtgcatcactgtggaagtgacatgtggccatgtgtggtggatagcaagtaacgcccacctgcagagccttttatcgtgccgtgcggctgtttctctcgcaccagctgtctctaacaccacgcttgtgactctcaggctgggtttggacaggtctgctttcgatagctctcatttcacattctggttatttcctagagcaaaacctcagaagccctggctaaactcatgtctctccaagccacagaagccaccgttgtgacccttggtgaggacaatttaatcatcag

SEQ ID NO: 139898 - DNA, 3863 bp, Homo sapiens
ccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaactaacagtggtctagagcttacttcatgccaggcactgttcttttcatcgatgatgactcacttgatcctcacaacaaccctgtgcaggaagaatgttttgtgtctccattttacacatcagagaggctgaatgacctgcctatagcctcacaggcagacacaggatttgaattaagcattgagtctcttaaccacaatactacgttgcctaatcgggggggaggtggggacaaattggcaaaaaacaaaagaagtggattaagaccaggggtagggagattagaacacccagtggagcattgctgatgggacagggcttggtctgtcacggccaaggaggcctgccgtcccctgggccaagtcacctcttggggtggaagtaggggagctccactgcctttctgagctccctggcgtgccctgtgtccccacagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 139899 - DNA, 552 bp, Homo sapiens
ccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacaggttcttgttgggggagcttgtggtggagagggtgtggacgcttccccaacccttcccaagctgggatccccacccctgcagtggaacagatgatgctggtttctgtccacatggatgggtcgagtgagtcacattgggaacgtgactccagggtggaagatgaacccagcctctggcctctggccccagctctgacatggcctgtgtcctccaaccccggccagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagg

SEQ ID NO: 139900 - DNA, 283 bp, Homo sapiens
agcaggtaatggcaagcatggctgccgtgctcacctgggctctggctcttctttcaggtgggtctccgaccctgacttcaacgtgggggtgtgggtggaggctggccagagggccctgtccaccctgggggaggagagcccaggccctgattacctagtccctctccacagcgttttcggccacccaggcacggaaaggcttctgggactacttcagccagaccagcggggacaaaggcagggtggagcagatccatcagcagaagatggctcgcgagcccgc

SEQ ID NO: 139901 - DNA, 493 bp, Homo sapiens
gtctcaatattagagtctcaacccccaataaatataggactggagatgtctgaggctcattctgccctcgagcccaccgggaacgaaagagaagctctatctcccctccaggagcccagctatgaactccttctccacaagtaagtgcaggaaatccttagccctggaactgccagcggcggtcgagccctgtgtgagggaggggtgtgtggcccagggagggctggcgggcggccagcagcagaggcaggctcccagctgtgctgtcagctcacccctgcgctcgctcccctccggcacaggcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggag

SEQ ID NO: 139902 - DNA, 5334 bp, Homo sapiens
tcttcctggctatccagaagaacaagcctatcagcaagaaggaaatgattcagaggtccaaacggtaagaccaagaaaacaagagtacgtatacaagtgtaaaccaggccaccaagtggtcgggagctctggcttgcacccagaataaatgtattatactcaagtttaaacattatgagaaagttgtgagagtcatttctcacttatggcactgaaaaaaaaaaaagcacatcatggtatgaatgactcatatgcaaaagatgaaaaacttctcactaatttgcatgtcttaggctcctctttattagaaacctaaatgtaaataaagaatattttaggccaggtacggtggctcatgcctgtaatcccagcacttagggaggccgaggtgtgcagatcacatgaggttaggagttcgagaccagcctggccaacatggtgaaactccatctctactcaaaatacaaaaattagctgggtgtggaggcacacgcctgtaatcccagctactcagtaggctgagccgggaggatctcttgaacctgggaggcagaggttgcagtgagcttagatggtgccactgtactccagtctgggcgacagaacgagactccatctcaaaaaaattaaaaaaaaagattattttgaaataaaattaaatatgtatttagaccacatcttttattctagcaatcccatttctaggaattgatcccatagggtgagaaagaacagtgttctccagaacacagtaagttaaacttttttaaaagattaaaatttcgaagcatgtgaacactgtttccatttgtggtctttaaaaataagtatttgtgcctatgtagatgtgtgtacttttatatgcatagaatatttctggaagacagaaaaaactggtaatactgattgcctttggaaaggataacagtagattttttgactttttataatttttgaattttgtgccatgatgaacgaacattagctactcgttaattaattcatttgagtgttgaatgtggtggtacatttctgtaatcctacctactcaggagtcttaggtgagagaatctcttaagcccaggaatttgagactgcagtgagctgtgatcacaccattacgctccggcctgggtaacagactgaaactctgtattcaaaaaataataaatacaatttttaaaaattaattcatttcagatattcatatattgatcatgagaatgccagagaataaggttgacttttttaggcattcattggacacttgctttaataagaatagtttcttagttggcataatgcttctgaagtaatggtactttaaaataatttatctcatgaactttaagcattcctcttgaaatcttgtttttactctatctagtcagcccttataggcaatccaaagggatgctttggatgctttagtccagtggttctcagagagtggtctgtggagtcctggaagttgctgagaccctttcaggcaatttgcaagctcaaaactaatttcagaatgacaccaggatgttctgtgccttttttgctgtgttggctatttgcactgatgatgcaagagaaatggggaggagtaaaatcactggtgtcttaccactattcaagacagtggcaccaaactgtagtagtctagtaggcattgtatcctgcacagcctcccgccaggagtgtgatggaagaacaaggaagcagtgtaaatggaggtacacgggaagcacttcctttgcaccgtgaaggatgatgactgttttaaggaaaagcacttatgccatggtttgtgtcgtgagctgaaccagctgcctttttcatggaacatgacttttacttgaaagagtaactgacagaaaaccaattattctgacttgtgtttgtagcagacattttcttgaaaatgaagaagtgggtctgtgacttcaggaaaatgtctgacagtatctgttgccaaagaaaatgtgagttttcaagccaacaatagaaatctagaaaacttgtattcacctccatgggcttgatgacctcttagtacttagacctttctgacgagataagcggtggcattaacaaatgtgatgtttttcatgttatctaaatacatttgtcaacatttggaagatctgcacaactccctggaccaggattttccaaatgattgttgctttttgttacaaaatcagggaatagatagaagattcattcaaataatgaaagatagactgatggatttttatgtaacagaataggaaaagtttatgacatgttttcagattccaccttgcaactaatttttaagaagctaccacttgtcagccaggcacagtggctcacgcctataatcccaacactttgggagtccaaggtgggcagatcacttgaggtcaggagttcaagcctggccaacatggtgaaagacttctctactaaaactacaaaaattagctgggcatggtggtgggtacctgtaatcccagctactctggaggctgaggcaggagaattgcctgagcctgggaggcagaggttgcagtgagccaagatcgcgccactgcacaccagcctgggcaacaagtgcgaaactctgtctcaaaaaaaaaaaaagaaagaaaagaaactatcacttatcaagtttgggtgtagtatcaaagaagatcaagagttacctgaaaagagtattgcagtaacttctctcgtttccaagtacgtggaaaatctatatgtaagctggattttttaatgtatactttaaccagagcaggttgggacagcagacttaatacagaagcagatacaagtccagctgtcttccattaaaccagacattaaagagttttctaaaaaatgtaaacagtgccactcttctcactaacatttttttgttttcaaaaagtctttatttcccattaaaaatacaggtttcttatgttagcctgtcacaggcttattgttatttcaagtgaataaaaaaataaagttttgcttaatttttaattttaatttttgatacagtatcaatagataaaacctacattgggatcttcagcatttgggagtgtgaagggggccctaagtctaaaatatttttgaaccactgcttcattctaactcagtcacaaaatggaattaggggaaatcatacagggtttgttgtggggcagctactaatactctcacctcagcaagagcagtccctgctgtaagggactaggaagcttgcctacaggaagacagccaggacatctcctaaaatgtatcaatgctttcgacgagaaatatatgagtggatttagtgcccatcttctggagagactttttaaactgtttttaaactggtacattttcattaggttgcttctgttcatgtttatttcttgtgtggcctcttttcaagggagtgatctgtttccatctgagaatcttcaatatcatctagtaactcttaatatttaggaaactacaacccagagaggggaagtaacccagcaagttagggtcacagctggagttagagcctggtgtttggccttcaattgtgtcctattaaggatttgtgtctctggagcctgtgttactcatcttttgttatcacctatctctaccaaagatatttaaaggttcccgtgagaaggaaagatttcaagaggaaagaacatagctcttttatttggaagcacttgttccagagtggccttcaggagacaccttcaccttctctaatgtgtttcccgcagagccctccatgaatctagtgattttttttccagattatagaaaactttaggaaatatagagaaaagtagaaaaaagaaaatgaatatcacttatcatccttccatctaatggaggatgggaatttttggtgggaggcgtgggaattttgcagagacctgcataacacacacttttttccctcaaattgttaatcatactgcatatacaggtttgtgtcttgctttattttattcaacattatgttgtgaacctttcctatgacactaaaaattctgaaacttttgtttggtatacatgaaacatacttgtaacatatacattccattatacttcataatctatttaactgttgttttgttggaaacgtatttacaatgagagtgcatttatcaaatgcacatttgtgtttctcccaacttaaaatcattgccacccaacccctgctagaacagatcccatgtttttcacatggccacaagatcctctctgcagcccacctcaccctcacccccatctgtttcccacctattcctttacgctcctttttgggaagcctcgagtccatttttaccaacactcattttccccaccttgagtgtcttctgtccttctccccattccctttctgctcttatccatcattattatttttttattattattattatttttgagatggagtctcactttatcacccagctgtagtgcagcagtggcttgatcttggctcagtgcaacctctgccacccaggttcaagcgattctcctgcctcagcctcctgagtagctgagattacaggcatctgccaccatgcccacctaattttttttttttttttttggtgtgtgtggttttagtagagacgggctttcaccatcttggccaggctgctcttgaactcctgacctcgtgatccacccacctcagcctcccaaagtgctgggtttacaggcttcagccactgcacccagcgctcctatctattcttaagacccaacttacctataatttcctctctggagcctttccgaacctccttccaccagaccaagtttcttctcctctagaacattttataggtgtgaccattttagtacttttccataatttcacttgtgtttccaaacacaatagtaacgctgttcattatcttatattgaaacagtccatttttgcatgtagagcagaaagtagaagttcagctctccttcatttatctcactcctttcccccctttatcccacttctttccacatgtaagcactattaggattttattgtgtttgtatttatctccccttccagattgtgagccccgggctagggttttctgtgctggagtatctaacggggcccagggcctttctgagagggatgagctcctggagagtgggaggtatagggagggatgatgagaggagatctcatgactctgcaccctggtaacctccccgatttctgtcctttcactggtgccatttctaaggatttatgagcagcttccagaagtacagaaaaagagagaagaagagaagagaaaatcagaatataagtcataccggctgcgagcccagctatataaaaag

SEQ ID NO: 139903 - DNA, 517 bp, Homo sapiens
gatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactggtgagaacacacctgaggggctagggccatatggaaacatgacagaaggggagagagaaaggagacacgctgcagggggcaggaagctgggggaacccattctcccaaaaataaggggtctgaggggtggattccctgggtttcaggtctgggtcctgaatgggaattcctggaataccagctgacaatgatttcctcctcatctttcaacctcacctctcctcatctaagaattgctcctcgtggtcatgcttctcctaactgcaaggctaacgctgtccagcccggctcctcctgcttgtgacctccgagtcctcagtaaactgcttcgtgactcccatgtccttcacagcagactg

SEQ ID NO: 139904 - DNA, 4977 bp, Homo sapiens
ggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcag

SEQ ID NO: 139905 - DNA, 1789 bp, Homo sapiens
cgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgagttggtggtgagggggcaggtgttctggggtgcagctcttctttgcctccctgattgccaggagctaccagttactgtctgcacaatcaaacagaaatagacctgtccttgatggttaacggaaataaaaggcgcttgtcccagaagctcaggtgaggcaccaccctgattatgggaatcacctgggaacatatacccagacctaaaactcagatccacttcccaggctgtggttatatagtcaggggggtgcagtatgggtattaggattttttattttttagttataaagatttttttttggtttgtttttgagacagggtcttgctctgccgcttaggctggagtgcagtggtgcaatcatagctcactgaagcctcagactcctgggttcaagcagtcctcccacctcagcctcctaaggagctgggacccacaggcatgcagcaccacacctggctaatttttaaaaattttgtggagtgttgcccaggctggtctcacactcctggcctcaagcgatcctcccaccccagcctcccaatgtgttgggattacaggcatgagccattgtacccagccactaagatgattcttatttggaaacacggtcaagaacaactgcgttcggtagtttaaccttttttgattgtggtggttttagtatgccttaccactctaccatagtaagaaatttgcagaccatgtacaccaacctttggtgctcctggggagaaagaaagaaggctatgcaatgcaatgcatgctcacagtccaagggagagggaaagctgtctaacaggattggttttcccgtgtgctttataagcagatgagtagaggagacagctcttattgtcctagtggcaattgggataggctgcaaagtttgttagggtggaggcttattccgggaccaagggagcccaaagaaacaagctcctgccaggcgcggtggctcacgcctgtaatcccagcactttgggaggctgaggcaggtggatcacctgaggtcaggagtttgagaccagcctggccaacatggtgaaaccccgtctccatgaaaaatacaaaaattacccgggcatggtggcgggcacctgtaatcccagctactagggaggctgaggcaggaaaatggcttgaacctcggaagtggaggtggccgttagccgagatcacgccactgcactccagcctgggcaacagagcaagactctgccttaaaaaaaaaaaaaaaaaaaagaaaagtaaaaggaaaaaaaagaggctctggcctgctggggtgcctgcaaagtctccgtggaagggtgacattcaagccgagacctccagggaactgtctcctgggagcacagagccctttgctcagcccccaggtggctcagtgcccccagccagcagactcagagcttgcatgattctttggtgctctctgcggtcttccaatgatgctgaaataaatggtgcttggtgtctccctgctgtagtccccttgcttgctttgctcacaggtgctgggagagatatgccttcgaggatatttggatgcattcaggttcttggaagagaagg

SEQ ID NO: 139906 - DNA, 1363 bp, Homo sapiens
gcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggaggtgggtaggcttggcgatggggttgaagggcccggtgcgcatgcgttccccttgcccctgcgtgtggccgggggctgcctgcattaggaggtctttgctgggttctagagcactgtagatttgaggccaacggggccgactagactgacttctgtatttatcctttgctggtgtcaggaagttcctttcctttctggaaaatgcagaatgggtctgaaatccatgcccacctttggcatgagctgagggttattgcttctcagggcttccttttccctttccaaaaaattaggtctgtgaagctcctttttgtcccccgggctttggaaggactagaaaagtgccacctgaaaggcatgttcagcttctcagagcagttgcagtactttttggttatgtaaactcaatggctaggattcctcaaagccattccagctaagattcatacctcagagcccaccaaagtggcaaatcataaataggttaaagcatctccccactttcaatgcaaggtattttggtcctgtttggtagaaagaaaagaacacaggaggggagattgggagcccacactcgaattctggttctgccaaaccagccttgtgatcttgggtaaattccctaccacctctggactccatcagtaaaattgggcgtggactaggtgatctcatagatccttcctgctggaacattctatggcttgaattatattctcctaattattgtcaaaattgctgttattaagtatctactgtgtgccaggcactttaaataaatattgtgtctaatcttcaaaacaaatttgcaaggaaggtttttggagataaggaaactgagactcaggattaagtaacacacctaaagtcacaggtgagcttggaactgaacccaagtgtgcccccactccactggaatttgcttgccaggatgccaatgagttgtagcttcatttttcttagagactttcctggctgtggttgaacaatgaaaaggccctctagtggtgtttgttttagggacacttaggtgataacaattctggtattctttcccagacatgtaacaagagtaacatgtgtgaaagcagcaaagaggcactggcagaaaacaacctgaaccttccaaagatggctgaaaaagatggatgcttccaatctggattcaatgag

SEQ ID NO: 139907 - DNA, 458 bp, Homo sapiens
tggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgg

SEQ ID NO: 139908 - DNA, 360 bp, Homo sapiens
ccctctacagccacaagcccgaggtggcccagtacacccacacgggcctgctcccgcagactatgctcatcaccgacaccaccaacctgagcgccctggccagcctcacgcccaccaagcaggtaaggtccaggcctgctggccctcccttggcctgtgacagagcccctcacccccacatcccccgggctcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacag

SEQ ID NO: 139909 - DNA, 282 bp, Homo sapiens
gtacccggaacgtgatcgaggcttgtgtgcagaccggaacacggttcctggtctacaccagcagcatggaagttgtggggcctaacaccaaaggtcaccccttctacaggtgagtggcaggccctcttgtcctctaagagcccatttccctcagcattgagtcttccttctcctcccaccaggggcaacgaagacaccccatacgaagcagtgcacaggcacccctatccttgcagcaaggccctggccgagtggctggtcctggaggccaacgggaggaag

SEQ ID NO: 139910 - DNA, 609 bp, Homo sapiens; identical to SEQ ID NO: 139875

SEQ ID NO: 139911 - DNA, 305 bp, Homo sapiens
ggcatccttctcaactggaccaagggcttcaaggcctcaggagcagaagggaacaatgtcgtggggcttctgcgagacgctatcaaacggagaggggtgagggggcacctgtacctgccgggggggctgccctgggccacccaccccagcactgcctgcctttctccttggcttccagcactgcagcttctgtgcttcttggcaggactttgaaatggatgtggtggcaatggtgaatgacacggtggccacgatgatctcctgctactacgaagaccatcagtgcgaggtcggcatgatcgtgg

SEQ ID NO: 139912 - DNA, 398 bp, Homo sapiens
gggcaacgaagacaccccatacgaagcagtgcacaggcacccctatccttgcagcaaggccctggccgagtggctggtcctggaggccaacgggaggaaggtgagcccagaaaaaggaggcgcagagatggggctcctgccctgcacacccccttaccctgccagcccaaggaggccggggccgagagcaagctgtcgggtcccaggtctcagcagtacctgcctttgccaccaggtccgtggggggctgcccctggtgacgtgtgcccttcgtcccacgggcatctacggtgaaggccaccagatcatgagggacttctaccgccagggcctgcgcctgggaggttggctcttccgggccatcccggcctctgtggagcatggccgggtctatgtgg

SEQ ID NO: 139913 - DNA, 219 bp, Homo sapiens
agtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccag

SEQ ID NO: 139914 - DNA, 477 bp, Homo sapiens
gcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccag

SEQ ID NO: 139915 - DNA, 555 bp, Homo sapiens
ctcgcggctcacggcgctcctggggcagccccggcccggccctgcccggcggccctatgccgggggtgccgctcaggtaagtcaccgcagccttggcaagggggtgtgggagcggcggtccgcttcggcgcccgccatcggcagggatctccctcttggtgccaggtacctgcctactgctcagtcgccgaaagtaggggaaagggcaagccagggtgccctagggcgaaactaggggaaaggtcaccgcttcgcgccgcctccccgcgcggctctcgcctgttctccccttgacacagcggaagtcccttccctgaacttgctaaccgtctcttttcccagctggctctggacaagtcagattcccacccctctgacgctctgaccaggaaaaaaccggccaaggcggtaggtagccccgaggccaggtggaccttagccagacccaaccagagccctgaaatttgcctctctctgcccaggaatctaagtcctttgctgtgggaatgttcaaaggccagctcaccacagatcaggtgttcccatacccgtccg

SEQ ID NO: 139916 - DNA, 968 bp, Homo sapiens
acatgtaacaagagtaacatgtgtgaaagcagcaaagaggcactggcagaaaacaacctgaaccttccaaagatggctgaaaaagatggatgcttccaatctggattcaatgaggtaccaacttgtcgcactcacttttcactattccttaggcaaaacttctccctcttgcatgcagtgcctgtatacatatagatccaggcagcaacaaaaagtgggtaaatgtaaagaatgttatgtaaatttcatgaggaggccaacttcaagcttttttaaaggcagtttattcttggacaggtatggccagagatggtgccactgtggtgagattttaacaactgtcaaatgtttaaaactcccacaggtttaattagttcatcctgggaaaggtactctcagggccttttccctctctggctgcccctggcagggtccaggtctgccctccctccctgcccagctcattctccacagtgagataacctgcactgtcttctgattattttataaaaggaggttccagcccagcattaacaagggcaagagtgcaggaagaacatcaagggggacaatcagagaaggatccccattgccacattctagcatctgttgggctttggataaaactaattacatggggcctctgattgtccagttatttaaaatggtgctgtccaatgtcccaaaacatgctgcctaagaggtacttgaagttctctagaggagcagagggaaaagatgtcgaactgtggcaattttaacttttcaaattgattctatctcctggcgataaccaattttcccaccatctttcctcttaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaag

SEQ ID NO: 139917 - DNA, 9295 bp, Homo sapiens
gctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacaggtgaggagaggactggcaggggacacggggcagaggaggcacagcccagtgcagtggggatcctggccctctgcaaacgccatcatgtggggcgcagagtagcagagtgctgaaggactggagccggaagcctgggttcacgcccagtgcggtggggatctgctctgccactcaccagcagtggggcctggagcaagctgcaccacttccttctgtaaaacaggccaaaggatggtaggtgatgtggatatgggctttcgtgagaattaaatgagtgggcatctgtaacacatgtcatcatcattattagtattcccaccactgttaacacaaggcatctgagaccaatctccactaacagcacactagaaagatcagctgtacctgggattgttatgatcagtcgaaacacacagttcaattggtctggtaataattatacacatcatcattgagccgtatcataattagataaaaatgctaagcagttagtatgaataactcaactaatattatttttatgcagccaagcagttgtagcttctcctgtctcacttattggttcccctttatttatcagcagtgcagacagttttctctagtaccctgtactgttctgtcatcttcatcatcatcatgttatgtttaccttcaaaagcacccagaatccatgcagcccctggctttccctgctgcagttccccctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccgcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtgaaggctgtggaggtagcgcaggctcctgtttgggtctgcagctaagatgggtctgaatcctggagccacaccaccttgaacctgcaaagcaagtcccagaattttgcagaagttcttcctcttcagtgtatagagttgggtggagggagtatagagccatcattcagtccttctcatctcacccaggatcacctgggagtgaccaaagtaggccaaatgtgattctagggccaaagtgaaggtgtccgccattccccgagtaagcaacttcctgtctattggctggtaactgggatggctttggagacacagcctgtctcagaagagaggaacagctaaccaggagtgataattcactcagtgccagtagcacatactgttctaaatctgaagaaggtagggagggttagaaagcaaagggaagacagtggggactaagaatgagtgtgggatgtcatgaggattcaggggagaatgcaaggagaagagacggccacagggtttgtggctatgccgcctgccgtggcccacctcatccccacatctgagcccaggcagatggaagtcccctgcagagcagtgttctgtcctggagtttcctccacaccccttcttgggaccagggctgtttcccaaatagcatcactgttcccgtgcaggccaggtgaggtgcctgggagcaggggtagggtgaggcaggcatggcggtgacctctcaggcagcttcgttgtgggatttagggcacagcgggaaacgtccagggcagaggttgcctcaccagtcacatggtactatgtaggcggtggtgtttaatagattctgtttatcaataagtggatgaagtggagatagacttccttgttcagtcattgaaacaggagagagggttacttgacataatcactttgtgttaaagctgtagtgtatgaaaagttcccaaaaattctacaagacaagcaacctagcaggaaaatcagaacaggtaacagtaagacaaatacgaatggcctgaaatcccgacaggtttttcagtctaaccaactcaaagaaagcaccttaagttgcaatgccatttcacctgtcagatgggtggggaggacttggtcctcccaccaccaggggtgaaagggtagtgtgggccaacacttcttaatgtgtgattctttttttttttttttgagacagagcctggctctgtcgctcaggctggagtgcagtggcacacgatctcaactcactgaaacctctgcctcccgggctcaagcgattctcctgcctcagcctcccaagtagctggaattacaggcgtgcaccaccgtgcctggctaatttttgtatttttagtagagatggggttccactgtgttggccaggctagtcacgaactcctcaggtgatcctcccgcctcggcctcccaaagtgttgggatttcaggtgtgagccaccacacctggccaagtgtgcatttcttttaccctgcattcccacttctaggaacgtgtcctgtgtaagtacttgctcagcatgctcagagattcccatgccagcttatttactgcaggactgctcataagagcaaaaataggaacgtgcccatctgtggggaactggttatgtaaactgtggtagagccatatggtggaatactctggagtcattgaaaaggataaggctggtttatatatatattaaataagttcctgacaagttggggatcccattgtttaaaatccttatgtttcatagaaggcaccggaagagtctataccgaaggactcaggggctaactctgaggagcaggatcatggttaaggaggctgtgtcataagatcctgcatacccttctgtgtttttctcaacaagtctgcactacttccataatttgaaaggcaactgtactttttttaagggtaaaattaactgtttaaaaggggggtgaggatctggcaggtgaggggccctggagacagagcctgatcatgtgtccagagcagaagggcttggagatcacagagaccagggcaggcatcccaggtctgtcactgtgagctgtagccctcgccagtgccatcacttctccaagtctcattctcttcacctttataggctgtgtcctacccagcctgagggccagccaggtgagagtcagtgggggtatgtgacacatcgcaggtctcagcacctgctagttctctgccccatccccatgagttattactttggcctcgggagtcccctgagggacccataaggacagcgcacagctttgagccctgaaacagcaggaaggctccacagtcacccctgaccaccctcctcagcagttcagcactgactctcagtgcagatattgagctcaacacctgccatgcaccttctcaccctccccccagccaggcaggacagaccttcccatcaacaaggaaactgaggttaccagaaacccacttgccagggtcccctgggcgtgtaggagtagagacagctagagccaggattcacctcccattcccattctcatccctcctgcttcagtgacatccatcccaatcacccttgagaaagaggaagataaagtgtccttcctcctggcctcagcacctcctcacttggcaagcacttggtgggcatcaggctgggcccagcactgtgcccagggctggccatacagtggtggacaaggctgagtgcctgtcccaaggagcccacagttcaggcaaacaggacagcagaagtaaagaggctgctcagtaacccagcctcaaatccctgcagaatttggcctgacttcagaagctgctgggtgcttgtttgcctgtgagctctgccagcaaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaacatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccacagtggggccacggtaggcactcagtcttttttcttaaggccttcagttgttggatgagggccactcacattatggagggtaatctgctttactcaaagtcttctgatttaaatgttaattgcatctaaaaaatatcttcttagtggccgggcacagtggctcatgcctgtaatcccagcactttgggaggccaaggtgggtggatcacctgaggtcaggaattcaagaccagcccagccaacatggtgaaaccccatctctactaaaaataccaaaaaaaactagctgggcgcctgtaatcccagctactcggggggctgaggcaggagaatcgcttgaacccgggaggcagaagttgcagtgagctgagatcgcgccattgcactccagcctggggaacaaaagcgagacttcatctcaaaaaaaaaaaaaaaaaaaaaaaaaaaaaaaaaaaacaccttcttagcacattgtttggtcaaacaactgggcaccgtggcctaatcaagttgatatgtaagaccaacatagccgctgccagcaagttactaacacttctgagccttggagcctcggcttccttgcctgtaaagtgggggtaagaagaccatcttgaaaggttgttttgaggttttacgtgagatgaaatgggtgtccaatggagtgcctttagcaggacacctgcttacccccacctctacccaggacatcatgatgcgggggaagtggtggaaccttcagaacccagcccctagtatgagaagaattctgccatcacctttctttcagcagagagggaagcagtccccttccgtgacagtcacatgcgtgagtgatggctccttccaatatcctgcacttcttactgccccttacctggcgttgctccactctgtctcatgttctagttttcttatctctttctctttttttttctattttatttttttcctgtaggcacaagtgagttacagtaggttaagttacaccttacctttccttgtttttcttgtttatttatttgtttatttatttttttgagacaaggtcttgttctgtcaccacaggctggagtacagtggtgcaatcacagctcactgcaacctggacctcccaggctcaagtcatcttcccacattcaggcaatcctcccacctcagcctcccaagtatctgggactacaggcatgtgccaccacacccagctagtttttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttactttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcgtgatccgcccgcgtcggcctcccaaagtgctgggattacaggcgtgagccaccacacccagccctgctgttacctctttcttacctcagctatttgaggatagagtctaggtcctgtcctgcatatagaaggtgcttatcatgtgtcttttgagtgaacacagagggtgacattgtcacgtgcagtgccaacagaaaccaaatgactagacacctgctgaccttccatggccacagggaggatgagaaaggcacctccaggaggtgtgaataatctgagggtattggccactgtggacaagactcggtggtggaagtgagctcagagatccaaagggaacgtgagtagagacatgcagagtctcgcagaggaagcagacgtgcaggccacaaagacaaaattacaagaaatgccccaacacgagcatatgctcacggactgcacagattcaaggaggaagtgccagaaaccctgcctgccccagcatctgcacaggcatccacaaagggtttctgtcatgttatctctttttcttccaacatccggtgctgtgagttttattgtccctgttataaatgcctccaggagtggcaggtcctgcccagccccatcagccagttggtgctgcagtcaggacacccaggcagcctgaggactgccagatgtgcagagagctatcgcgtgcctgctgcgtgcccagcacctcacacagctctcagtgtctgaccacgctggtgccctggtggacaaagttcctgcccttgtggcccttttgtctagtgggtggcttccaacaatgaacacacacaggatatgtcaggcggtgacaaaggctactgagaagaccaaagcggcttcaccctcccagagcacagcttttccctcccaggcccgagagatgtagggagcccactgtcccagtctgggtcaagaggaacagttacaacaccttggaatgactgaagttgggagctaaggtgccaggacaagacaggccattttaggaaccagagacttgtgttacccctaaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttcggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcctgaagtcatagccttagcaaactgcctttctcgccaacacactcaacaccccgtggttcaaacatctatacgtctgatagaaaaacttggagaaattcagtgtgttgcttaatcaatatgactgatacctaagctgttctactcaagaagttttcatgggaatgaacttgagcttcttgaagagattgtttacagcatccctggagtctatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaag

SEQ ID NO: 139918 - DNA, 2489 bp, Homo sapiens
gagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaaggccttccacaagttacttatcccatatggtgggtctatggaaaggtgtttcccagtcctctttacaccaccggatcagtggtctttcaacagatcctaaagggatggtgagagggaaactggagaaaagtatcagatttagaggccactgaagaacccatattaaaatgcctttaagtatgggctcttcattcatatactaaatatgaactatgtgccaggcattatttcatatgacagaatacaaacaaataagatagtgatgctggtcaggcttggtggctcatgcctgtattccctaaactttgggagcctaaggtgagaactccttgaactcctaaggccaggagttcaagaccagcctggataacatagcaagaccccatctctacaaaaaaccaaaaccaaacaaacaaaaatgatagtggtgcttccctcaggatgcttgtggtctaatgggagacagaacagcaaagggatgattagaagttggttgctgtgagccaggcacagtgctgatataatcccagcgctatgggaggctgaggtgggtggatcatttgaggccaggagtttaagaccagcctggtcaacatggtaaaaccccatctctacttaaaaatacaaaaaagttagccaggcatggtggcatacacctgtaacccagctactcaggaggctgaggcacatgaatcacttgaacccaggaggcagaggttgctgtgcaccactgcactccagcctgggtgacagaacgagaccttgactcaaaaaaaaaaaaaagaagtttgttgctatggaagggtcctactcagagcaggcaccccagttaatctcattcaccccacatttcacatttgaacatcatcccatagcccagagcatccctccactgcaaaggatttattcaacatttaaacaatcctttttactttcattttccttcaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaa

SEQ ID NO: 139919 - DNA, 214 bp, Homo sapiens
gtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctg

SEQ ID NO: 139920 - DNA, 1371 bp, Homo sapiens
gcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtaaggatgcccccctcccccacaacccaggccctgggccgctctggtgcagcggcagatgggagccgggccattgcagataatgggcttgtttttaaacaactctggggaaaagcaaactgacaatccgttcgtaagctccatcccttctgctcagtcatgacctgcccctgtgagagatgaagggttagtcccagttgtgatgtgataagcccagacctctttccttccgacaggtgatcgtgcatgcagaggaggctctgagacgcccccagcaaggttcctgggtttaacccaacattccccaaagtatgtatttggccacattcacagaaagaatattagtcttttgtggaatgctgcgggttgacagtcacagcttggaaaccaacccacagagagctcatcattaatcatggctatcacttgtttaccacctactgtgccaggcctatgctaattactttattagcgtcctctctgccgctcgcaggcctctattattataggtcagtagtattcgatttatttaaattaaatacggaaggtcatagattaagcaagaaagtgccagcaacatggtgcgtgcctctgactgggcactaaccctccaagtcttagttttcccaaccataactggccaatgaacagcagctctggatgcagctaaaggaagactgaagctgtaggtcccgtgctcggcgcagggccccctgcaaggaaggtttcggagggactggatggggtctttgaactatctgtctttccctttactgcagtgggcccaggggcaggccaaagttgctcccgtgattgacttgaacgtgcacgttcctaatccctgacatttctaaagctctggctcattaacgagggaaagacgtgaaccagctgggggagtggggatcgcagtgccccacgtggccgcctcgtgacctcagtggggagcagtggggccggctcccggcttccacctgcatgaggggccctccctcgtgcctgctgatgtaatggacctgccctatgtccaggtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagag

SEQ ID NO: 139921 - DNA, 624 bp, Homo sapiens
ctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcagtctataatttctaactctagattatcatgtagtttccatatggaaactattaaattcttcataatttaataaatatgattaactttcttcttagaggccagatggttttgccaaaattatcaacatgccaggtaagattaatagtaggagttgacttccaagaatatttggtacacatctagaacagatactggatggaaactggaatgtctctggcagcagcctcacaggttctccagagagctgtgttttgcatacatggtctgtggtctgttttgtgtcctaggtctggaatgttcaactctatacagaacacagagctccagcaacctggcagaattacgacagcttcttgattgtg

SEQ ID NO: 139922 - DNA, 4309 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggcgcggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtgacttttggaaccgcccactcccttcccccaactagaatgcttttaaataaatctcgtagttcctcacttgagctgagctaagcctggggctccttgaacctggaactcgggtttatttccaatgtcagctgtgcagttttttccccagtcatctccaaacaggaagttcttccctgagtgcttgccgagaaggctgagcaaacccacagcaggatccgcacggggtttccacctcagaacgaatgcgttgggcggtgggggcgcgaaagagtggcgttggggatctgaattcttcaccattccacccacttttggtgagacctggggtggaggtctctagggtgggaggctcctgagagaggcctacctcgggcctttccccactcttggcaattgttcttttgcctggaaaattaagtatatgttagttttgaacgtttgaactgaacaattctcttttcggctaggctttattgatttgcaatgtgctgtgtaattaagaggcctctctacaaagtactgataatgaacatgtaagcaatgcactcacttctaagttacattcatatctgatcttatttgattttcactaggcatagggaggtaggagctaataatacgtttattttactagaagttaactggaattcagattatataactcttttcaggttacaaagaacataaataatctggttttctgatgttatttcaagtactacagctgcttctaatcttagttgacagtgattttgccctgtagtgtagcacagtgttctgtgggtcacacgccggcctcagcacagcactttgagttttggtactacgtgtatccacattttacacatgacaagaatgaggcatggcacggcctgcttcctggcaaatttattcaatggtacactgggctttggtggcagagctcatgtctccacttcatagctatgattcttaaacatcacactgcattagaggttgaataataaaatttcatgttgagcagaaatattcattgtttacaagtgtaaatgagtcccagccatgtgttgcactgttcaagccccaagggagagagcagggaaacaagtctttaccctttgatattttgcattctagtgggagagatgacaataagcaaatgagcagaaagatatacaacatcaggaaatcatgggtgttgtgagaagcagagaagtcagggcaagtcactctggggctgacacttgagcagagacatgaaggaaataagaatgatattgactgggagcagtatttcccaggcaaactgagtgggcctggcaagttggattaaaaagcgggttttctcagcactactcatgtgtgtgtgtgtggggggggggggcggcgtgggggtgggaagggggactaccatctgcatgtaggatgtctagcagtatcctgtcctccctactcactaggtgctaggagcactcccccagtcttgacaaccaaaaatgtctctaaactttgccacatgtcacctagtagacaaactcctggttaagaagctcgggttgaaaaaaataaacaagtagtgctggggagtagaggccaagaagtaggtaatgggctcagaagaggagccacaaacaaggttgtgcaggcgcctgtaggctgtggtgtgaattctagccaaggagtaacagtgatctgtcacaggcttttaaaagattgctctggctgctatgtggaaagcagaatgaagggagcaacagtaaaagcagggagcccagccaggaagctgttacacagtccaggcaagaggtagtggagtgggctgggtgggaacagaaaagggagtgacaaaccattgtctcctgaatatattctgaaggaagttgctgaaggattctatgttgtgtgagagaaagagaagaattggctgggtgtagtagctcatgccaaggaggaggccaaggagagcagattcctgagctcaggagttcaagaccagcctgggcaacacagcaaaaccccttctctacaaaaaatacaaaaattagctgggtgtggtggcatgcacctgtgatcctagctactcgggaggctgaggtggagggtattgcttgagcccaggaagttgaggctgcagtgagccatgactgtgccactgtacttcagcctaggtgacagagcaagaccctgtctcccctgaccccctgaaaaagagaagagttaaagttgactttgttctttattttaattttattggcctgagcagtggggtaattggcaatgccatttctgagatggtgaaggcagaggaaagagcagtttggggtaaatcaaggatctgcatttggacatgttaagtttgagattccagtcaggcttccaagtggtgaggccacataggcagttcagtgtaagaattcaggaccaaggctgggcacggtggctcacttctgtaatcccagcactttggtggctgaggcaggtagatcatttgaggtcaggagtttgagacaagcttggccaacatggtgaaaccccatgtctactaaaaatacaaaaattagcctggtgtggtggcgcacgcctatagtcccaggttttcaggaggcttaggtaggagaatcccttgaacccaggaggtgcaggttgcagtgagctgagattgtgccactgcactccagcctgggtgatagagtgagactctgtctcaaaaaaaaaaaaaaaaaaaaaaaaaaaaactgaaggaattattcctcaggatttgggtctaatttgccctgagcaccaactcctgagttcaactaccatggctagacacaccttaacattttctagaatccaccagctttagtggagtctgtctaatcatgagtattggaataggatctgggggcagtgagggggtggcagccacgtgtggcagagaaaagcacacaaggaaagagcacccaggactgtcatatggaagaaagacaggactgcaactcacccttcacaaaatgaggaccagacacagctgatggtatgagttgatgcaggtgtgtggagcctcaacatcctgctcccctcctactacacatggttaaggcctgttgctctgtctccaggttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaag

SEQ ID NO: 139923 - DNA, 2328 bp, Homo sapiens
cgttttcggccacccaggcacggaaaggcttctgggactacttcagccagaccagcggggacaaaggcagggtggagcagatccatcagcagaagatggctcgcgagcccgcgtgagtgcccaggggaaggggtgtaggcgaagggaggagacagctgggccatgccatgatgacctgcctctgctgcctcaacctctgtggccgctgctgggacagaggaaaggagcggtgctagctctgtctgcagatcccggccatcctgggctctttagcgccctctgcctgcagcccccgccttgacaactccgtagctgttgcccccttgctcactgaggcgcgggacctgggatcaatcgggaggacgcccgctgcagtccccagaatcaaaggatgatgtggcgcatctatgtttctttggagagtgttgtaggtctggatttgtatgggcaatgtgtttgtgcttcgtgcgtgagttgttactggccagggctaggacaagagccctcgaccctggggccaacgccctgcgtccttggttcccccagaggatcagtgcgcgatgacttggggacaaaggagatgatggaggctagcagtctgacggcctggatatctgtccccttctccaggaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcacatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgata

SEQ ID NO: 139924 - DNA, 757 bp, Homo sapiens
gtttctgagcttggcttggattcagaagtgctgcctgtccggggagaccacccagctgcccagaacaggttcctctacgtgggcggtgccctgcatgccctacccactggcctcaggtaacaccagcacctccgctccttttactgtgccctcatcctcatatgccttccatttctttcttcttttctttttttttttttttttttttttttttgagacggagtatcgctctcgcccaggatggagtgcaatggcgcgatcttggctcactgcaacttccgcctttcgggttcaagcgattctcctgcctcagcctcccgagtagctgggactacaggtgcctaccaccacgtctggctagtttttgtatttttagtagagatggggtttcaccatattggccaggctggtcttgaactcctgaccttgtgatccgcccgcctcggcctgccaaagtgctgggattacaggcgtgagccaccacgcccgacctgccttccatttcttcatctccctgtcagccttcccagcaaaaggaagccaaatgagtggaaatgaccccagcgcctggagctggggaggtatgtcaggagcttccccctcactatgcctttctccatgcagggggctactccgcccttcaccccccttctccaaacctctgttttgggctgggctgagggagctgaccaagccccggggcaaagagcctgatgagactgtgcacagttttgcccagcgccgccttggacctgag

SEQ ID NO: 139925 - DNA, 459 bp, Homo sapiens
ggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctccccaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcat

SEQ ID NO: 139926 - DNA, 567 bp, Homo sapiens
atctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcag

SEQ ID NO: 139927 - DNA, 2120 bp, Homo sapiens
gttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaaggtatggtggaaacacacttctgcccctatactctagtggcagagtggaggaggttgcagggcacggaatccctggttggagtttcagaggtggctgaggctgtgtgcctctccaaattctgggaagggactttctcaatcctagagtctctaccttataattgagatgtatgagacagccacaagtcatgggtttaatttcttttctccatgcatatggctcaaagggaagtgtctatggcccttgctttttatttaaccaataatcttttgtatatttatacctgttaaaaattcagaaatgtcaaggccgggcacggtggctcacccctgtaatcccagcactttgggaggccgaggcgggtggtcacaaggtcaggagtttgagaccagcctgaccaacatggtgaaacccgtctctaaaaaaatacaaaaattagctggtcacagtcatgcgcacctgtagtcccagctaattggaaggctgaggcaggagcatcgcttgaacctgggaagcggaagttgcactgagccaagatcgcgccactgcactccagcctaggcagcagagtgagactccatcttaaaaaaaaaaaaaaaaaaaaaaagagaattcagagatctcagctatcatatgaataccaggacaaaatatcaagtgaggccacttatcagagtagaagaatcctttaggttaaaagtttctttcatagaacatagcaataatcactgaagctacctatcttacaagtccgcttcttataacaatgcctcctaggttgacccaggtgaaactgaccatctgtattcaatcattttcaatgcacataaagggcaattttatctatcagaacaaagaacatgggtaacagatatgtatatttacatgtgaggagaacaagctgatctgactgctctccaagtgacactgtgttagagtccaatcttaggacacaaaatggtgtctctcctgtagcttgtttttttctgaaaagggtatttccttcctccaacctatagaaggaagtgaaagttccagtcttcctggcaagggtaaacagatcccctctcctcatccttcctctttcctgtcaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctggg

SEQ ID NO: 139928 - DNA, 2131 bp, Homo sapiens
gtcccaggttgcccatgtccaggaaaagatggatccccctatccaaatcttctccgtggtgtgtgtgggtggaggagtggaccctggtccaggcaggggctccagggaagagaaggcgtcacttccgggggccttcaccagtgtctggtggctcccttctctgattgggcagaagtggcccaggcaggcgtatgacctgctgctgtggaggggctgtgccccaccgccacatgtcttcctacccatctgctccccagagggctgcctgctgtgcacttgggtcctggagcccttctccacccggtgagtggccagcagggtgtggggttatgtgagggtagaaaggacagcaaagagaaatgggctcccagctgggggaggggcaggcaaactggaacctacaggcactgacctttgtcgagaagagtgtagccttcccagaatgggaggagcagggcagagcaggggtagggggtggggtgctggtttctgagggactgatcacttacttggtggaatacagcacagccctggctggccctaaggaaaggggacatgagcccagggagaaaataagagagggagctgcacttagggcttagcaaacacagtagtaagatggacacagccccaatccccattcttagctggtcattcctcgttagcttaaggttctgaatctggtgctggggaagctgggccaggcaagccagggcgcaaggagagggtaatgggaggagggcccactcatgttgacagacctacaggaaatcccaatattgaatcaggtgcaagcctctttgcacaacttgtgaaaggaggaggaagccatgtggggggtcctgtgaaggaaccggaaggggttctgccaagggggcagggaggcaggtgtgagctatgagacagatatgttagtgggcgcctaagacaaggtaagcccctaaggtgggcatcacccagcaggtgcccgttcctgggcagctggtctcaggaaggaagtcccagaactgttagcccatctcttggcctcagataatggagtatttcaggacttggagtccagagaaaagctccagtggctttatgtgtgggggtagatagggaaagaatagaggttaatttctcccataccgccttttaatcctgacctctagtggtcccagttacagctttgtgcagttcccctccccagccccactccccaccgcagaagttacccctcaacatattgcgcccgtttgccagttcctcacccaggccctgcatcccattttccactctcttctccaggctgaagccacaatactttccttctctatccccatcccagattttctctgacctaacaaccaaggttgctcagaatttaaggctaattaagatatgtgtgtatacatatcatgtcctgctgctctcagcaggggtaggtggcaccaaatccatgtccgattcactgaggagtcctgacaaaaaggagacaccatatgctttcttgctttctttctttctttctttctttcttttttttttttgagacggagtttcactcttattgcccaggctggagtgcaatggtgcgatctcggctcaccacaacctccgcctcccaggtacaagcgattctcctgtctcagcctcccaagtagcttggattacaggcatgaaccaccacaccctgctagtttttttgtatttcgtagagccggggtttcaccatgttagtgaggctggtggcgaactcctgacctcaggtgatccacccgccttggactcccaaagtgctgggattacaggcatgagccactgcacccggcacaccatatgctttcatcacaagaaaatgtgagagaattcagggctttggcagttccaggctggtcagcatctcaagccctccccagcatctgttcaccctgccaggcagtctcttcctagaaacttggttaaatgttcactcttcttgctactttcaggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactg

SEQ ID NO: 139929 - DNA, 354 bp, Homo sapiens
acgggacaacttgcagagctgcaaccccaggacagagctggagccagggccagctggatggtgagcgcaacagtgatgcctttcctagccccctgctccctccccatgctaaggccggttccctgctcacattcccttccttcccacagcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaa

SEQ ID NO: 139930 - DNA, 2012 bp, Homo sapiens
gtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccaggtatatatgagaaagtgggcagacctctcccttccatgctgtgtgtggccctcagatattctgcccgctaagcgcaaacatagtgctttagcttggtttaaatggcactttattgcagctttcctgccccacccaggcagttgctgctttttttctctcttaatgaccagtaggtggggcttggggcccccccagtgtgggggactactaagggcctggtttcactgtcagtttcagttgattgcaagtgatcagaactggccctggaatagcaacctccttgctgcaaggtgtggtgaactctgtgtctccaatgtgcatattgtttaggttaatttacgtttgttgctggaagcaacaactggatcacccttgagcccatgccactcttgagtgttctatcttaaaaggtggagatatggtccttgtctttcaggaagttataatttaaaagagaaaggcatgaaacgtctgctttggtggtgatattaaggaactagctgtgtgtctggtgggaagtgtgccctctatgtgtatattttggaatataaaactaaatccctgtcctaatattggaatgtttaggggctatttgggggcaagcattggtaggctggatttttttttttttttttttttgagacagggtctcaccctgtcacccaggctggagttcagtgatgtgatcatagttcactgtagtcttgaactcctgggctcaagcgatcctcccacctcagcctcctgagtagctaggaccacaagcgcctgccaccatgcctggctagatagggtcttgctatgtgcccaggttggtctcaaactcctggccttcaacagtcctccaagctcagtctcccaaagctctgagatgacaggtgtgagccactgcacccagcctgaatttgtgtttttctatattttgtttgattataagtgtaatgtacacttattattaacaattcaaaccgtactgaagtataagaagaaaagaggaagatgccctttcactgatcacattctgcctcccgcccaatctcattccccagtgttgctatggtgatattaatagttgggcattaatctctccaaatctttatatagagaaaatgcacacttgcgtgtatgtgtatgtatatgttcacgtaatacagatacagacttttttaactgaaatgggatcatacaagatagactgatgtgcagctggctttttcacttaactatgtattagacatcttttatgccagtgggttatagatagagcccattctctttagggaatggaatgccttgtgctgtctacagtacaaatgagtcgtgatttttttccccaacttttcaccattctcttattagaggacatttgtgttgtaagcactgggttttaaaggtctcacatgctcttggtcatccattcctgtggacagtagtcctctgaatgggaaagtatatttcataaacgcccatcacagaggaagaagtactgtcacgactgtgcacaaagctagaggctttgccatccccagggcccttggccctgtgtcgctcattgaactctcctccctacttgctggcagccttcactgtccttgtctttcagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaag

SEQ ID NO: 139931 - DNA, 6420 bp, Homo sapiens
atttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagcatagagaatgatattgcaaacatctgagtactcactatcccaactttacaaaagggacagccagaggagcccgatgcctgagcttccggtcccagggacaaatgccccagttcccttagtattcattcgtgggtatcacgtgatctccaaagtcttcacattctagaaaatgggaacaagaccccagacccatcctggacaaaggaggagaagaccagagcacaacatttattaaggtcttgccaggcttcctgctaccagcaggtatcagtcactgggctgtgctttttccacacttcagtaggttgggttcatttcattttcatgacaaccctatatgggaaaatgttgtgaaaatgaaatgagcccagcccattgaacctattacaattcctccctttttgtggatgaaggaactgaggcccacaatggttaagcaacttgcctagggccccacaactgatccttggaagatctgaagtcccagagcttctgctatttggaccacacttcagcactgtctattattttatgctctccagataccagggacatttaaaattgttttcagcccaagcaagggaagcaaaaatcttttaactgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcaaaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgttttctctgccccctcccttggaaatatcttctatgtctcatccttatgggaccttagtctgggctcatgagctgtcttggaaaatctgggcttgctgatcccgatgcaggagtgggtggtccccaaggcctgctctgaacgctgcaattctaacatctagatatcagtggttctccaagggcaagaggggctttttaagctgcaaatactccctcctctcccaaacccagttttcaatggggttaagcctgtctcatccacttcaacttccattttgtggactgggaaagattatgaatgggaacctgatgcatgtgtgaacagttggaggcaagaaaaagattgagaactacagtctaaggttccaacatttctgtggttgtattagtcagtgattccattatcccaaaagcctaagattttaggcactatgattcctcataggtgtcatccagagggcactgtgtttgagagaacagctctctcacagtgaaagttcaggtctgtgacaggcagatgggagaggggttggcagccctcctgagtggatggctacccacctccactgcgtgtggcctggtcctgcgtgtggtcagttgttataaatgtcttttattagacatccagagtcattttcacttgtgtaatttagggacatttctgtctcttctgggctctagttttcccatctataaaatgaggacattggataatgaacccttcagccctatgagtctcgctcctcactccctgacctacctgcacaagtcacactgcccactaggatgggtgtgtttgttccctggtcccttcttttttttttttttttagatggaatttcgctcttgttgcccaggctggagtgcaatggcagtatctcggctcactgcaacctccacctcctgggtgtgagtgattctcctgcctcagcctcccaagtagctgggattacaggcatgtgccaccacacctggctaattttgtatttttagtagagacagggtttcaccatattggccaggctggtctggaacccctgacctcaggtgatccgcctcggcctcccaaagtgctgggattataggcatgagccactgcgcccggcccctggccctttcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggcgagtgagcgtgggttagtcgatgctagtgtttgtttacatgcctgggttacctggaagatcatgacacatgcagtcacttggttgttttgagaacgggccagagtgacaaagtgttcagttgccactgtggtcaagccataggaaatgagggtattcctagctgtgcctgtcttctaggccccaccacccctcctcagcctgctgggaagctcccaaagccaaaagaaagtctcggtggaagtctcactggccaggagagttgggacaagtttttatttctttttcttgatgaccttaggagaatttgaggactgaaaccctaaaatagtccctgagaaccagaaagtgtgagctggaaaggtaggatttcaagaccagctgagtctataagaggtcatcaaatctacctgctccccactttacagaagaggacactgaggctagagaggtgatgtgacgggtcaggggtggagtcaggtctagaactcaggctccccagagctgagcagacaccaagctccctggagtgaaacttgcagtgatcagcttgggaggcacatttcttgatctagatggctgaaactttctctcgaccacagagaggggcttcaggtctcatgggcctataagtctctgccacaggatagtccaccatggctggaaggggctccctggaaggccaaagaatccagggagaaccctgggggtcagtgggccaacagcaggtcaagaattctttcctgcaaccgaaagccagggagacagacacctgccttggcctaagctgtcaggcccaggacaaatattcggctcctggcatcaaaaacccagcccagaaagcggacccagagttgcaggaggtgagcgtaggtgatgggccaggggccatctgaagaggccttcctcggaagcccctgccctgctccccacagccccctacccaggagttccctgggaagacaggctcatcacctctccgcctctgcccaggtcggttaatattcaatagaagttacattaggtccccgaccctgctaatactgagcaaacatttggaaaacatcattccgtgactgagctcgcgccgggcactgataacgcccgcctaaccttgaggagccctatccgcagctgctgacagcagccctttcattccgcccgccggccactcggcgccctgatgggtgggtgcgggtgctggcaggaggctgccgtgggaggggtgtgggcgggtggggtggacggcccggtcagggaagccgtgctctgagctggccccgtccacatggtggtctgagaggaggttgcttgcctctggacttctgttctatccactgactcccgggctcaagtgcaaaggatttgacttttattctctgattttaacaatgtgtcaacatcaagagaaagttgaatagctggggtgtcaatgttccctggagaaatagggttcttataagaattagagtttatgaccaggtgtggtgcctcgcacctgtaatcccagcattttgtgaggctgagtggatcacttaaagccaggttttcgagaccagcctgggcaacctaatgagaccccgtctctcaaaaaaaaaaaaaaatttagccaggcgtggtggcacacgcctataatcccagctattcgggaggctgaggcaggaggatcgcttgagcccaggaggttgaggctgcagtgagctatgattgcaccactgcagtccagcctgggcaacaaaatgagaccccatctcgaaaaaaaaaaagaaaaagaattagagcttgtctcttccaatgccttcgttctctcactgcacaaatattcattgagtacctactgtgaaccaggccctgttctggtggctgggactacagcagtgaactagagggatggagttttggccttctgaagctttccttctcagagagagacagatagtaaaggaagtaacaaataattctacaataagtgacttgaagaaaaataaagcatggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggcgacatgacttgaacggatccctctgtctctgagaggaacacagactgcaggcgcaaggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttggactccaagggctatcccatccactgtcgggatggtggaaggatcatcttctatctcaggccaggactgacccagatgggagcaggcagtggagcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctccattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcctgtcccgacag

SEQ ID NO: 139932 - DNA, 4534 bp, Homo sapiens
gcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacaatatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactttgggaggcagaggcaggaggatcacttcaggccaggagttcgaggccagcctggccaacataacaagacctcgtctctatagaaactaaaaaaaattagccagggatagtggtgagcacctgcagtcccagctactcgggaagccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcctgggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaacttcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttctaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgatacaagtcaggggacatctgggtcttgactccccagatgctccagctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggag

SEQ ID NO: 139933 - DNA, 1125 bp, Homo sapiens
gtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggtaagctggtggggatgggtgggcacctgggtgggaggctcatggggcaaccgcagaatccaggagctggaagagccactgggactcattcattcattcatacaacatgtatttatccagtgcctactctggaccagtcactgtgctacatcagtgatacctgggtgaaccaaacagaccaaaatctcagcaactcaagcagggaggcaggcactaagcataatacatcaattctgtggtacctcagaaggtgaagggtctatgggcaaattacagcagggtaagggggactgatgttttctaagtttttgttttatgaagaaaaattaagcccagaaagcccttatttgcaggtacaattatgcagaagcccagtacataagatagataaggagctgctaggagaggggagcagagaactgaccccatggcctttgcactgctgtggaaccccagggctccagggaaccgcagtttgacaacttttgaacaagtcaccgcctgcctctcccactagcctagacaaagagctaaaggctcagagagggggaatgacttgccagagccacttaaattagtggcaggtcccagtggagggctgtttcctgaccaccctgccccctcctccaaaccacgggctctgggaaggagaggtggtgcccttgggaggtcttgggcaggggtgggatataactggggggcccagctgattccctccccttccactccaggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacg

SEQ ID NO: 139934 - DNA, 1470 bp, Homo sapiens
aagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatggtgagcagcgcaggggccggggcagggggccaaggccatgcaggatctcagggcccagctagtcctgacgggaggtgccacctgtctaccaggggtggggagagcgggggctggaggaccacccagcctcagaggcagctggaggcctgggtgaacaggactggccaacatgtccccaagtcccacagtcaccatctggccagcattgagaggggaacgggctgaggaagagttagtggcaagaggaaccccagccagtcacaccttgtccagtttaccagaggaaaaaccaatgtgtaagaacagaaatgtgacccggcagccagtgcactgcccccctctccaaaggccacccctcaccctccaccagcatgcacagaaagtggggtgacagcaatcacaatgtctacccaggcagcaaggacccctgaccatggggaggactggggtgcagggaacatagaagcagaatgaggcctagggggagttgggcaaggccagagccctagctgcagccaagcacatggccaaggccagctcctggaagggcagggctccgaggcaggaggcaggaggctgcccgtggctacccgtcctcacacccctgcagcttgctagtctgtctgtgggctgggtgtgaatcaaggcagtgggatggtgtggggacctccctggccccagcagccagtgaggagcctggtcagtcagcagagcattcagcagtatccagttccatggagaggcccgtgtgaggggagtcggggctggtcttcagtaaggatgggtggccagggcccctagaagtagaaaaggagactccgggtgctggagacagaaatcaaggatgtgcctccatgtggagcctcaggaatagctggccaggcctgaggctgaacctcacaaggttcagctgggagggctaggctgacagagcacagccgggccagggaccagcctgccctgtgttgccttgtcccgagggccactgtcagcaggtctctggcatgggggaggcttagggcctgagcccaacaagcagcagcggaagaggagagggaaactgtggacaggcctggcattcagtggccaggtgttgcagtgtccctgaggaatagcttggcttgaggccgtggggagggctgccggccagcgcacccccccatgccagatggtcaccatggcgtgcatcttccagctcttcgactacatctctgagtgcatctccgacttcctggacaagcatcagatgaaacacaagaagctgcccctgggcttcaccttctcctttcctgtgaggcacgaagacatcgataag

SEQ ID NO: 139935 - DNA, 5337 bp, Homo sapiens
acatcagagtaccatgatatcatgtatcctgcttggacattttgggaagggggacctgctgtttggccaatttatcctacaggtcttggacggtgggacctcttcagagaagatctggtaaggtaggtcctttaaagaggttttattttttctctttctgggttttcttgaaataagccatagaatataaccaattatttactttttttttttttgagacggagtttcgccctttttgcccaggctagagtgcaatggcgtgatctcagctcaccgcaacctccgcctcccaggttcaagtgattctcttgcctcagcctcccgagtagctgggattacaggcatgtgccaccacacccggctaatttcgtatttttagtagagacggggtgtctccatgttggtcaggctggtcttgaactcctgacctcaggtgatctgcccacctcagcctcccaaagtgctgggattacaggcgtgagccaccgcgcccagcctatttatttttaagtgactaatttttaagttaaaaattaaagacagaaaactgtagtgtaaacaattttgtacgtgtctaataatatttacatatccatagaaaggggcagaatagtctatcctaaactatcagcaatgcctctttgcaagggattatcagagacttttgttttgtattttaaatttttctttctttttttttttttttgcgacacagtcatgttctgtctcccaggctggagtgcagtggtgctatcgcggctcactgcaacctctgcctcccaggttcaagcaattctcttgcctcagcctcccgagtagctgggattacaggcatgtgccaccacacctggctaattttttgtatttttagtagagatgtggttttgccatgttgcccaggctggtctggaactcctggcctcaagtgatccacccacctcggcctcccaaagtgctgggattacaggcacgagcccctgtgctcagtcagtattttcaatttttctatacttaagattctttaaataagagtgcattctttcatagtaagaaaaaatgaatgacctcgtcataggggggatagaaaattatttggaagaatataaacatacttggcaattgagagctaagtagtttaggcagggctgagggagcataaatgtcccataagcatctcaagtacaagcttattccagatcctctctgattcatgactgagacatgccttggcctgttgactccatcctgctatcatttcagaatttagattgtgtagctcatccaagctgtaggtatttcttacctagctacattttacatcatgattcaaacaactttggtgcttaattagagaacttccggaaacacagtcattataggccttctctcaggtataaggaaagcaaacaattcaaccttgtttccataaatacctatcacctctcccaagtgtggctgaagattcaaagaggattaaggtaatattcccttcctgaagaaacgtacagggctgcagtcctcagtggtgggtagagccctttgttaaaaaacaaacttctctagtgggtataatttggaaattttaaaaaataataacttagtctcatattttacagaactggaactagaaattgtctttgtccagccctttatttcagggataagggaatgaaggtacagaaaggtttagtgatctggtcaaggtcagaagcaaatctaggcctaaagaccaggtttccaagtgcattatccaacctactttactggttaatattccttgtgttttcctgacattgagactgtcatttcttgtttatttttgggttttgaacataattttgagagggggggaaaaaggtgtggtttttttgtttcttggttgttttttaaaattttttgtagagacaggtcttgctatgtttcccagcctgatctcaaactcctgggctcaagtgatcctcccaccttggcctccaaagtgctgggattacaggcatgagccaccacactaagctggaaaaaaggttttaaacttttttttccctaagttattcttggccttggccttaattttctaatcctttccccccctcctcaggtacttgcaaatacccttttcacattcttctttttgtagctcttttcccacctgccatgcagctgctttgttttcaaaatctttaaaaacatttttactgattatgaaacctatatatgctcataaaattttacaaatatgtataactcaggcaactttccccctaacttattggtgtatctaagtaatctttccatgtctttgtttcatgtcagtacatatgaaagagtcactttatttatttgtttgtttgtttatttttaaaaggcaggatctcactatgttgcccaggctggactcaaactcctggggtcaaggtgttatccagttactccaccgtgtagttattaataccattttcccccaggtaaactagtaagcaatttttaggcagatagaatgttttaaagtctaatcttatatgaatacttttttcttttgataccttcccattttattcaattgaatttattcatggttatagaaatacaattttgttttttagaaccctctgtttagaatctctaatgatgttcatttgttaccttgaaaatttaataatctgcttgtttatccatctgcactgatgtctgcctgccactgttcattctatttttctgatattttgggagtttgtgcccactgatttatatttcactctgtagaagaattcattgttctttacagatcgaagatttcatttgttactgtcagagagggtttaaaaaagagggctggggtagcaccaggctgtggtggccaccgttagcacttgcctggagaaacaagtcctaacctaggtcttttgagggaggatgggtaggttaggagaatgaaagagagagaacagtgatacacagtttgggtttgtgtatatgaaacacagcttccccaggagccaaggaaataaagagaagtaactttgagtataaattgatacatgttttgttagatagtttgacaatatgtatcaaaattggaaatgtatactgtgtatcctttgacctagctgtttcatgtctagaatgtatcctaaggaattaatcagatgaatgtgcaaagatttgtgtacaaggatgtttactaccatgttgtttcttagagcagaaagttggaaactacctaaaagtccatcaataaaggatgaagtgaatcataacatgactataaaatggaatttttgcagtgagtctttgccagagattataaaatggaatatcgtgcatgaatggaaaggcagtgtaggttttaaaaactctgggttcaaatcctggctcttattagctgcatgactctgtgcaagttgcttaacctctaaaggacctcatttgtaaaataggggtgataaaacctacctcttaagattgtgagaatgattttttatttacaaagcacttaaaacaatgtctgtaacatagtgaagtgctatatagatgttggctgttattattatttatatttcctattaagattgttacctaacagtatgtatggtgtgacctctgttacatagagcaaagtttctcagtactagtgttgctgacatttggggctggataattctttgtcctgggagctgtcctaaccactgtaggattgttcagcagcatttctgatctttacccactaaatgccagtagcagtcccctagtagtaacaatcaaaaatgtctacagacatggccaaatgtcccctgggtgggagggacgggcaaaattacccccagttgaaagctactaatatgaataaatgattgcaaggaaattctcggctaaaatgttacattgttacctctggacagggagattccagacgacttcttacttttatctttatgctttttcatgagaactttgcatgaggagcatgaaacattttccactaaaaacaaaacaacaaaaatccagtgctatagtgtctctgcttgggcaggaagaagtatggggaaaacaagatagttctggccttagactggagaatcaggtaaaggtgatccatccagaaaaggccagaggatgagccacgttggctgagggtggaggtctgagggcctggaaaatactgagcagcgttctcagctgagtgaaaatgagcagcatgacattatatgtatctgaaaaggacctgtgcctagaaagtttatatcctaagtttctccgttactgtaatccagcccatcaatccctcattaacttcagttcagccttcccttcctttttcagagaagatgctgtgcagacttctgtgcagggagggttcctacgaagcaagttaagaatgatgcatctgtgagctagcagtttcagtaaggaaggctggtcatggtaatgtgtactgagatctgactttcaaggacttcatctttatagagcacttagtctggctttaagaatacaaaggtgcttttcaaatatcaaactaaatctgatgacacttcccacctatggaaaacataaaatcagagagtgatttccctttcattccatttctgatgcttttttatttttttgcagttctgtacacataattaatttcatcagtagcaccctacttaaagtacagaggaaatccacatttgccaaattataaacagacctaatcatgaccttcagggtttgggggcttttctttcaatgttgttaacttgttaatggggagtagatttgtagatacaactgggtagcacctccagagcaatgaaatggtagcaaaaggaaacaaagtgtcctttagggctttttcttttgagtgactttgattagacttacttagaaatatgaagctctggccaggcacagtggctcacgcctgtaatcccagcactttgggaggccgaggcaggcggatcacgaagtcaggagatagagaccatcctggctaacacggtgaaaccctgtctctactaaaaaatacacaaaattagccgggcgtggtggcgggcgcctgtggtcccagctactcaggaggctgaggcaggagaatggcatgaacccaggaaggggagcttgcagtcagccaagatcgcgccactgcactccagcctggacgacagtgcgagactccgtctcaaaaaaaaaaaagaaatatgaagctctgaactaatcttcagaaatggttaaagcacattcttatatagttgaaaaagatatattgaaactaattaaattctatattcttaggtcagcagcacagtggccatggaaaaagaaaaactctacagcatatttccgaggatcaag

SEQ ID NO: 139936 - DNA, 2250 bp, Homo sapiens
ggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtaagtggtatgtggggacaagggacacgtgggaaggtgggagggttggggaggactgtcccagtgacagcagtcacctaaacctctttgcacttcagtttggttccattccattcatgccactccttatcactctacttcactctgttcattcatccattccactctatctcattccattcactctactcctttccactctattcactccatccaccacaattaaccccattccatccactccatccactaccttcgactccactccatccactctactccattcactccactcaactccactccatccactccactccgtccaacttcatcccatccactacattcaactccactccatccactctactccatctactaccttcaactctaccccatccatccactccactccatccattccatccaacttcatcccatctactacattcaactctactccatccactccactccatccattgcatccaacttcatcccatctactacattcaactccactccatccactccactccatccattccctccaacttcatcccatccagtacattcaactccactccatccactgtactccatctactacattcaactctactccatccactcccctccatccattccatccaacttcatcccatctactacattcaactccactccattcattccactccatccattccatccaacttcatcccatccactacattcaactccactccatccactccatacctggctccatccactccactccatctactacattcaactctactccatccactccatactctattccatccacttactccatccactccattcagctccactccatccactccactcactcaactccatctactccactccctctacttcattcaactctgctccatccactccactccacccattccatccactgcactccaaccagctccattagactccactccatccactctacccactcttctctccactcctctccactacataccattttattctatctgtcccatccactcaactccattcactccacatgactccacatttcatccattccactctacttcatccactcactccactctataccattccactccactctattcacatactccaccattccagtctactccattcactccactccaacccactcactccactccataccattccactccactgtgttcacacaactccatccattccactctagccactccattcattccactccacgccacactattcctcaccattccatccactccaccctataccattccactccactctattcctccccacccgtcctctccaccctttaccactccactcgactgtacccattccacttgatcccactcattccactcaattccatctactctactccacaccatccactccacttcatatcattccactcaactcaacctaagttgatttgggttaattcaattcaattcattcatttcagattgtatcaattcaattcatttcaattcaactaaattcagttaaattcagttcagttgtcttctactgagcacctactgcatgtcaggtatagcactaggcagtgggaggaatggagctaataaatgcagtcccagccttcaaggaactgggagcagctgacccagggcttggcaaaaggtagaaacaaaggcagatttgctggctgcataaaggcagacaggcagctggcctaagcaaaccaatggagtttgaagtgctgagggctgtggaggcaggggagggcagggaagtggggtgctgaggcaggacactgcttccctctccaggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctg

SEQ ID NO: 139937 - DNA, 633 bp, Homo sapiens
gggacactgtcgctgtttaccaacgaggctggaggcatcttagatgacttgattgtaaccaatacttctgagggccacctgtatgtggtgtccaacgctggctgctgggagaaagatttggccctcatgcaggtataccccctctgtgttctagacaccttgtcttccttgttcatagagcagtatccttgttgtccaagacagggttggcacagacaagggacctggaaaatggctctttcagtgaatgaacagctatgagactcaagagcaggccctctctggagcacgccagggtttggtggtgggggattaccaggcatggggagggggtcttggcccctctggtgtgaggtggcagaactgggcttgggtcatctctatcacttagtagctatgtgaccttgtaagatgggaaccagcctactacctttttttttcctccctcctcctcctcctctccactgtcctactactgtccagctctgcagcgtccagcccatggtagctgctcagtaagtggccccagatgctcttgtgtttctgtcttttaggacaaggtcagggagcttcagaaccagggcagagatgtgggcctggaggtgttggataatgccctgctagctctgcaag

SEQ ID NO: 139938 - DNA, 561 bp, Homo sapiens
gtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatg

SEQ ID NO: 139939 - DNA, 1665 bp, Homo sapiens
gtctcaatattagagtctcaacccccaataaatataggactggagatgtctgaggctcattctgccctcgagcccaccgggaacgaaagagaagctctatctcccctccaggagcccagctatgaactccttctccacaagtaagtgcaggaaatccttagccctggaactgccagcggcggtcgagccctgtgtgagggaggggtgtgtggcccagggagggctggcgggcggccagcagcagaggcaggctcccagctgtgctgtcagctcacccctgcgctcgctcccctccggcacaggcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggaggtgggtaggcttggcgatggggttgaagggcccggtgcgcatgcgttccccttgcccctgcgtgtggccgggggctgcctgcattaggaggtctttgctgggttctagagcactgtagatttgaggccaacggggccgactagactgacttctgtatttatcctttgctggtgtcaggaagttcctttcctttctggaaaatgcagaatgggtctgaaatccatgcccacctttggcatgagctgagggttattgcttctcagggcttccttttccctttccaaaaaattaggtctgtgaagctcctttttgtcccccgggctttggaaggactagaaaagtgccacctgaaaggcatgttcagcttctcagagcagttgcagtactttttggttatgtaaactcaatggctaggattcctcaaagccattccagctaagattcatacctcagagcccaccaaagtggcaaatcataaataggttaaagcatctccccactttcaatgcaaggtattttggtcctgtttggtagaaagaaaagaacacaggaggggagattgggagcccacactcgaattctggttctgccaaaccagccttgtgatcttgggtaaattccctaccacctctggactccatcagtaaaattgggcgtggactaggtgatctcatagatccttcctgctggaacattctatggcttgaattatattctcctaattattgtcaaaattgctgttattaagtatctactgtgtgccaggcactttaaataaatattgtgtctaatcttcaaaacaaatttgcaaggaaggtttttggagataaggaaactgagactcaggattaagtaacacacctaaagtcacaggtgagcttggaactgaacccaagtgtgcccccactccactggaatttgcttgccaggatgccaatgagttgtagcttcatttttcttagagactttcctggctgtggttgaacaatgaaaaggccctctagtggtgtttgttttagggacacttaggtgataacaattctggtattctttcccagacatgtaacaagagtaacatgtgtgaaagcagcaaagaggcactggcagaaaacaacctgaaccttccaaagatggctgaaaaagatggatgcttccaatctggattcaatgag

SEQ ID NO: 139940 - DNA, 1189 bp, Homo sapiens
gggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggtcaggactcagaacagtctggcgtctccagactctcacatgcagtatgtgcaggcacctgatacttctgttgcccttgtgctccagtcattgcacaaggcagaaaacagctctggcaggaagggactgccaaagttaggagccctagggcctggaaggagagtatggtcctcagatcccccttctctcctgcttcctccagggaacccaacagtcatgaccctgatagtttcccataacaacctgggcattccttgggactcaggagctgctaaactctttcatcccctggtggcttcagcagtccttatcaccagcctcacaatcccacaggcccacccccagtgggcctgtggcattcatatttcatattcatatttcaaaccacaatatccagcaaaatgtctcctgagcacccagaactccataccatcggccgggtgtggtggctcatgccttaatcccagcactttgggaggtcaagatgggaggattgcttgagcccagaagttcgagactagcctgggaaacataggaagccctcgtctctacaaaaaaaatttaaaaagttagccaggtatggtggcatatacttgtggtcccagatacttgggaggctgagataggatcacttgggcccaggagtttgaggctgcagtgagccatcatcatggcatcattgcattccagcctgggcaacagagcaagacctcgtctcaaaaaaaaaaaaaaaatgaagtccatgccaccattcttggcagcccagcccttatcctccttaattgctccctgtcccttttccaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaata

SEQ ID NO: 139941 - DNA, 481 bp, Homo sapiens
gtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtgagtgtccttgcttgtaaggaaaacccaacctcatctttccttggcagggagattctggagcagtccctagggaggccctgtggggaccccggccccccggacacagcttggcttcccctcgtaggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcg

SEQ ID NO: 139942 - DNA, 2860 bp, Homo sapiens; identical to SEQ ID NO: 139853

SEQ ID NO: 139943 - DNA, 351 bp, Homo sapiens
gggagactgtggccgctttctgtctaaccgagccctcaagcgggtcagatgcagcctccatccgaacctctgctgtgcccagcccctgtggaaaatactataccctcaatggaagcaagctttggatcaggcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattaccca

SEQ ID NO: 139944 - DNA, 4916 bp, Homo sapiens
gcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacaatatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactttgggaggcagaggcaggaggatcacttcaggccaggagttcgaggccagcctggccaacataacaagacctcgtctctatagaaactaaaaaaaattagccagggatagtggtgagcacctgcagtcccagctactcgggaagccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcctgggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaacttcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttctaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgatacaagtcaggggacatctgggtcttgactccccagatgctccagctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaata

SEQ ID NO: 139945 - DNA, 2548 bp, Homo sapiens
gggcaacgaagacaccccatacgaagcagtgcacaggcacccctatccttgcagcaaggccctggccgagtggctggtcctggaggccaacgggaggaaggtgagcccagaaaaaggaggcgcagagatggggctcctgccctgcacacccccttaccctgccagcccaaggaggccggggccgagagcaagctgtcgggtcccaggtctcagcagtacctgcctttgccaccaggtccgtggggggctgcccctggtgacgtgtgcccttcgtcccacgggcatctacggtgaaggccaccagatcatgagggacttctaccgccagggcctgcgcctgggaggttggctcttccgggccatcccggcctctgtggagcatggccgggtctatgtgggtgaggactgggctaggcagggggaggctgagaatatggcaggaggacttgctctagaagggggcaggacccacatggccctgggagagaagtgtggactctggctagaaaaatatggtctatacatgggccaaggtagactgtgattatgtctccacagcctgcagagaatacaggatccatgcaagttgggacattaaaaagtgtatcataggctacagagaagattgcagctatgggagcagccattccccaggagaggagaggagagggacagtgtgtacacagcactaaaagggctgggttcagtggctcgcatctataatcccagcactttaggaggctgaggcgggaggatggcctgagcccaggagttggaggctgcagtgagctatgaccgcaccactgcactccagcctggatgacagagacagaccctgtctctaaaactttttttaaaggaagtagcatctacacagggaataaggtcacctgccactccatcctgcagtccccaagcctctcagggcccaccacgcaggtcctggtttctctatcctctccccaggttctttgcagatgcaggctggcccaggagagcaagtgactaccagggcgagggagaaggcagcctttcccaggctgctgtggggatgtgggcggcaactacctgggcccaaagagggggtggcccaggagagcagcctcgatgtggtgttgcaagggcactcaggggtgtgtccgcctctcttccgccaccggcaggcaatgttgcctggatgcacgtgctggcagcccgggagctggagcagcgggcaaccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgtaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacgaccgtg

SEQ ID NO: 139946 - DNA, 1648 bp, Homo sapiens; identical to SEQ ID NO: 139884

SEQ ID NO: 139947 - DNA, 6723 bp, Homo sapiens
atcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggtaagtaattcattaaaaaattgtagtcacctttttaaaaacagtaatatataatcagtgaagaaaaatgagaaaatatagctaagaaaaaatgaaaataaccaaaattcttcaacttttcccatggaaataagctcagtcattttaaaataaactgcaggtaagtaaataataaataatctgagggaggatatcagtgaatgggtaagagaaagatgaggaaaagacattattattgttttaattttagatattccctaagaaacatcaatattgtcaagataccctgtacatagggttaaagtgcctaattgtaatttttaagtgtgatctttgcccaaacgaagtatctgtagagcaaaggaacgttggccttggaaaaaatgatccacattttgccactatgccaggccactcttgttgtggagagcttggccgcttctgctttggaaaatccgtgagaattttcatgcgtgccctgcctcttactcccttcccagtttgtccacagacatgctatttcctttttacattttatacaatactaggctataagagaatgagcatcagtggtgatctgaatgggttaaggcagtcaaaactgaaaaagattaacttgtaacagctagtaaggataaattaagtttagtgggaactacatgttataaaatcgcttatgaaatgaagcctcttatagcaggcttaatgtagtatcctgaatttcctcttcattgtgtgtgtgtgtgtgtgtgtgtgtgtgtgtttaaagagagatgctgtctgttatgtggcctgggaaagctttttttttctttctttttttgacagagtctcattctgtcgcccaggctggagtgcagtggcatgattttggctcactgcaacctccgcctcccaggtcaagagattctcctaccttagtctccccagtagctgggactacaggcgtgcaccgccatgcctggctaatttttgtatttttacttgagatggtgtttcgccatgttggccaggccggtctcaaactcctgacaccttaggtgatccacctgcctgggcttcccaaagtgctaggattacagatgtgagccactgtgcccggccttggagagtttttttttttttttttttttttgagacgtggtctcgctcttgtcccccaggctggagtgtgatggcatgatctcggctcactgcaacctccgcctcctgggatcaagcgattctcctgcctcggttccccgagtagttgggattacaggcacctgccaccatgcctggctaatttttgtatttttggtagagacagggtttcatcatgttttccaggctggtctagaactcctgacgtcaggtgatccacctgcctcagcctcccaaagtggtgggattacaggcatgagccaccgtgcctagccccgggaaagctttttgacatggaaatgatcatgctgctgatggtccagggccccacccttggaggcagacagcatagcttttttatcagctgaggaaagatgctcagagaggttaagtaactttactcacaatacccagctcacggacagcagaactggtgttcaaacccaggtcttgtgcttccgagctcagtggcctttgtgagtctagtacaccacaaatcttaaagaacagtagtgatatggcattgatgaggctcagacatcagactgatgcagtcaacagcaaggagagtcccatgtggtgcttttgaacacaacttagtcaccatttctgatttctttctttctttttttttttgagttggtgttttgctcttgttgcccaggctggagtgcagtggcatggtctcagctcactgcaagctctgcctcccgggttcaagcaattctcctgcctcagcctcccgagtagctgggattacaggtatgcaccaccacgcctggctaatttttgtatttttagtagagatggggtttcgccatgtttgtcaggctggtctcgaactcctgacctcaggtgatccacctgcctcggcctcccaaagtgctgggattacaggtgtgagccactgtgcccagccaaccctttttgatttctgatacctcacttgcttctatgctacccagcctgctaagtgtggtgtggcatccatgctgaccttatttggggactattgctaatgtctgtcctccattcttgcatctctgggccattttttgctaatataattaggctggtattacttgtaaaaggatttgtctttagacagtctcagctgctcttcctcccaccccaacttttaatttttgtgtaaaagtcccagcaccagagttctggggcccttctcttaattgtgctaccagacaagagcattcgtggcagtttttcctgtgtgtattcataaagagtatcagagatatagtggtcagatgaacgtggtaacaaagcgcttgagttaaactgtgagcaaagcacaagattgcggtgtaggctctgttggggcacagtggaagctgtgcttccaaatgctgaaggagccgagttctgccgcagtggcaagaagcctgggctggaagctggaggctggagctctgagtccagctcttctgagaagggtggggctttgggcaaggtatttatcctctccgaccttctgtttcctcatacatggaatgaagatttctgaccattaggtatctgggattccttcactcaaaaatgctgagtttaaattataagtcagcactgctcagctttggagtctggggaagctgtcttcccagaagtgctgaacttctgcacagggtttgtagggctattgggtaaagaagttgtaagcagaaaacccacaaagtctactgaggcacttttagattcactttctaatttccaaagctgaaaagtgctttctgccaatgcatattttaaccaagtaccttcctcctttttccccacccctctctttttaatgacaaggaaattggctttcatgcttccctggcccagagaaaccccaacgctcatcacttggaccacaagatggaaataaagcagtaggtagaacacaaaagataaactccagctctcatctaagtcccttcctctacctgggcccaactctgccagctggtcttgtcttcccatggtgccttcctcctggattagctgcctttacccttgtaatgtgaaccctctgaaacagtgctgtccaaaagaagttctggaatgatggcagtgttctgtatctgcactgcccagtgtgatagccgctagtcacatgtagctagtgagcacttcaaatgcagctagtgtgactgtggaaatgaatttttaatttttaaggaatttcaatttagctacctttagctaacagattggacagcacttaagttgggagggagggagagagtgtagattttttttcctttgacaatgttttcagactttatttgcatgggttctagaactagaatttgaaggcaggcataatggctgagtggaaagaaaatggcccaggcgcgggagacctgagatcattcattatttcagatggccagttactcattcagcaccataaaggctgctgttgtgtgcagggcagtgtgctaggtgctggggataaatactttccctgtctcggaggggcccatagtctggctgagaaagagtgagtgagcaatgaaatcaatggctctggcagattctggaaggtctaggaaaactccaagcaggggacataagatctgagcctcaaagaatgagtggaagtttgcttggctgaaggaattggtggcggctacccttggggactgctgtggcttggttcagtaggcatgcctggggcacaggaggagcttacgggagaggcatctgaacagccagttgggggtctggttcttgggtagcagtccaacagcctaagacttcagcctcaaaggccagtggttttcatgtcatgttttaggtgcatttgaggttccacaaccactcggttggaatttcatggatgctgcagctaacatgagaccacagctgtcagccatgacccccgattccaaactatggtgttcattgagacagccagtgatcactgttctcatggactctattttaaataattgtttaaagatagaatgtataagtttatactaataaaatactgcttttatctatttttttctttgggggtctgtataagattgcattttgaaaagaaagctataggcaaccataggccgaggatggtaggcacctttggggctagattctcagctttggggcctcacttgcctcacccgtaaattggaggtaaccacagtatgtgaaggcaggggctgggcctcaacatctttggaacctccttatagtgatgtttagacctctagatgctccctcagatggccagtgtcagagagagagagttcttactttcattttaacccctggtggtctgtcccagacatgtgacaaaggcaggtcttaaactgtgtcctcagaaggggagtggcttgtaatccaggtgacaagcagcatctgatatatctgtgttgctgcatttgctttccaggtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccaggtatatatgagaaagtgggcagacctctcccttccatgctgtgtgtggccctcagatattctgcccgctaagcgcaaacatagtgctttagcttggtttaaatggcactttattgcagctttcctgccccacccaggcagttgctgctttttttctctcttaatgaccagtaggtggggcttggggcccccccagtgtgggggactactaagggcctggtttcactgtcagtttcagttgattgcaagtgatcagaactggccctggaatagcaacctccttgctgcaaggtgtggtgaactctgtgtctccaatgtgcatattgtttaggttaatttacgtttgttgctggaagcaacaactggatcacccttgagcccatgccactcttgagtgttctatcttaaaaggtggagatatggtccttgtctttcaggaagttataatttaaaagagaaaggcatgaaacgtctgctttggtggtgatattaaggaactagctgtgtgtctggtgggaagtgtgccctctatgtgtatattttggaatataaaactaaatccctgtcctaatattggaatgtttaggggctatttgggggcaagcattggtaggctggatttttttttttttttttttttgagacagggtctcaccctgtcacccaggctggagttcagtgatgtgatcatagttcactgtagtcttgaactcctgggctcaagcgatcctcccacctcagcctcctgagtagctaggaccacaagcgcctgccaccatgcctggctagatagggtcttgctatgtgcccaggttggtctcaaactcctggccttcaacagtcctccaagctcagtctcccaaagctctgagatgacaggtgtgagccactgcacccagcctgaatttgtgtttttctatattttgtttgattataagtgtaatgtacacttattattaacaattcaaaccgtactgaagtataagaagaaaagaggaagatgccctttcactgatcacattctgcctcccgcccaatctcattccccagtgttgctatggtgatattaatagttgggcattaatctctccaaatctttatatagagaaaatgcacacttgcgtgtatgtgtatgtatatgttcacgtaatacagatacagacttttttaactgaaatgggatcatacaagatagactgatgtgcagctggctttttcacttaactatgtattagacatcttttatgccagtgggttatagatagagcccattctctttagggaatggaatgccttgtgctgtctacagtacaaatgagtcgtgatttttttccccaacttttcaccattctcttattagaggacatttgtgttgtaagcactgggttttaaaggtctcacatgctcttggtcatccattcctgtggacagtagtcctctgaatgggaaagtatatttcataaacgcccatcacagaggaagaagtactgtcacgactgtgcacaaagctagaggctttgccatccccagggcccttggccctgtgtcgctcattgaactctcctccctacttgctggcagccttcactgtccttgtctttcagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaag

SEQ ID NO: 139948 - DNA, 1216 bp, Homo sapiens
cctttcagtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtaagggtcacaccaaagttagggactttgcactgggagagcagcacccagggcagggcccttggttttgcagattaccaaaactaaggctgggggcagggaaggcgagcaggcttggggcaccttggaaggaggcacatgggccttgggggtcctggctagggcagctgtgcctgccactggccctctgcccaccacccctcctcactgtggctatccagtgtccagcctctcgaggggttctagggtacttattcctggagctaacggtgacccaggacaccagtgtccggggcctggcctggggcttttatggggggagctggctggctgcccagggctgtctggctctctgggggctctgcatggcatttccaggggttggtggatcagggattctgtccctcaggagaatgtgggcactagcccaaggccactcacttctgtgtacatagccacctgagggcccaggaatggagggggccaggctacagctggacatctggcactcggatgggctctggagcccccaggcctgcagcatctgcccagggactgccctggcccttggccatttcctcagggacccacagctccaccagccggcccctcccagtgctggaatagacagttcctcagtccacatctgccaaaggcggcactagaaggcatcctgccttttttactgcgttctggaggtggggtcacaaagcactgctcactgcataaaagggacagcatcctgcccctggcagccctgcctgaccagctccgcctctcccactgctatccaacctgtacaccctggtgaccatgtccaggccagtggccttaaggactgtctctgtactgatggctccacatctacctctccagccagactctcctctgaactcgggcctcacatggccaactgctacttggaacaaatcgccccttggctggcagatgtgttaacatgcccagaccaagatcccaactcccacaacccaactcccag

SEQ ID NO: 139949 - DNA, 3442 bp, Homo sapiens
agaggctaggcctgaggcctggaccgctctgtgagcgaggacccggttccgcccgaaggatgaagacttgtctttaaagatgacaacgtacaggaaaggtccatcagccgatctccccctgcctgggcccacagcgccccccaaaccctcaccaccctctctcactgcctagcctgcctccctaccttctctctgaggtcgctcctcattcttgtgttacccaggacagggacctagccagaaaccggcagcattcccccttctgtggagtgacagtatctccctctcattgtaacttatcctcaggcgcattcgacagtcccctcttgctttctcacccccttccttcacccaagggaccctctgcctctccagcccactcccagcctcctttctcttggttccctggtcatgcctgcctccctgtctcctgtctctccctcccacacacacccactatcctcccagctatcccagcaccctccttcctaatcttgggagacatctcgtctggctggacgggaaaattccaggatctaggccacacttctcagcagacatgcccatccttggggaggaggaacaggagagagcctgaggaagttctgggggacagggggatgatgggatcaaggtcaggccaggaagcccctgaggacagagactgtggggagactgggactgggaagaaagcaaaggagctagagccagggccaaaggaaaaggggggccagcagggaggtatttgcgggggaggtccagcagctgtctttcctaagacagggacacatgggcctggttattcctcttgtcacatgtggaacggtaggagatggaagacggagacagaacaagcaaaggagggccctgggcacagaggtctgtgtgtgtagccatctaagccactggaccccagcagacgagcacctaagctcaggcttaacccagtgcacgtgtgcgcacatacatgtgccccgcacctgacagtccactcaacccgtccaaaccctttccccataacaccaacccataacaggagatttctctcatgtgggcaatatccgtgttcccacttcgaaagggggaatgacaagataggactccctaggggattacagaaagaaaagcaggaaagcaagcatcctgttggatttcagcagcaggtatgatgtccagggaaaagaaatttggatagccagggagtgaaaaccccaccaatcttaaacaagacctctgtgcttcttccccagcaacacaaatgtcctgccagattcctcctggaaaaaaacttctgctcctgtccccctccaggtcccaggttgcccatgtccaggaaaagatggatccccctatccaaatcttctccgtggtgtgtgtgggtggaggagtggaccctggtccaggcaggggctccagggaagagaaggcgtcacttccgggggccttcaccagtgtctggtggctcccttctctgattgggcagaagtggcccaggcaggcgtatgacctgctgctgtggaggggctgtgccccaccgccacatgtcttcctacccatctgctccccagagggctgcctgctgtgcacttgggtcctggagcccttctccacccggtgagtggccagcagggtgtggggttatgtgagggtagaaaggacagcaaagagaaatgggctcccagctgggggaggggcaggcaaactggaacctacaggcactgacctttgtcgagaagagtgtagccttcccagaatgggaggagcagggcagagcaggggtagggggtggggtgctggtttctgagggactgatcacttacttggtggaatacagcacagccctggctggccctaaggaaaggggacatgagcccagggagaaaataagagagggagctgcacttagggcttagcaaacacagtagtaagatggacacagccccaatccccattcttagctggtcattcctcgttagcttaaggttctgaatctggtgctggggaagctgggccaggcaagccagggcgcaaggagagggtaatgggaggagggcccactcatgttgacagacctacaggaaatcccaatattgaatcaggtgcaagcctctttgcacaacttgtgaaaggaggaggaagccatgtggggggtcctgtgaaggaaccggaaggggttctgccaagggggcagggaggcaggtgtgagctatgagacagatatgttagtgggcgcctaagacaaggtaagcccctaaggtgggcatcacccagcaggtgcccgttcctgggcagctggtctcaggaaggaagtcccagaactgttagcccatctcttggcctcagataatggagtatttcaggacttggagtccagagaaaagctccagtggctttatgtgtgggggtagatagggaaagaatagaggttaatttctcccataccgccttttaatcctgacctctagtggtcccagttacagctttgtgcagttcccctccccagccccactccccaccgcagaagttacccctcaacatattgcgcccgtttgccagttcctcacccaggccctgcatcccattttccactctcttctccaggctgaagccacaatactttccttctctatccccatcccagattttctctgacctaacaaccaaggttgctcagaatttaaggctaattaagatatgtgtgtatacatatcatgtcctgctgctctcagcaggggtaggtggcaccaaatccatgtccgattcactgaggagtcctgacaaaaaggagacaccatatgctttcttgctttctttctttctttctttctttcttttttttttttgagacggagtttcactcttattgcccaggctggagtgcaatggtgcgatctcggctcaccacaacctccgcctcccaggtacaagcgattctcctgtctcagcctcccaagtagcttggattacaggcatgaaccaccacaccctgctagtttttttgtatttcgtagagccggggtttcaccatgttagtgaggctggtggcgaactcctgacctcaggtgatccacccgccttggactcccaaagtgctgggattacaggcatgagccactgcacccggcacaccatatgctttcatcacaagaaaatgtgagagaattcagggctttggcagttccaggctggtcagcatctcaagccctccccagcatctgttcaccctgccaggcagtctcttcctagaaacttggttaaatgttcactcttcttgctactttcaggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactg

SEQ ID NO: 139950 - DNA, 323 bp, Homo sapiens
aaaccctggttctatgacatgaagaaagtttgggagggatatcccatacaggtatgagttctgcttcctcatgtgggggtggactaagacacaccctagtgaagagacggtttgtggaatccatggcagagggattagagtgatggaatgaagaacctcaggggctagggggtttgtggagtggggacacccttgcggctggttgctcttacctctctctcctctcccagagcactatcccttcccagtattggtactacatgattgaactttccttctactggtccctgctcttcagcattgcctctgatgtcaagcgaaag

SEQ ID NO: 139951 - DNA, 689 bp, Homo sapiens
taatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagccctcagggcctgaggggaagtggtggctgtagcctctaatagtctagtggtcgtcattcctccctggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcg

SEQ ID NO: 139952 - DNA, 873 bp, Homo sapiens
accatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtctttgaagcccaccaggtaactggtggtatggggcagtgagtgcttctagcctatccttgtcggtaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcag

SEQ ID NO: 139953 - DNA, 3679 bp, Homo sapiens
attttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcag

SEQ ID NO: 139954 - DNA, 627 bp, Homo sapiens; identical to SEQ ID NO: 139852

SEQ ID NO: 139955 - DNA, 9244 bp, Homo sapiens
atattaataaggcagcggaaagaagaaatatgaatacggctccatcaagacccagccccacacgaaggtaaagtaccctgaagccgtgagttaccttgggagagttgggctctggggagttaagcccagcttcgtacaccaaaggtcttttcttccccccaacaagtgaaacgctcaagcaaacaataagaacatgaaccctgtgtgaagggccttgctgctttttttaaacatacatcaggagatacagaggaagctttgtgttttcggtggcaaatccagcaagttcagcttgcaacatgagttgcaggcaattggaagaggataaacctctgtctgtccccagctcacgtgtcattgggagcctccagagcagaaggagtgccccagagtcattggtgtatgccatgctgcactgcagtgggcagcagagattcgactcttcattccaaatggctgccggtccagatgttaacccaggtttacggaaagtgctgcttgagagattgccgctgtgcctgtgctgcagatcccctgtttgcttacatacttgggttatctgtttgaggggaaataaaaagggcaaaacactccagctctcgaaggtctccctttttcttagctttcacggaaatcgagggtgttttcccaatgtattcttccttccggtgtatacaaaagagataatcctggtgtgtaccctcaagatacacattaaattggtccctcctctcaaagaagagctttattaatgataccatttacaccaaaaataaagatactgtattcaattgttctggccccataacagcacacaagtggatgcagttttgtgtagagggcagacagatatgatatatttcatacgaatgatatatttcatatctggtgtctcttcaaggcccaaatggattaattgattttgccttgcctctaagtaaaaaagccagttttccccagaaacataactaaactacgtaccacagtaaactgcatttcctacagtgaactggacagtgctgcatacagtgaatcctcgtctgtactggtagctccactggtcaccttgtgaacccaactaactgagcattacgcataacatacagctgtcctgcttttggacaaaaacacctgtattttgttacctgcttatatgaaagaatgtccactgtgtgtttcatgtatatactcctacttggatgtgaagttctagctaccgggaatagattacgcatgcccactctgcagtttaagcagaccctaagggcaagtaatgctgctggtttcattcagttggagtctttgtccactctgcctgtgcagcagagttgaatccaataccatagctacagctatataccacagctgtcgtgtggattccctggccattcgttggtttcactgcggaagtgggcatgtaaattggtattctgtctgttctctctaaagaatgcttgcagcttgcaggtaaatactctgttggttgatttgtgtgtatgtgtgagtatcctgaagaacataaacaaatcctgcagaacttcagcagttccgtataatgtctgctttcattagccttcatctaaccatgccacagatcttgggcagtcctatctgtgttgctccttattgtcccagcacagaatggaatacaggtggataagagttgcatctaatcttcagaagtacagggttcccattggaatctttagttgccaggtggcttgaaaggagataaggtgtgtatccaatttccaaagagcgctaacgtgtgtgtttcctggtgacttaccaggagtgtggaatttgtaactataaaagacactgactccgctagtaaaatcctacccctctctgttgtctccatgatacttggtgatctctggataatgtctgtgtgtttctgcaggcaaaaacaacaacaacaaataagccacattgcagaatagagaatagatcctgtttctgttatggattgagaagggtattttatatcatcctgttaatgatacttaaccaaatgcttttaacatttctagttgattgtagatattcaacaaacattgcagtgttggggaatgaccaacttccctggttgaaacccagtaatagccgttgccagagcattaaattaaaaatattaatttaccccaatctagaaatagttttatgctttttttaaataatagtccccgcacaaacaaacatacagacagcactggagagggccttataaaatgagcttctagccaggcacagtggcccacacctgtgatcccagcactttgggaggacgaggtgggcggatcacttgagctcaggagtttgagaccggcctgggcaacatggcaaaaccccatctctacaaaaaaatagccgggcgtcatggctcttgcctgtactcccagctactggggaggcattgaagcgggagaatcacttgagtgcagggggttgaggctgcagtgagccgtgatcacaccactgcacttcagcctgggcaacagagtgagtccctgtctcaaaaaataaaatgagctccttaccaactatataaatatacaggtcacctttgtatgccttttaaaatatcaccttcctcagaaatcaattgtaaaatgaggtcatttggtggtgtggatagggcagtgacttcctgctttatttacaatcaacaggagggacagctaggctaattcaaattccattaacaatccatcttccccttggtgatatttccctagctgggttcctcagcatgttatttaacatgatgaagttccatacagtcatgtttatttgcttcagggaagaatgatggtcaccattagtaaccccatctaaaaaccgaactaagagtcccagttttttaccttaaaaaaaaaaaaagacaaatttaacattgtattcaaaatcccagttttttaccttaaaaaaaaagacaggtttaacattgtattcaaaatagcgagcactaacattttaatcattgtcctgatcatactttatctcttaagatataccaatagggcagacataaattgcaaagagtaggtgagacgggcaagtaattaatctggaaggggcaaatcatttaactgagggtgaacactgggtacctcctttgggtgcatgcttccagtcaaagccttgagataactccaaatgtatcaatagttgacaacaacaaactgcctttatttggcagccctaatcattttgtatgcccccagccacagggggtgcatcattcacaggggaaaaaaaacactacctatggcaaatatttcctaaagttatacctctacatttttagcgctttctacgtttaataagaatattggtataagcatactggcaagacctttataacaccttgttttgctggacttaacgtaggtatctttgggagttttacaggattatcacctcttcagatgtttcagtaaaccacagttctgctggctttgctctctattcaataatatgactccctgatgactccagctgtcagtgtgtaattctgacaatattggcccagccaagcacagaactctgcatgaggaatctctgctctggatcacatttcagcctgaattcttatcatctaactcttgagggccacttcattgaactcctgtgagtaccttgcatagttaccatgcaagttgtcaagcatcgatactaagcattagtccttcttcaaagacaggatcatgattccagttgtgccttagatatctcagttaccatcttcagctcaacaccttgacagtccagatcttgtagcatatctttatgcagatgtggcctctaggtacaagaagtaagactgtacttctgaatgacttaaagaagaacaaatagaattaacttgtctgcatccaacgctctgcagaggatttttccccatatatttgtgaaagatgttaaacctggtatctctttggtgaaagtcattgggtatcggctcatcagaaataacctggctgtagacaagtttcttatatgacctgaaatgctttctgcttatccacagggccctaatgcttttgattattgcttgctccctggttgtgagacagcccttgctctaggtgggccacaaagaaattccaggttgtgattacctctgcagtaacacttgaagaagtcatcagttctcagcagctgccacctctaccaataagaaagttctgtttgtgctggagaaggttgtcagtgcttcctaaggaaaagcatggacatgtgtaaaatttgggtctgtgaggtgtgatatctcattgcacgtccatatcctacctccacctaatggcaatattctggacaagtctgttgtctccatttctaacagtagcatgaagccctcctggtggaggatcaacatcatacagcagccagccatttagatgatgatatttgtggacagtatatctgtgacagaagtttgaagagctaatgaaggatttttcagggtcagaaagaggctggccctcccaaggaagacattccggtgaacagaaaggaagaaaggagatgctgacctttgcagaaaagaaagaaaaagacaggggtcttcctccctgaccgtctgtagaaccaaagccaaagaaaaccatcttggatgtgaagtttcagtctcttgccaaagagaaattcaaagtccatcacagttttccaagatgatcatctatcagttcttactctgtaggctgtcacatgcctggtgctctgcacacccctttagtcctcaggaagagacacattctaccagaagctcatcacttgccaccagagccattgttttccccttcacccctttcgcccttacgtctcaaatgtttcccagcagtgtgactatattcccctcaaggcaaagagtatttgcctttttccccctcctgaatagatgaggaatttacagcagaattttagttgtgtttgccacctgccttcagtttgtggactccagtgctgaaatttaaccactgttcagtttctttttatcctctagtgatgtagtacctgagggtatgctgcatttggttcctttagtaaaacacctctggtgctgtgggatgatattgttaaccttattatgctccagaaacctgattctaacccacttatcatctgaggtccagcgtctcccacaggaagctttgtcttcttgcactttgattcgtgcatactactgcccttttgttagctgtagtcttgttttgaaaaatatgttggggccagcagcaggagcccttttgttctgaggagttctttgtttgggtcctaaagcaaccctaaagggttttttgttttgttttcgtctccagaagaacagcagtctaccatagtgtttatcttttggagaaaggaaaaaaggctttgcctttccttttgagaaaattattatcttctttgtccctacttccaccatgcctttggttctttttccttttgtgaatatcacctcttctacatttttaccctgaaggcacttgagagggaattagtagttttgttgcacatggacttcaaattatttgagggaaagggtggggcttgccctctcagactggaagattgaacccagactttgcgaatctagagttttagtcaacttgcagggatggactttgacaggtaagtaaggtttttcagtggattcaaaagaatgaggaccaatcataacataacacttataatactccgaaggtggtaaataacatgctatgacatgccccaccccgatttccaccagcccaaggctttgtgtgtggtctgtggtctgtcaggatcatgatatctcagccctgattgccaagaacacttgaaattggattccacctctaatgactacttctaactgctccccaaggcaggtttatctgccgatcattaatccaaaaatactttgcagttgtcctttctctttggatcttgagtgtttgcccacattacatgctacatcagatgttacatgttaggaagattatatgatgtaataaggaaggttgaagtaagaatcttggttagtctttactttattctaataagaaaaataatgcttagctattctcatttaaagtccctggtctatgatatgtttgctctcacaagtcaggaatgctggtgaaccttagaatatataacaaatatttttcatggaagcaaaattggcatttaaattgtttttgctgtgcccgtgtagctgaggtgaggttttccacaagctgatgacatcatgatgaatacctaacgtgtgtaaccatggtagacgacaaaagtatgagcaaaacatgctgcctgctcttgagaggcttacagtttagtagaataattcaattcattaaacatttactgaactcctatggtgtatcctagagctacaaagccttcaagagaacttcttatttggtagggaagccacgtaaacaattacagaacagtgtggtaagtgcggttatagaagtttgtactggagcaagattcattcaacatacatatagagcatctgtcgtataacagacattgttctacatagtgggtttgtagtgcagaatcaaagtgacatagttcttgtccttgtggcacttgtagtctagtagggcagacagacattaagtaaatatgtaatgtcaatttgtgataaatgacaaaagtgaaaacagtgctatgagagaattttaggggcagaaagtaaactttgattgaatctaacaatcagggagtaggggatatttatatgctgagacctggaagaggagtatagatctcttcctgctactcacgtaaagggatcaggaaagacgttggctaggcagagctgaaaggccggtgtggcaaagagtggtgaactagggagagggtgtgacagggttagagaagacaggagccaagattatacaggaccttcatggcattggtagaggttgtagattgaattctaaatactgtgggagcctggcacagtggcacacatctgtagttccagctacttggtaggctgaggcaggaggatcacttgagcccaggagttcaaggctgtagtgttccgtgatcccacctgtgaatagccactgcactccagcctgggcagcataggtgagatctcatccctataaaaataaatacatactgtgggaaaccagggaagggctttacatacgtaacagatcactgtagagtgatctttctggagaaagatttggaaagaggcaaaaacagaaatgaggagactgctttagaaggctcttgctgtggtttgagggtgagatgattatgcgctggccttcagttttgccaaagaaggtaaaggaaagtgggcagaactgagaaagaatggagaaaatttggaaatgtggttggaagggaggatgaggctttaagggaaagatgacatccagtttcgtggcttgagtaactgagtagttggatgtgccatttactgagatgggaaggactggaggaggagcatggttgttggggaagatcaagagttcagggcaggttttacggagaaggtaatccttaaagcgggtcagacataagacattgttgtaaaagggtaaatgccagatcaagatgagtaatacagatagaaagtgccctgagctgagcagaagagatcagcagttaggaagggtagggaaggtttcttggaagacatgggacacgaacttgcctgtgtggattggatggtacttggattagtgcaggaaaaatattccaagtatagaaatcaaataaataaaactattgagatagattatatcttgtgagttataagaattaagtagaactgaggaggttgaattagaaatgagagggagataatagctgtcagatttattaggctttctaacatagaagttggcattttaggatagttagtgtatttatgtgttgaatgaattgaaagcaagtaggttgatttttaattttgtgttttggaaacctgttggtgtcagaatagaaataagggcttggattggacttacaaatccaatgggaatggaaagaaaaagtgaacgggacacaagtgactttattgggatgggggaagaaaaagcatagttaatattcaagaacttaaaacttgataagtggaaagatgattttgtcaaaagtggaaaagtggggaatgggactgatggggttggggtaagaagtttttaattttaaatatgttgaagaggagtttccagtgggttgaaacgtctcatgaagaacattgagtcagagcagacaaagcatatctgtgacttcactgttcaggttgtttttttgttttgttttgttctcttttttttttttttaaaccatcttgagcaaaatggaatcagcttctacgtaaaccctcagattgagagataccaatactcaatagccctgacaaaacagagaaacagattgttcttggtcctttactgtatgtatcttatagtaattttttccccttaattttattatcctgccaagatacttcaagtgcattttccgtactttaaggacagttcctttgatcacttttataagattgtgccattcgctctttttttcttcatgagtcttgcctccttactctgtcactccaactttttaccccttgtaaagtctctttcaagcaagtctggtggaaagacactttcactttgaaagcctgatgaatactgttatccagtcaaaaccttcagtttttggtcatgcattcttttgatgtcctaatcttttgagattgtggaacctctagactatttgctgaccagatggatgactggccttaaatgttgagtcatgttctgtttggctgccctgttttagagaagaatgcttggagggtgggggttttctcatatgaagagctgatgggttggctactttcaatttctttgtcttagcattttcttgctacctcccacagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacag

SEQ ID NO: 139956 - DNA, 10465 bp, Homo sapiens
ggggccctgattcacgggccgctggggccagggttgggggttgggggtgcccacagggcttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcagtaaggagccctgccccgtccccgctcccaggagagcctagaggggcccccctcagctcctaacgagccccccttctgagttgagtccccatgaccttcagcctttagcctagttgctgggaagggggacagggcccatgagagcccaggggtccttgcttggaggtttgagcctccagcccctgaactgctcctctgcagagtcccaaatcccatgagcccaggcctttagcccagtccttgggcaagggggacatttcccaggggggtccaagatgggagaaaaagcaggtgagttcacaactcaaatgcctggagaactgggaggtggtggaaatttttagccactctgatcatttatactctccagaccctaactcctgcactgagtcctcagtgggtaggctccggggcccaggaagcactgccagggaggagggcccgaagctggggtttgggggctttcctggcctcctagggactcatgcgtttagccagggaagcccaggtctttcttacctgaggcagacagagcctcgaggtgggagctgctcccctttcctgtatggccacaggcaccccacctcaccagcaggcgccattagaggctgcccgttctacatccccatccgctggcggactccccgtctcctggagaactgggtgggtcctgagctcgatgcctcccctctcctcagcagagctgacctagttactaattacccatgtgctttattatttctcttttgttttataaatttataaatggcaaaaggctctgataaggtctgtgatcattaacttgtaggaatggtggcctggaaagatctgggccaacccacctcccacctagtgggggtgggggatgggggtgtgggggagaaggaaggatggcctgggggctacaggggccacccctccccagcggctccctgacctccaccctacagcgcctgcttgaggaggttcactacttcctgggcgctgtgctgaggtttcacaggaataatttcccttcatggtgaggagtcctgggcagaagctattggtgactctgcttcacaaatggggaaactggggcttagagccgggaaggagctagactaagttcaccaaactgaggccccaaacctactctgttcggtgctctcaattgctatgaccggggaccagaggcctgcagggggtggccagggagtcagagagagaccgagccccaaagatgctccaaaggggcccatctcttttctgtccaaggtcctgatcccagctggggtgggggagggctggtggattcctgctttcccagaggcctcagggagcctcccgagggcctggacagggggcaggggagcagtcagggccccctgacttggcaggaagaggagggcaaaggactccagagctgcaggggaggggcaaagagtcaggcatcccagacccagggcgaaggcaacctgacggggtggggctgggcctgacctgcccagggccccagatgggactgggggctttggggtgagggtgggggcaggggatgctttcttacctggctgagtgagctctctcggtcagcagccccctttggtgggatggtggggttggggaggcttgatccacagcatttgaaggggaagcagaggtcaaagtgcttcctagggaccagcagagacctggaagctgaggcagagagtgtagagagaggccattgggggagatggacagagaagctgggagaagcagaacggaggagccaggggggcgggggctcagacccagctgggagaaggggcacgggagagaatgaggcgccccaagcttgcaaggaggctggagtgcttcccgcctgccccgattgggttttctttaatgctaacagcatgctatttactttccatttaaatttgagatgttgctataaattatcaaccagctccttgttcctgcagagtttataactaactacctgggttacttattgttcaggtaacaaaagggatcggaaaacgccctgagtgaaaaaagtggggcctccagcgtcagggtcaggaaaggagccagggagagaggggcgggggacccctattgaaggcctgggccattggggaggttgaggctgggaagacggtacagaggcagaatgtctagtagaagctgtttcccgggagaagtcagtgtctgggaagaagccggggtgggtcctgggtcccaggcctccctggggtgccccatgttggtggccacagcaggaacctgagctctttcttcagatctcccccttagctccctgagtgaccttgggaaagtctgttcctctccttctgcctcagtttccctccctggccaaggaataaagtccaaactccctgccttggtttcgttcccctccctccaccccaccaaattcctggatctcttcccaggtctttctcttcctctcggcctttgctgcagtcattttggctttgctgttcctcagtaccccaagccaattcccaccccagggcctttgcacgtgctcttcctgctgctcagaacctctttccagatcttcccatggccgattccttctccttcagctccctgattgctccatccaaaagggggccccacccccgtcactctcttccactactgttgttcactttctctggttccctgtcaagacttgtgatcatctgatttgtttgttttctatctcctgccatgaaaatagaagctcttcaaggacaaggcccgtgttgccttatttaccacttgtacccacatcctgcccagtggctgatgcacagcaggaatgagtgagtgactgggattgtctgaggccctgaagatatctgctgccctgttggtcagggcccagcagcctgagacgtggccaagggagaaactgggacccagagttccttcctgggtgtcctcccgggtcctttctgtccctgatcagctcaaaccccagcgtgtttcttttttgttgttgttgttgttatttttgagacggagtctcactctgtcggcccggctggagtgcatggcgcgatctcggctcactgcaagctctgcctcctgggttcacgccattctcctgcctcagcctcccgagtagctgggattacaggcatgcaccaccacgcctggctgattttttgtattttagtagagatggggtttcactatgttggccaggctggtctcaaactcctgacctcaggtgatccgcccgcctcggcctcccaaagtgctgggattacaggcactcagagccactgccctcagccttcaaaccccaatcttgaagtattctgatcctgcccatcaggcagcatcagggcactgagactcaggaaaacagtagccacggcaggaggggggggggacagaggatctgacgtccccaacaaaagccagactgcctgcatcctaatcctagctctgcccctttctagcttgagcaggtgattttatacttctgagcctcagtttcgtctgcagggtagagatgacaatagcccttgtccacagggttaaatggcatggcacttgtagagtaaacatgtagtaactgcaatatacagcagttattattagtgatcccattttacagatgagcaaattaaggctgagagaggcagtgccttaccgaacgaaactcttccaaatgactgaaggcaagccaggacttggacctgggtcctcctacctcacgctccatacagcaacctcgaggtcacactttcccctccccagtcattcctgctgtttaagttgaccatcaactcacttccatacagtgctttggagttcacaaagggcttacaaaatgcgctaagctcattttttcctcctccccatctctgaagtctgaaatatcattagccccatttcacagatgcggaaactgaggcacacggaggttaagcaaagaatcaaggccaggtctaaagcccccacactgagaagtcagctcccctccagatgtggagatgaataccacaaccttgcatgccctgaaaccccaggggccagagggcaagaggctcaaagccttggacatccgattgaccctggaaagggtaggagagagaggaggaagatgtgggcgggtcttcacttctcctgggctctgctgtgtggggccaagggtctccagggctgcattgttaagatgatgatgatgacaatattattccacaaattcagcacttactgtgcaccaggcattgccctaagttcatcctccctatttgaagctcatttaattttcccagtagcagtgtgaggtaggggtggatttaccccacgttacagggcagatgtgggtcatgcaagagcacgcgtggctaggtcacagtggtgggatttgaacccacattggtttgactctcaaacccattagagtcaaagcaggagatgcctggagacttgtcctcttagttctttcctttttctttctttctttttttttttttgagatggagtctcactctgttgctgggggtggagtgcagtggcgcagtcttggctcattgcaacctccgcctcccgggttcaagtgatcctcctgcctcagcctcctgagtagctgggaccacaggcatacgacaccacacccagctaatttttgtatttttagtagagacagggtttcactgtgttggccagggtggtctctaactcctgacctcatgtgatccacccgcctcggcctcccaaagtgtggggattacaggcatgagccaccacgcccagccttggcctcttagttctgagctaggacagttggagaatctgccctcaaaaatagtcaggcccttgaagactctgtgtgtgtgtgtgtgtgtgtgtgtgtgtgtgtttgtgtaagagacacacagagagacagaagagagagagtgatagcaagggagtggggggtagggagagagagacatcgattcagtaggttctagaaaaaagtggcacaggtggcttctcccagaaaagggaaagacatgccctcttggttctctgactcctaactggcatttaaaattcacttttttgttgtggattttttgcccaactctactaggaattgtttaaaagtggaacgttcgtatcagctcactttaacagtttgctttccattttcacattcaaaagcctgtcttcggtttctaagggttgcacatgtatttgtgcagggtggctggcctttgttttattttcaagttcagcttaaatttgacctggcatgagagaatgagaatgagagagagagagagagaaagaaacagacagacatggaatcagatggacaggggcacatagaaaatctttggtttgagcccaggagaggctctcaagaggtgagaggaagactgaccctattctctttgtgggagagagaagggaaggagggaggaagggaggacacaggaggacatggcacaggagggtgatggctgcagatgggggaggggaggcatcaggcagcctggctctaggatcagataaacatgtttgccacagagcaccaggctggactttgtactgcccttccttctgagctctgactggcactcagcaaagcagggagatgaaggagagaggatcctaggagccccggaaagaagggagagagagaagctggggagaggcctgcgggggtggggtggtcctggcaacatgaaatatttttgagtcccaactagatcaccttgcacaagtgactgcacctttctgagcctcagttttctcctctgcaaaatgggcacaccgtctacttcctagggttataagatgtaagtggccagtcctcagcacggtgcctggctcacagtaaatcctcaagaaacatgagttctcagacttttttttttttttttttgagacaggatttcactctgtcgccaaggctggagtgcagtggcgcgatcacagctcattgcagccccgacctctcgggctcaagagatcctcttgtctcagccttctaagtagctgggactacaggcttgtgccaccacacttagctaatttttctattttttgtagaaacagggtcccactatgttgtccaggctggtctcaaactcctgggcccaaggaatcctcccaccttagcctcctgaggagctgggactacaggtgtgcaccaccatgcctggctaatttatttttttttttatagagacagagtctcactatgttgtccaggctggtcttgaactgcagggctcaagtgatcctcccacctcggcctttcaaagagctgggattaccaccatgagccaccatacccagtttacaattcagttttaaatattatatatgccaaggtgggaggatcgcttgagcccaggagtttgagaccagcctggccaacatagcaagaccctgtctctatgaaaaaaaaaaaatagaaaaaagaagaaaaagtacaaaaattagctgggcatgttggcatgtgcctgtggtcccaagtacttgggagtccgaggtgggagaaccaattgagcccaggagtttgaggctacagtgagctatgatcacgccactgtgctccagcctgggagacagagcaagtagcctctaaaaagaaaaataaataaataaaaataaatattggctgggcacggtggctcacacctgtaatcccagcactttgggaggccaaggcagatggatcacctgaagtcgggagtttgagaccagcctggccaacatggtgaaaccctgtctctactaaaaatataaaaattagctgggtgtggtagcgcacacctgtaatcccagctactcgggaggctgaggcaggagaatcgcttgaacctgggaatcagaggttgcagtgagctgagctcgcgccactgcactccagcctggccacagagcaaggctttgtctcaaaaaaaaaaactaaataaaaataaatatcatgtatgcatatatagtatatattatgtaatttacaaagtacacaaggacaacagagaaaactgtccttctcactcccatccccagcaccccgttctcctctggaaggaaccagagtccccagttccttgcgtgccctccggtattttacacgtgcacaaatatgtagaaatcctcttttacctcacttcaaattattcataagtagcagcacagcagacacaccagataaactctgctccacctgggcacacagagcttcctcagcggggttttttcagtggttgcattgaacagatgcacctccatttagttaatcagtatccttttgctgggctccttggtggcttccaatcttttgctatggcaagcaacgtggcaaggaattgccttctacttgtgccatttgtcacctgtgccaatattaaaagccacaaattctagaagcgaattgctcagcgaggcaggggaaagcacaggctttggaatcacgcagacccaagttcaaatcccagtctgcctgtttcagtgctgctgtattgagctgtatttatctgtaactttttgtttgtttgtttgttttttgagacggagtctcactctgttgcccaggctggaatgcagtggcgcgatctcggctcactgcaacctctgcctcccgggttcaagcaatcctcctgcctcagcctcccgagtagccgggattacaggcacctgccacaatatctgacttattttttatttttattatttttttcgtagagatggttttctccatgttggccaggctggtcttgaactcctaacctcaaaagacccgcccaccttggcctcccaaagtgctgggattacaggtgtgagtcactgcacccagcctatctgtgacatattggtaatataagttcaggagagggagagagaaagaggcagggattgagacagagcaggagaggaggagagaaaatttatatggctcaggcagtctgatcccttctgttcccccacagggagacccacagcagagacatgactcacaggtggcatcaggtccctttgagtctctctggtgggagaatctcaacccacagagtaggattccagtgttcacatgcatttttggtactatgaggcctctgaatgtcaaccctgtcacctgagactctgttgaaaaaccagccgcggccgggcgcggtggctcacgccagtaatcccagcactttgggaggccgaggcaggcagatcacaagatcaggagatcgagaccatcctggctaacacggtgaaaccccgtctctactaaaaatacaaaaaaattagccgggcgtggtggcgggtgcctgtaggcccagctacttgggaggctgaggcaggagaacggcatgaacccaggaggtggaacttgcagtgagccgagatcgcgccactgcactcgagcctgggtgacagagtgagactccatctcaaaaaaaaaaaaaaaaaagaaaaagaaaagaaaaaccagcctcctgttctggtgctgcagggaaacaggcctggccacagccaagggtgcagattttcaggaagcatttttaaaaatatatatatatatatatacacatatatatatatacagagagagagaagccactgaggcccacagaatttgcatcattttattccttgtccaaggtcacaggacaagcagagtcccacccacctgaaaggattcagttctaagacagcctttagggcaaaaagtcacaaagttgatctatctatctatctatctatctatctatctatctatctatctatctacgtgtttgcaccctaatcactggcagtaaatgcactttttttcttttcttttcttttttttgagacagggtcttgttctgtcacccaggctggagtaggtgtaaaattggagaatccatatttctttccttgttttcagatttaatgctttcctttttccagcaggtctccttcgtccatccatccatcatccatctacccacccacccaccaatccatccatccattcatccaaccatccatccatccatcatccatccacccacccacccaccaatccatccatccattcatccaaccatccatccatccatcatccatccacccacccacccaccaatccatccatccattcatccaaccatccatccatccatcatccatctacccacccacccaccaatccatccatccattcatccaaccatccatccatccatcatccatccacccacccacccaccaatccatccatccattcatccaaccatccatccatccatcatccatccacccatctatctgtccatccactctaccctaccatccatccaccagtccatccatctatccaccaattcatccatccatccacccattcgcccatccatccatccacccacccatccatccatccgtccatccacccattcatccattcatccattcacccatccatccatccacatatcttcatctgtgttgtgtgtctgtgtatccatgtttctaaacctttatctgttccagtgtctgtatccataggcctgtgtccacgtttgtcatgtgtgtgcgtctacaagtctctgtcctcatgaccatgtgtctgtgtccctgtgtcctggcataaatgaccatacctcaccgtccctgagtctatgtgtaggcccctgggctccataactgctttcatgcacagtccccaccctcagggttgacaaggttccagcacccaggaccgcagccccacctatggggagagacagcccttgctgagcagatcccgtccttgccctctcccagggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagc

SEQ ID NO: 139957 - DNA, 687 bp, Homo sapiens
atcctgcaccctgaggaatgcatgtatgctgtgggccaggtacacttgaccagggaagccacatggtgacatatgccttccctttgttctcaaccaagaagcttgtctcacaaccttctgcatctgcttccccagaatagcattctcagggaggggcagaccttgggatgctaccggtccaaaaggcgctggggagcaagtagatagaggtggtcccatgctttgcgccattggttggggaaagatcaggcctgatgtcctaggatgtttttccatcagggggccttgggcgtggaagtgcgagccaaggaccaggacatcttggatctggtgggtgtgctgcacgatcccgagactctgcttcgctgcatcgctgaaagggccttcctgaggcacctggtagggcctgtgctccacctgtggagggctggggacttggagagctgggaaaggtggcagggaagatttcttacatgaatgctctgtatacagtgctaactcattcttgttgaatgttgtgtatggataggaccaggtctgggcccacagttgccttttcagtgatgtcctcaggtctgtggtcacagggtggtgttaagagcccttgcagctcacaagaacttcttgttacaggaaggaggctgcagtgtgccagtagccgtgcatacagctatgaaggatgggcaa

SEQ ID NO: 139958 - DNA, 1460 bp, Homo sapiens
cgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccaggtgagcccgccccgctctctccctggtaaagtggggcccaaaaagcgcgcgctccaaggttccttgcggttcccaagctccaagatttcgtagtcctcttctcgtcccccttggcctagatttgggggaagggtcgactgcgtgcagggcgcccggtaatgaatgtggaggatgaggtgggaggagggacggcagccctgcttctcttctgcccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 139959 - DNA, 1418 bp, Homo sapiens
acacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacccatccccttgagcccattgttgtttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcaaggttcccaactcagctctaacaccaaccagcagagcgacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaag

SEQ ID NO: 139960 - DNA, 1648 bp, Homo sapiens; identical to SEQ ID NO: 139884

SEQ ID NO: 139961 - DNA, 365 bp, Homo sapiens
gggaaattgagggctttcgccttagcgcccactgctcctgtgacagcagggataacacactgcaagtggacatcaacggtgaggcctgcttccccggccatgcccagttgtgacgtgtgtgcgtgtgtgtgttcccatctgccccacgccccacttatctatccctctgagagtgtgtgtgtatgtcccctatcccctgactcccacaccaaagcagggttcactaccggccgccgaggtgacctggccaccattcatggcatgaaccggcctttcctgcttctcatggccaccccgctggagagggcccagcatctgcaaagctcccggcaccgccgagccctggacaccaactattgcttcag

SEQ ID NO: 139962 - DNA, 10480 bp, Homo sapiens
ggagctggcgctgggaggggaggagcgcgcagcccgcgcgccgcagggccgggcggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcagtgagtgtgcgcgcgtcagccgggccgggccgggatcgggcagaggcgcgcggggcctccgcgggcgcccggagtgcggccaagttgggcagaggcggggcctcaccggcgctccggtcccggcgtggccctttcccggccctgcggggcagggggtcggccggggtcaagttgtgcacctactcgccggccgctcgatgccgctgcgaggaggggcagcgctgaggaaggagcccgagctcggggtcctcaggtgcagccggcatggggtggggtgcaggttgggagaagaggcccccgccacccgcggcacctcccgccctgctgtcctggccagctagggggaggcaggcgctcgtcgtcggtgcctaggggaggaggagagggcgcaggggcttgggaagacgcccccgtcccgcacccctgcgccccagccagcagctgcggcggtcaggagcccactggcccgttctcccgccccctgcccgacccaccgggccaacttttgactccgggtgcccagacacccatccaggtgtgagcccggggtcgcaggtacgtacttgaaattgggaacgaggccccgcctggggtgcctcgggagagccccacatcaggcgatctagacccttacgtcccttcctctagccgggtccaggtggcaagcctggcgtcccgactatttttgaaacctgttttctctcgcacctttcccctcgggcttccagagtcccttgggtgcccaggcaaacgacagactcgccgccacctctccctggggcgtctgggaggctgggaggggcctccccccctttctctcccccagtctctgattacgctcagggaacttgtcacctggcaccttcccctgaagccagaagacccagcctagcgcaggtctcgttgtttgggagggagaagagagtggcttgcctggggtcacacacaccttcctgctggttttggagccagagcccaggactgctgcacactcccacctccctgccacctacttcgggccacagcttctcccctcatcaggaaacaactgacagtacagcaccccctcatcccatcccctcttggccttacagggctctgccaggggagcccgagctccctggtccaaggagtgccagcgtgtctgggcctagagggcccgcctccctcctcctctggccccactctgttgttcagctgtggccgcctcccagctgagactggcattggcattgggaatgtggggtggtgcctgctggtggggggtggggtcagagacccattagggctgggccactaggccaggggatgtaccgtttatcacactgattgcatcccaaaatagaccctttaaaaactggcaagatttgaccaggacttctgagatggccatctgttccagtgggagaatcctgcgggttttctccaggaatgagggagggagggtggtggggcagcccccagggaagtggttttgaaggaaggggggctggcaagggaagggaggctagaaagaaatatctctgaatctggggacgtggaagaggtagccgctttggatgtggaagagaatttctcttgccatcttcaatcttgagcaagtcacttgtcctttctgatcctcggtttcctcatctgcaacatggggataaaaactcttacctggcaggagtatcaaggagattattggtaataatgctccctcctaactggtggctttcttctcccctgctcctcttccccctgcctatccttgggacgctgccagcatgattagtactgtggtgagatgggttttgggggccccgagcctgtctgcacctttggaggaaaggagaggagcacctctccccctcctccaggccctggtaagcccaaagtgctgtcctggagcctctggatctgaaggagggcaggccgagccccacctgtccctcgtgatgaagtctcaatttcctcacctgtaaattgcaaataacagtagtacctgcctccagctgtttgtggggatcaagtggaattgcgtttgcctggcatagaggaggagtttggtaaatggtaactgctgcttttgtaactgttttacaacctgtttttgcttccattctctcattgactcctgtgaggtgacagagcagacccattttagagacaaaggaactgagactctgagcattggagtcattggctccagacacagagcatctaagaggcagagctccacattcctagcgcaggggtcttaccagtgtgcttggtgaactctgccatgggaggagctgggagcaggccccacctaccccacgctgggctggcagcctctgacagcagtggccacaggttagagcaggggccatggggtatgtgggggtgggggtgctagggtcaccttgctcagggttgtgacccagcctggccttggacctggtccctgtggttgagttttgaggccaaactgaagccagtggagttaaagttagactcgaaccctgctctcagttgtgacctgctcctcctcctcaaggtcctcactaggattagcatgagcattgcttatttgtggagaaagaagcccagagaagggcagcaccttgcctgaggtcacacagcaaagccagcaccccaggcttctttccacccagcttcatgcctgcagtggattcctggttgtcctgaccttgaaagagggctctcttcctctcccacacatggcttttcctatcccctggggagacatcaatattttatctcagtccctggccaggcattttccttccagctgcctggaagaggggctcaccttggcccctcagcactctttccagaggtactgggatcattcaggccctccggttattttgtgggttgtgcttacccagagagaaggggtgaagaaataggaggtgcaggttccagtaaagctagttcatggtggaaggcaagggagggaggatataatcatatttataatatttataataaaggatattgcaaatgaatgtggcccaacacaaattcataaactttcttatgggtttttttgtgatttttttttaagctcatcagctatcattagtattagtatattttatgtgtggcccaagacaattcttccagtgtggcccagggaagccaaaagattggacatctgtggcttacagtctggtgcaccacaacaagggtgtagatcagtggtgtggttgtggacattggtagcaggacaaataaaaataaagcagggtgaggaaatgatgggacagctttgtaagataggatggtgtcttcatttgggttcctctagagacaaggattggagtgcaagtcatttatttgggacaagatggcaggaaatattgttaggacaagtgagaagggaggggagtccacaaagtgggcattataaagcaaattaccagcagggcgcggtggctcatgcctgtaatcccagcactttgggagaccaaggtgggcagatcacctgaggtcaagagttcgagaccagcctggccaacatgatgaaaccccatctctacttaaaatataaaaattagctgggtggggtggtgcaggcctgtaatcccagctacttgggaggctgaggcaggagaatcgcttgaacttgggaggcagaggttgcagtgagccgggatcacgccactgcactccagcctgggggacacagtgagactttgtctcaaataataaataaataaataaataaataaataaataaataaataaagcaaattaccaccagggactcctggagcttaaccccgctgtgggaactgtgggaggcagtgtagaacgtgctcttcagagccgttccactggaggggcagttcccggaagcccggtggagaggactcctggggtcgggagatcttcattccccagtctgcgccagcctcagcatctccagcaggcagagtggcaggtactggcagtcagcacaacatggaaatggtgtgcagggaggataagggcggccactgacagcaccagggaaggtccctctgagaaggtgactcggtacacaccggtgaatcccaggagggaggagtctgggaacagtgttccagctagagggaacagcaagtgcagggaatgttgaactggaggctaggactctgcttctcccgggtctgggggctgtgtgaggggcatgtggcttgaaggagtcagaggtcacccactgcccactgagggtcagatactctttttgagcagccctgcagggctctgcctgaccccagcaaggggcttgggctgcaggaggcaggtatggactgaagtcccagtgctgtcaattatgagccatggtcaaactcctctgagcttctttatctgtgaaatgggaacactgatctatcctggactcttctctcaatatgagaatggtcatggacacgttaaatctctttgcatttgaccactgtaatgacagtagctcacacttgtgatacttggtatgtaccagacaagcttctaagctcacctcgggtgtgaactcagttcatcctcaagacaaccccatggatggatactcttttttttttttttttttttttttttttttaagagggagtctccttctgttgcccaggctggagtgcagcagtgggatcttggctcagtgcaacctccacctccttggtttaagtgattctcctgcctcagcctcccaagtagctgggattacaggcgcctgccaccacacacagctaatttttttgtatttttagtagagacagtgtttcaccatgttggccaggctgttctgaactcctgacctcaagtgatccacctgctttggccacccagagtgctgggattacagacatgagctaccacgcctggctgaggtggatactcctattgtccctgttatttatttatttatttgagacaaggtctcactctattgcccaggctggaatgcagtgatatgatcatagcttactgcagcctcgacctcctgggctcaagggatcctcctgggtagctagaactacaggtgcacactgccacgcccagctaattattttttgtagagacgaggtcttaccatgttgtccaggctggtcttgaactcctggcctcaagcaatccttccttctcagcctcctagcacactggaattacaggcatgagccactgtgcctgtcttgtccctgttttaaagttaggacactgagatccagggaggttcagtgactatgaactccacagcccatagcatatttttctcttactgtgtaagtaggtacttaggaaatggtagctgctgcaatttgtcattttaaaaattattttcttttgataacaatctcaacagctttgacttctgaaattttcctagtacttttcacgtccagaaacttctggtgacgctcctgaggggatgaacccatttgtcagatagaattacagcccagagaagcagctacactccaggtcagggcagagcttgagccctcttctgagatgttgtcactctggcctctgaggccatctccccaccaggctgggggaggctggaggccagagccccggttggaggctcccctggcccctgggtttggctgcagctctgatgttgcagacacaccagccaggcagggtctctgggagcagcagaacgggcacaagggcattcagcccagctctgactcccgggtggttgggggaccttaacaaggaaagaacacgtgttcacagctgtaatttagaccttagaccaggcatatggtctgtccccagctaactccagcagcaggtcatctgtaaaattgcaacgttaaaatagcgcagtcattacccactacagggccaaaaataactaggaccggaacagggctgtgcactcaggcctgtatttgcccaggggcctctgggagcacctcctgaagccgtgggctcctcccggcaataaggcctccggctgtggctggcgagtagggcgggtggcgggtgtggccctgagccctaccaatgggccttcactgagagctcccaggtgctggtttctgtggggagggtgtgggcatgaggggccttacgctctagtgaagacatgagtcatgtgcacagaccacaggagggaagcagcttcctagagagaaaggagcatctcagtggggcctgggaacatggggtacaagggagaaacaggaccagactggacggccacattgggcaggcgcacgcttccatgccaggtcctggggaagcagacatgaatggcaggtactttaaagggaagagacgtgtaggcagtgcttggcagtgggtggtgtggctgcaggaggaagaagagatttacagtcaagaaaggcaccaacagcccgcccacaggagggatgaggccccactggaaggtgtactgagcaactgcgatgggcctgcctctctgctaaattctataaacttatccaagggtcacaacagcccccaggagtcagagctgttgtttcccccattttaaagatgaaaaactgaggttcagggagggtaatgagctcactcaagatgactcagacatgaagcattggagctgatatcttaggattaaggccttgctgttaaccacgaggctatattgcctcaaaggaggcttcctggaagaggttggatgtgtggggtttgatcaagtgaagaaagggcatttaggatagagggaactacttgagcaaaggcaaagaagttagacagtaaatattacattattaggaagaagctctgcatggttggagcttcttggggtagggggtatgtagggatattgtgggagaagagacggggaaacttaaaattccctcacagtcactggtcattgtggggattgtctatagtggactgggtggggtgaggagagtccctctgacttgccatgttaccttgcacaggtcccatccctgtctgggcttcagttgtatcatcaagtgaggggcttgagctgagggcctaaggctgatgagtggcaaccagtctgtaaggacgtggttagaggaggggaagggtcaggccagggaaggaggaatgcagaaaaatgctgaacatttcaggggtcagggaggactagggaatgttttgacagcagagagatcaccagtgaccttggcaggctttggttctttggaatggagggagcggaagtgactttggaaaggggccaggaaagggctgaaccagaggaaatgggagaatggggacatgaaaatgggggctggagagggagagtggagaatgtttgccaggggtagggatggataatgagatgttcaaaccttgatcaattagtattgcttgcctggggccttgtgctgagaaaggatcagagggaagtagagctgcaattgattatcaatgtctgccaagggtgcgggtcataggcacagtagcacttctttccattgctgtccttgcttagatgggtctcaggttgaaattggtggcctgggtatcctagcctgcagaggggaagccttaggtattaggaatacctaattccaggtgagaagaaatgcctccgcctccaaaaacctgatcttttgctagaattaaggtagtttgctgcatgataaagtagtatggtctcatggtcaggagcttgggctttagagtcagtcctttgagtctcagtttcctctctgtaaaatgggaatgagagaatgcctgcttgcaaggtggctgtgagtgttagaggtgatggtaatagctatggctttattattgttgcatctttgttatatgaaagcgctgtttttccctgatgatggtgctgttattctgaacttgagagcagggtctgtgtctgagttgctccagggccccatcactcaacccaggactggggacatctcagggactttcacattcttttggaggatcaaatggaataggcttgtggttgatgggacagaggataaggtcatgttgggctttggggtcatctcagtggagacctggcctcatgttggggtggaggcccagggatgagatctagggctggagggtcactgggcctggggccagggctggggatgggatggggttgtcctcgtcatttcttccttgagcgagtattgagcgctacctgcatgccaggttctagatgacagtcagtaagtccctgctcacctgatctcaagacatgaggggaactgggtacatctgtaagttcctgtataaccctccccagccctgacacccgcaccctctttcagatgaagaaatggcctcagagagggacagtggcttgctcaaggcaaatccagagaaatgtgggtgtacaaggctccttctggctgtggagagggggaccagagcccctggaggcccagggctctaggataggagctgagaggggcagcagggatccagactgggtaggggacctggtgatgccacctggacccagacttctgctcttgacagagccggaactccagaaccaagctgagccttgtagtaggggcccacatccctgccagagcctcagctgccctggaactagcaatacccaaactttcttcctgtggcttttcaatcagagccagtgaggaaggcctcaggaggaggtagggagggcccaggacatctcccagcccctccctgggggatggtctagggaagctggccctggctacctctcgtggcccctggaagctgattcctggctggatcctgctctgtcctcaacaagattgtgtgtgaggctgaagagcagttttctttctcatctgtaaaatggtgcagtcataacaaacacctcctacaagcacagcatctgtgagggtttcctctctgtaaaatgggacagagaggtaggggacaggaaggggctctggcaggtggaagtgtgaggtgttcattcatctttcttcatgtcctccttccgaggagccggggatggtcagaaactgtcagtgcagcctgcttttgccctcatgcccatttgcctccacggggccctcacctacgtggtggggcgctctttccacgtgtccctcctggtccatttgcccacccagtgaggcaggctcatccccttatttcctgacatttgtgtggttggtgcttttagagaactctccttgtggactctgttctgcaccattgtcacagcccagagaggggggaatgttagtcccaaagaggagaggggacttccctaggaccatccagggggtgggaagcagagtgggtctcgaaccttctccgatttgggaaatcgccttctcctctccccacccacccttacccttccctgctctccctgggctactgtctcctgcccagcctcccacatgcccctgttggtctctacggatgcgcacagggaggaaagcagtgcaggctggggccatgggaaccgctcagggttgaagtccgactcattgtatgtggccttcatctcatgactttgcctccctgagcctcagtctcctaatctgtagaatcattgtctcacaggattgcactaaggattcagtaagaaatggtatgatttgccctcagcaagtggtagcattgaagtaaagagggctcagggcttgaaaatagggctcgaaacttggctcttgcacttcctggctctctggacttggttatgtgattgagcctccatggcctccgtgtctttgtctgtcaatgggtttgattaaagcgttgacctcataggttcttaggaggattaatgagaacattttatgtaaagctgcttacatggagccttggtatgtgccggaaagctttagccctttattaaaagtgacagcagacccagcacggtggctcatgcctgtaatcccagcactttgggaggctgaggcgggcagatcacttggggtcaggagttcgagaccagctactcgggaggcagaggcaggagaatcgcttgaacctggggtgcagaggttgcagtaagctgagctcgcaccactgcactccagcctgagtgacagagtgaaactcagtctcaaaaaaaaaaaaaaaaaaagagtggcagtagtggtgggggagacccccatcccccttgctggggtttcctaggaaagaaggctggtgagagctgttgctggtggtgggccctgagccgcagggtctgagggcctaccctgtgctaccccagagctgcctgagaactggacagacacgcgggagacgctgctggaggggatgctgttcagcctcaagtacctgggcatgacgctagtggagcagcccaagggtgaggagctgtcggccgccgccatcaagaggatcgtggctaca

SEQ ID NO: 139963 - DNA, 668 bp, Homo sapiens
tggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagcggagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatg

SEQ ID NO: 139964 - DNA, 365 bp, Homo sapiens
gtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctcgtgccctgagtgccatcactgcagtgtctgtagctgtggtgaatctgcagtaccaaggagcccatctgcctgtccag

SEQ ID NO: 139965 - DNA, 360 bp, Homo sapiens; identical to SEQ ID NO: 139908

SEQ ID NO: 139966 - DNA, 398 bp, Homo sapiens
gcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccg

SEQ ID NO: 139967 - DNA, 782 bp, Homo sapiens
gctcatgcaagcggtcctggaccacaccattccctacctgcacgtgagggaagcctttggccagaagatcggccacttccaggtgagccgagtgcttttgctgacatgtactcttcaactgggctaaagttttctttgaaaagagaggaagtgaggtgggcaccgtggatggttactgtctcctctagcaaattgagcttgactgcttggaatgcagtcttcctcagcatgcagcctgactctggaagtcatcaggaagttcaccacattgccacctcgattcctgtgtgaggtggatgaactagacattgtaaggttggagagcaaagcgtgcaagttgtgggggcagaagggaaagaggttgctatttgtagttagaccttctggtccgaagaagctgctggaaggtaataagcattggagtaaatggtgccttgggagccatgcctttcggaggcagtgatggccacttcggggtgtcatgcgggctgtggaacagccactctgtggccctaactcccacacctgcccccatctccatcatcctgagtaaatcccatctcctctccatgcccctgcttcctcatccttggctgtcttgttgccattgctgacctgcttttggtaactgagagagtgttccagcatgttgacctgtgacatccctttgtgcccagttgatgcaggggaagatggctgacatgtacacccgcctcatggcgtgtcggcagtatgtctacaatgtcgccaaggcctgcgatgagggccattgcactgctaag

SEQ ID NO: 139968 - DNA, 435 bp, Homo sapiens
gccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgg

SEQ ID NO: 139969 - DNA, 680 bp, Homo sapiens
ctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaagggtatgtggagagggggcctcaccttcctgaggttgtcagagcttttcatcttttcatgcatcttgaaggaaacagctggaagtctgaggtcttgtgggagcagggaagagggaaggaatttgcttcctgagatcatttggtccttggggatggtggaaatagggacctattcctttggttgcagttaacaaggctggggatttttccagagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaag

SEQ ID NO: 139970 - DNA, 408 bp, Homo sapiens
ggggccttgggcgtggaagtgcgagccaaggaccaggacatcttggatctggtgggtgtgctgcacgatcccgagactctgcttcgctgcatcgctgaaagggccttcctgaggcacctggtagggcctgtgctccacctgtggagggctggggacttggagagctgggaaaggtggcagggaagatttcttacatgaatgctctgtatacagtgctaactcattcttgttgaatgttgtgtatggataggaccaggtctgggcccacagttgccttttcagtgatgtcctcaggtctgtggtcacagggtggtgttaagagcccttgcagctcacaagaacttcttgttacaggaaggaggctgcagtgtgccagtagccgtgcatacagctatgaaggatgggcaa

SEQ ID NO: 139971 - DNA, 3029 bp, Homo sapiens
gtcttcacctcagacactgaggcctccagtgagtccgggcttcacacgccggcatctcaggccaccaccctccacgtccccagccaggaccctgccagcatccagcacctgcagccggcccaccggctcagcgccagccccacaggtgagaggccctggctccaccccctcccttactgtccctgcccccttccatgttggtcccaccccttctgttgctgtccgtcactgtggggctgtgcatgcagcaggcctagggctgctgtgaggaagcactggcaggcgtggaggggtggggtgggcttccatgaagcccaagaggcacaggcgaccccaggaagatggggcccaccttacaagaacatctcagggactggactgaggaaaatgatgaagtaattgttagaggcagtggagagtaacgataaggaccaggtctgtgagccagaagcgactcttgcatgtgtttggtttggcttggctcagggttgaacattctttgaatttgttgccaacatttcaaaatcaggaattttcacatagaaatccagatttctggcatcttttggaaaattggaaaaattcatattcccatataacagtgcaccaggcctcactgcatccactcacatcggctccaatgacccctggcggtggggcggtcacctgagtttgtaatctatgatgccattgtcaggagtgggcactttggagtcaggtgggtgggctttgcagcctgcctttttgcaagctgccccctttctataaggttcctggacccggccctggcagctgtcatgacagccactgaggccattctgtgtcctggcattcaccccatgaggcgtgtccatgaccacccccattttacagatgagaaagtggacactcaaggaggggagggacttgcctcatctcccacagctaccagatggcagggccaggactcgaacccaggtcccacctcaaagcccattctcttaaccattgccatcagtcagggttctccaggaacacagaaccaacagatttatttgaaggacttggcccgtgtctgcggggggctggcaggcctgaaatctgttgctggcagctctggggagtgaattctgcagccttgaggcagaattccttctctgggaaaccggtttttgctcttacggccttccactgatgtaggaggcccacccatattttcagggtaatctccttcactcaaagccaactgattgtggcattaaccacatctacaaagcacctgcattcacagcagcgcctagattagtgtttgactcagcctagccaagccaacacgtacaactacctacctcggcatctcaccggggcttctccagtgttcacactaagatgtactcaggccactccatgggcggccgtggaccctggctgggaggctccctttgaagaaccgagggtagaggtgtgactttggggttcctgttatctgctgtgatccaggaggtgtggccctgcctccccatcctgagtacccctagggacaggcaggtggggtgggtgtgggtgcctggtgggtggctagcagccttgtttgcctctgcagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaa

SEQ ID NO: 139972 - DNA, 1107 bp, Homo sapiens
ctcttcgactacatctctgagtgcatctccgacttcctggacaagcatcagatgaaacacaagaagctgcccctgggcttcaccttctcctttcctgtgaggcacgaagacatcgataaggtgggccgggtggaggggcagaaggcagatgaggggaggcacaggcaccccagaggaactctgccttcaaatgtagcccccataccatgtgctcagaagggagatctggattcaaattgtggccatgtcacctgccacctctaatgctgtggaaaagaagcatcacattagctaattctggctgtgcgccttgtgaggcaccagctatgatcaccccactccagtggaaagagcagctggcagtagggtggggctcaaactcaggcagccgggctctgggtcacctgcaggccacggtcatgtcacactgcctctagctgagtcagaaatgtgaaggaactgagattctacccttcctgcaagctagcaaagtggcctgccagttacatctgtgcatgcacacacacacacagttatatatgcacacacataaaacacgagacctttgggtcagggagaaagccagatcctcactcacggcagaagcagcagccaaagcaacatctcatgtggttttccaagccccagtccctacagagacagagagggccaggtggcacctgtgcatgcagcggggtaccttgcaggagggaaatcctgattttacacaaagctgctccccccacgccctgccttgactctgggatgacgtctcagagctgtgcagtacaacattcttaaattggctgggactcagccctgcagaaatatgatatcttcaaggagaatcgttcccaaaacctctcaaagctatggggctgctctgagcctgtttcctcagctgtaaagtagggtgcatacttttatggccctgtgcaggaggtagtgacaggccctagcaccctgcctccagtatatgttagcagccacgaggcctatctctccccacagggcatccttctcaactggaccaagggcttcaaggcctcaggagcagaagggaacaatgtcgtggggcttctgcgagacgctatcaaacggagaggg

SEQ ID NO: 139973 - DNA, 745 bp, Homo sapiens
cccgcccctctctccgtaactcagccatcagcaggggcagacggcaggtggcctggttgctgcagctcccaggatcagctctgccctccccgcaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacaggttcttgttgggggagcttgtggtggagagggtgtggacgcttccccaacccttcccaagctgggatccccacccctgcagtggaacagatgatgctggtttctgtccacatggatgggtcgagtgagtcacattgggaacgtgactccagggtggaagatgaacccagcctctggcctctggccccagctctgacatggcctgtgtcctccaaccccggccagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagg

SEQ ID NO: 139974 - DNA, 2667 bp, Homo sapiens
gtgctgggagagatatgccttcgaggatatttggatgcattcaggttcttggaagagaagggtatgtatgggctgggaggatcagccatgcccttttgacaagcatttactagcggtcttggtaaagacttgagatttgccttagttctaacacttagtgcccaacgccttccttgtgttgctcaacctactcatgagcccaggagataggaaatctccgtcccattgtacagatggggaaacagaattttggaaaggagagccaagcagcacacacccctccctgaggggcagagccgagatttgaactgggatgtcatgactccagggccctctccctccccagggtccccttatctgaaggcggtttttctttccagctcgacctcttgtgacccttagtttaacaagggccgaagttaaagagtttctgcgcctggaccccaaatgaagcaatcagatttctcatctccagtcaggtgtgggtccaagcccactagacaagtttgctcttcccagagcacatttctgccttcaagtcatcctggcttgtcagggctgggggagttctgctgtagaaatattagagtggaaggaaaaagatgtgttgggagctatttttctttaatactaaaagttggttgatgaatttgtcgttggccaagaccaaggagactgcatttttaaggacatatgtgtatttatctgctcagaaaatgttcattgctgtgtgctagggatactgcagtgaacacagaggtgtgacccttgccagccttgtgagagaagtgagcagataagtaagcagaagggtgatgctgtgtcgatgggaaagtacaggtgccaatgagaaggcacaggtgtcaaggagaagacacaggatgctggaggctcatgcaggatggatctccaaggcccaggggaagaagggcctctcggaggacgtgaatccacattaagactttggggataagtaggagcgccttaggcatggggacccatggatgcgaggcctgtaggacacagacaggatggcatgaaggcctgtgcaactggaggggtggggatggggacactaagagatggctggaagtgtgggggtggggacactaagagatgactggagaagagggggtcaggagtggtgaaaaatgggagaggagggcaggctgggccttttggatacagggggattgcatcctgcagtggtagggagccactgagggctgctgcagtaggagtgaggggatcagaggagagctttggaagccccctggatgcgggacaggaagcgagataccagtgtctaggaggccagtgaggcagccacaggctccaccaggatcagggctgcgagggtcatgaggaggaaaccaatttgaaggagtccaggggaataggacttggaaatgaccgatgggacatttgggaagaggaagacagaagagcgcagtcccggcttctggctttagcagttgggcaaggggagatggggagatgtgcccatgggttgagggttgaggacattaggagggagccggtatggcaggaagagctggtgtgccagagatgctggaagcagcatctgcctgagaacagatacctggcaatattcctaagggaaagtgacatctcggagggtgaggagggcatctgatagggcctggaaagagccggggcaagcatgaatgtgaggttatcttggggggcaaggctcaggcgttgaggagcagcccctggtctcttcagcctgaagttggaagccagagttgggccaggtgcagctgtggttgtctgaagtccccctcccccagcccagtgtgccaatgctgtaagagcaagggccgctcactggtgctggtggctgagtcccagcacccaggacagggcctggcacatactggtgcccaatcctcccttctgggtgcttcttccaaggccttgtgatggaagtgagtaccctcttcgacatcagacccagcttcaaatcctggctctgctatgtattggctgcgtggctttagacaagtcttttaaccttgctgtgcttctgatttctcagctgaaaaatggagatgatgatagtggtttctgtaaggccttatggtgaagcacctagctcagggcctggaaggcaggtgtaaccagtggttcagttgttataaaccaacactaaccctcgcctttgcacctcatgaaaccagatatgtagatggagcccacaaagctagcaggagccaagctcacgtgtgtcctgctttaaagccccatacccctttctccgggtgacaaacacctgtgctcgttctcttcccttcccctcttccccttgcatttggctaataacaggccagctgcctgcctccctgcagtttggtagatgggtgggtaacgaccaccactcccacgttcgcctgatgggcttgttttccgtgcccttcacaggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacag

SEQ ID NO: 139975 - DNA, 2329 bp, Homo sapiens
ggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacggtgagagctgaccagggcaactcacgggctgctggctccacacagcctgaaaccaaggtccagggagcccttggggcagcctagagggggcacctgtagagcagtgcctggcgcacagtaagcaccatggctgttggctgttggctttgctgatctggaccttggatcttagagcctaagacctgccacttcctcagactgccagcatctaccatgggtcccaggcgtggggtagtgtttacctccctatacctgaggtttacgcattctggcccagaagggaactgataattgataccagcttgaacaatttggggaacaccagtcccagaaactcaagcctgtctcagatgacctgacacagcatgaaagctactgccaaggccaggtggcccttcttggttatagaaggcaggcagtaaccagtaagtaaccacatttgtcaactgccaggagccaggcagaagtttcttggaggtcacccactcccaggagacagagccttctctgccctgtgctccaggcctcctgcagagccttgtcttcggaccccagggtaggatattgcaaagcccacctgtcccctcagtacctctctgagtaagacccctagaggacaggggagagcctcttgtgatctctacaggcaggttagctgcttggccagcttttacccagggatgccctaactgccttgcatcttagagggtagcagtacctgagccctccatttgcggctctcctgggtaatggggtctggcaggtctgggtttgactcctttcttaggaaatctcggaactgactgaatccctctccttacgctaactccaggagaagtcgaattcgtatcctactcaattactaatgacaacaatttttgagtgcttactatgtgaggattcttatttaattgatctaataactcagtaagttttaaaaagtattagcctcatttttctgattaaaaaagaaaagtggccaggtgcagtggctcacacctgtaatcccatcactttgggaggccaaggtaggaggattgcttgagtccaggagtttaagaccagcctgagcaacatagtgagacctcatctctacaaaaaaaaaaaaaaaaaaaaaaaaaatttagccaggcttggtggcgtgcacctgtagtcccagctactcagaaggctgaggcgggaggatcactttagcccaggaggtcaaggctgcagtgagccatgattgtgccactgtactccagcctggatgagagtgagaccctgtctcaaaacaaaaaaagaaaaaggctgggcatggtggcacatgcctataatcctagcactttgggaggccaaggcgagtggatcacctgaggtcagcagttcaagaccagcctggccaagatggtgaaactctgtctctactaaaaaaaaaatacaaaaattagccaggcatggtggtgggcgcctataatcccagctactcgggaggctgagacagagaattgcttgaacccgggaggcagaggttgcagtgagccgagatcgtgccactgcactccagcctgggagacagagcgagactctgtctcaaaaaaaaaaaaagaaaagaaaaagaaaagtgaaggagtctgccccaagtcacaaagctagtaaactgctgagctggaactcaagcccaggcctttgtcaccaaagtctgtcttaccccagctagcgtagctcagtcactcagtaagttagagtccttgtgtgctgggcactgtgaacaaaacagacaaaatcactgctcttgcaaagatacaccaaaaaaaaaaaaaaatcacatcttgtggagcttgcgatctggaggggccaccccatcattcctaccttgctgactctagagcttctgggggccttaggctccaaaaggatttggcccatgcacctgtaaagggatggggatgtcagaggtgctggggcctgcctgggctccttgctgactgcccccttccctgtgcagctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcg

SEQ ID NO: 139976 - DNA, 582 bp, Homo sapiens
ggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatcccaccctcattccctaccaaataggggctgtggaaatcagtcagtgtagattattttttcgctccttagtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcag

SEQ ID NO: 139977 - DNA, 1401 bp, Homo sapiens
ctactgcccaacccgaatgaaatttcagacgcatgatcaagcccagtttaatagggaggaaaaaaaaaccttttcttctccatgactggggctaagagctgttctgggacaagcatgtatgtgtgtgtggtgggatgggatgggatggggtgggaggagggggcagcaggggatttttctagctggtgccagagcagccaggcctcttagaggtggggtgagtctggccattgtgcaaccccttccagttcctctgagcagataatagctgaatccagatggtgacagcccgtgtgtcaccgtttccagttgagtctaggatatgagtaactggactgaacaaaaggcctttaaagagaccagccagcttcctagaagagaggagatgctactcatttctaggggtggggtcgggtgtggggggataaacaaacaagtggaaaacccattcgcaggattccatacccttcctgtgagaattgtaactcaaggctgcttacacttgagtcggactgtaggcaggttgcttaaggctgcattgtcccagcctccccctccaagtcatctgttccttctgattaatgacagctctgcatgttctctggcccctgcttccccttggaggctgcagagtcaccacattctgtgccctttctgtgttgagcactttgggtctgcaggaggcacatgcacgtccagggactgcttttcagctcctggacaggccaggggcttccttctatcagccactcaactagtgtggcctgcaaacaggaaagggccacagagggtggggggtttgcttagctctcaggagctgacagaagatgggaacatgtacaggagacagttctttcaaatcatctgtgtgaaagcgggtaaccctttgggtatttgcaagtctagagctttaggtgttactggttttaaaggtgtcaggggcagctggggctgcgtaaggtaaggtggcagaggaaaggagtaggtgaatggaacttactcacatcctaagcccacaggttgagaacttctgttcagctccctcaggggtttgggaggctgcctttgcttttctagccccctaaacgggccccccttctctctacaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagag

SEQ ID NO: 139978 - DNA, 50432 bp, Homo sapiens
ggccatggtcagcgtgaacgcgcccctcggggctccagtggagagttcttacggtaagtggggctgggggaagactggacagggcgggactgcggtcagctttgggaggccatgggacacctccccgtgtgtttcttacgggcccaaagctcctcctggagctcctctggaagggcaggaagccccacggaggcaatgtgaccgcttccctaagctctcaagccggggcatggcctgcttggtgcgagaagtgctgggaggggccgagaagccctggggcagaggcttggctcattttgtctgtccagaggccttcctgggaatgcatctcaggggtctttccaaaaccccacagagggtggggcttggaagcaccgtcctgtttcgatgcggggcaaattgaggtccaccaggagaggcttgctgggcctaggtcacgttgctggtgcattatcaagctgggcgtgggaccgggcagctcggtcgctccgcacctccgttggctctggataatggggaggaggtagaaagcgccgcgcagggtggagcgttggaaaatgagaatatcttgtgcggacgtgtgaaactcagatgcagggctagaaagcatgtgttactgagagtgaaaggctcaggctcactccttagggtgacccccacattggaagcaacccaatgtccctcagcagagggaagacgggtaaataaagcgtgagacgtctttacagtggaatgctatcccattgttcaaggaaacaacgcacatctgtgtgtgacagggaagaacctctcagttaaattaagtgaaaacggtacactgaagaactgtgtagttgctgatagcgaaacggatatagatgtatatatgtacacacgcgtatacgtgtacattccacgcatagaaaattcgtggaatgacacaataaaattggtgacaggtttgtttctgaggagggaaattcaagagaatgttttatcttttggggacacattttggattttttaaaagttgggtgccttttataaacctgttcaaatcacacacccgcacagaacttggtctctggaatccagcagacctcggggtctagttgtgactctgtcacacggctcaacattcacgtgcctcttgctttctttctgaagtggagacaggactaggatgtgtcttaagatcatggtggatgccgtggggaacaaggatgtaaagcccttgataccacgtgcattgcaaagacacaatcaacatttatgtcatcaattgctgaggacagagggccagggaatgacagaatcagggcctgatctcctgactctagtcaggaagaatcttctttgctttgacccccatcaaacaggaatatgtgatgcactggaaatggcagaggctgaagaaaccaacagcctgggaacccatcccacacaccagctgtgtgaccttgggcaagacatttcccctctctgaacctatttcctcatctgtaaaatgaagataacaacaggacctatctcccagagagcggggagattagaggagatagcatagaggagattaagggtgaggccacccttaatccacaattttaagacctggagtatagatgccaatggatgacttggttgaacctgtggctaggggaagacattgtctctcaaaggggccagacagcttctggggaaggacagcccaggtcataaggctaagctaggggtgaacagaaggccccacagtgtctcttaaaggatgatacaataatataacctgacagcctttcactgtctcccacgtctctgcaccttgtaggatgtcctcatgtctcttcatctctgctcctgtgtcatactcattatatagcaaacattcagcaattattagaatggttgcttctatcgacaggtaggtgggtgaatggatggatgaatgggttagtgaatgttctactattatctctcagacagctgtttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtgaccttgcagtacatccacaaaaaatgagcacttttgtcctggggcagtggaacattcactgcagtgtatgtgtgcctatgtgtatgtgtgtgagagtggctgaaagaccctgatttgatatttttgataaaatacacctgggttagcatcctagatctaccttatttaaaaaaaaaaaacaaaacaaaaaactgtgtggtcttgtgagtcaaatcattacccctctctgagcttcacatgttttatctgtaaaatgagctactgaagtctgctggaaggctccagaaaaaaaaaaaaaagaaaagaaaaatttgctttctgagaaaagaaacaagtgctccgaggaaacaaaacccctctcccaggctgggtgcagtggctcacgcctgtaatcccagcactttgggaggctgaggcgggcagataacttgagattaggagttcgagaccagcctggccaacatggcaaaaccccgtctctactaaaaatacaaaaactagccgggtatgatggcacacgcctgtaattccagctacttgggaggctgaggcatgagactcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcagggacatggcacatagcagagcctcagttagaggcagaggaagacatggctgttgtgaggatcaaatggaaggatccatgagtgcttagaacagtcctgggtccagagcaagcacgcaagaaatcctcgttgtggtttcatgtttttgagctttagcaggattctaaagagctgctctttggtgtggtgatgctgggtggacttggccctccctggacttccggtgcttccacggcacactggttttggctttgcggttctcgtcatcgctctgatcagatagttgctggtgtgaattgtggtgtctggctgccccaccagactataaactccgtgagttctgggacctgggtagtttgttcagccttgtttgtctcactatgtctcacatggtgactggcacagaagaaatgctcaataagcatttgttggatgagtgaaatgatgggcttaaaacagcgctacaatgatgatcatcaatgtcagccagatcccactctcttgccttccttcctctctgccctcctcactgcgttgtctttggtccttgtatttgccccattataacccaaactggctgtcccagcttcagctgtcatgtctgcacttacgtgtctgaagctggaggcaggaggagaagaggttttcctcagtgcccttgtttcttttatccaaaagcaaaacttccccagaaacctcctggcagactcccctagttcaaggaaagctgggaagacaagtatgtagtggaaagagatgggaaagccaagatggacctagaccagtgatttttctcttggggtgtggcacactcctgctccaaacagaactgaggctctggtataaatgagtttctcagcctcagcactgttaactttctggcctggaagattctctgtggtgaggggctgtcctgtgcactgtaggatgttaagcagcatccctggcctttactccccagatgccagtaacatctcttcccatcagttttgccaaagaaaaaatgtctccagaaagccaaatgtaccctggggcacatataaccccactgtgttataggagaacaaggtagttctggggagtgtctaccacaatggagtagagtagactgtgactcttgtgttgttctgctttgagtgccaggatcttgctcagtgccaatctggtactaccctgagtaactctgaggatgagatgctaaacatgcatatctgtgtgctaacctgactcctggccttattacttttctacccttattttccctttaacaagtttcccttggttatttattttgcttctttggtagttgctcatttccgtaagtacctcgaatctccttaaaggaaaggtctgtatctatctcattctttttgttatagtccagccttccacagggcctgatcccatgtagaccttgattgaagattaattaagtggatgaatgaatgggaagatggatggatgaataaatgtatgtttaggtgggtggataggtgaatggactgatgaatgaatgtgatgtgatgaatggatgtgatagatgggtggagggatgcatgaatggaatagagggagaaatagctggatggatgagacaaatgaatgagtaactggggagatggctgggtggatagatgggtggatggattaataaaaagatgttatgggtggatggttgggtgtggaggatgatgcatggatgggtaagtagatggatggaaagatatgtaggtgcatgtgataaatggatgaataagtagctggatagatgggtaggtggttaggggaaggatggatggacaaatgatgtgatgagtgggttgatgaaaagatggatgaatggatggataagaaggggtgggctgaggtagcctggaatagcagcatcttcaagtgctctaaacaggacaagtgaagagataggggatgtcaacaatcttccatcagggcaatactgtatatctgtttttaagtgccaggtgagcctaatttttcctagctatgtaggcctagtccctttgaccaatagcatcagcttgaggacagatcagaggccattgtcggagacagtttggtgatgtggctctgccccttgaagctctatgatgatggtgctttgcttcacttctctggtcctcagtttcttcacccatcaaatgagccttggttgttgtgaagattccatgagctaatgaaagagaaaaggtaatagaagctataacaaacatgccgtgtccttgtgaagggtggataggcccaaaatcgagtaggaccccagatgctggctggctatgggaccgtgtccaatatcaggctatggctgttcccacccttcattcttaaaatatggcccctctccagcccttcccctatctcccctcccacatcaccttcccatcctacgtcaattcagtcttcagcccctatgattcacaaacctggttgcacataggaaactttttaaaacaattttggggctccactccagacccagtgaatcagtctcctggggtgagttccaagagtctgtaattttttgagctccttgtgtgacttagggtatgcagttcagttgaggtatggaaaccattgccttactttctcccatttagtaaacagaggaactaaatatccagagtgcatcttgcctcaacccagaagcctcccgtattcattaattcattgttcatttgttcatttcttcaacaatcttccactggaggcttatggtatttaagacattttgtaaggcactggggaaacacaggaggataaaactttgcttcacgtggtggctcatgcctgtaatcccagcactttgggaggccaaggtgggtggatcacctgaggtcaggagttagagaccaggtagaggcagaggttgcagtgagccaagatcacgccactgcactctagcctggcgacaggagtcagactatgtctcaaaaccaaaccaaaacaaaacaaaaccaaaaaaaaacaacaaaaaaaacaactttgcttcagatcttaaactgtgctcagtttggcaggaggacagacaagccagcagcaaccaaagacagagtgccatgataaggacagcaaaggcactgtgggatacagagggacttaggagaaggggaaggggtcacagacttcttgaccttggaggagtagactgatatctaagctggaacctcggtttagcaggagtcagccgggagaagagacggtggggaagagtgttcccagctgagggaacagcatatgaaaaggcctggagcctggccacacactgctctgattttacttatatttgactgcaattaattccatcctttactgaaagtatcttgagacttgtctggttgtttcatgattgattaatcttattcctaaaagcatgctgaggctgggcatggtggcttattgtggattacacgcctgtaatcccagcactttgggaggctaaggcgggtggatcacttgaggtcaggagttccagaccagcctagtcaacatggtgaaaccctgtctctactaagcatacaaaaattagctggacgtggtgccaggcgcctgtaatcccagctactcgggaggctgaggcaggagaatcacttgaacgcaggtggtggaggttgcagtgagccgaggttgtaccactgcactccaacctgggcaacagagggaaacttgtcttaaaaaaaaaaaaaaaaaaaaaaagcatgctgagatgcttaagtgaaggaattgtgccttccatttttcctgactcatatgcctgtagcataaggatgggtcaatgataacgaaaggaatttgttttcatttaagccccttttatgtaatgggcaagatgttggctatttgatatgttttctcccttttaagccttgcaataacccatccaagtaggaaatattatctccattttataaacaaagaaattgagattcagagttgttaagtcacgtttccctgcatcgccttgcaaataggtgattaaaatctagtctgacaccaaatcttcattctttcagctattatgtcataatagcatccaaggagtttaccaccttctaccacctactagctgtgtgaccttgagtgaatgactcaattctcttttttttttttttttgagacggagtcttgctctgctgcccaggctggagtgcaatggtatgatcctggctcactgcaacctctgcctcctgggttcaaacaattctcctgcctcagcctcctgagtagctgggattgtagctggggttacaagcgcctgccaccatgcctggctaatttttttttatttttagtagagatggggtttcaccatgttcgccaggctagttttgaactcctgacctcaagtgatctgcccgcctcggcctcccaaagtgctgggattacaggcctgagccactgcgcccggccgacccaatcttttttgcctcagtttcctcatctgtcaaatggggttgatgataataccatttacttcacagggttgttgtgagacataaagtcaatatttgtaaagtgctgagtgtctagcacatagaaagtgctatgtgaatttgaacgattattattattatacctatagtgtgtgcatctactatatgcaaaggactggatgcttactaggtgttagcatcattttggctgttgtagaaacaacagagatgagtaaggaatagataactggtcccaggatgcaactgtctctggctggagactaaggacaaggctttgttgcaagccttctggggccctgggatgcccagggtctcctcttgggggtgctggttcatagatgggggcctgtgtggctccttcacagaggaggaggcagatgagaggcatagaaagggaggggacagacctatcctcatcagagacctgggagatggctctggccctggccctgggtagctgtttgtgacctcactcaagtccttctcctgctgtttctccatctactcttttttttttttttttttttttgagacagagtctcaatgtcacccagtggctctatctctgctcactgtaacctccacctcctgggttcaagcaattctcatgcctcagcctcccaagtagctgggattgcacgtgtgtgccaccacacctgacaaatttttgtagtcttggtagagatgggtttcaccatgttggctaggctggactcctggcctcttgtgatcctcccacctcggcctcccaaagtgctgggattacaggtgtaagccacagcacccagcctccatttcctcttttgagaaatggaggtatgacaaccatctggctcagccattgtcacacagtattccctgggtcctaagagtcaggaaagatgctgcagggttccctttgagggtaatgtgggtagggacgtgttcaaatggactagggcttagcctctccccacccttcaacctctggctccatcagagacacttctttttgacttttgtatatttctttttattttattttagagacaggggtctcgctatgttgcccaggctagcctcaaactcctgggctcaagcaatcctcccgcctcagcctcccagcccctgggattacctgctcatgccactgcacccggcactctgttttgacttttaaatgaaatatttaatggagggtctccacagttcaaaaatatttggaaaatcagaagaccacaccagtgtgtttcaaactgcaatcttaacccaggaataggtcatgcaattttttttttattttttttttctagatggagtcttgctctgtcacccaggctggagtgcagcggcacgatcttggctcactgcaacctccgcctcctgggttcaagcaattctctgcctcagcttcctgagtagctgggattacaggtgcccaccaccgcggccagctactttttgtatttttactagagacggactttcaccatcttggccaggctggtcttgaactcctgacctcgtgatccacctgccccgacctcccaaagtgctggggttacaggtgtgagccaccgtgcccagccggtccttcaatttattgggattatattagttcagacaatatagcttatgtaacaagcaaatgcagactttaagttagaagtttattgacctctgtggcatagtcatccagggacccctaaggtcaccctagcccagaaagacactttcacttctactcacattccattggtgagaactagtcacatggcccttgccaaatgcaagggggtctggaagatgtggtccctagcggggcgggactagctgtaaagtttgtaaaggggagcgtgaattagttggtacacagttgatcgtctgtgcagtagggtcatgctcacacgtccctccacacacacacgttaaatatgtataacaagtgtaaatatacaatttaaaaaagtatcttttttttttggtttgtttttgttttgttgttgtttttgaaacagggtcttgctctgtcatgtgggctacagtgagccacaatcatggttcactgcagcctcaacctcccaagctcaagcaatccttccatctaagcctcccaagtagctgggaccacaggtgcatgccaccatgcccagctaattttttatttttatttttttgtagtgacaggtcttgctgtgttgcacaggctggtttcctactcctgtcctcaatcttcctgcatcagcctcccaaaatgccgggattacaggtgtgagctactgcacctggcctttacaattttttacataaaatgtttcaataaaaaagtgcatagatagatacagagatagcaataaagcaaatgtgacagaatgcaaccagttggtgaatttaggcgaagggatacatcagtgctcactatactagtctttcaaactttaaagtttgaaatttttcaaagtaaaatattggagaaaatgaaattcttaaaatttactagacctataagtagactaaaacaataagttataactaaagtaagatttggccggacgccgtggctcatgcctgtaatcccagcactttgggaggctgaggtgggtgaatcacttgaccccaggagttcaagaccagcctgggcaatatggcaaaaacccacctctacaaaaaacacaaaaattagctgggcctggtggtacacgcctgtagtcccacctactcgggaggctgaggcaagaggattgcttgagcccaagaggtgaaggttgctgtgagccgagattacaacaccacactccagcctgggtgacacagcgtaatcctagtgctttgggaggtcaaggcagaaaaattgccaccacacctggacttaaaaaatatttttactgaagtataacattcaaaacagaaaaaggcacaaatcatcaatgtatcgctttatgaaatttcacattttaacaaaagaatgaaataaaataaaatagaaaatatcatagagcatttcatgtagtaagagtaagatatgtatgtttttgaaacttttgttttatttatgtatatttatggatttgtgcttgatgttgtgataatagcaaaaatttatagagtacttactagggttttacacatattaactcctaattctcaaaatgtccctattggccgggcgcagtggcacacgcctgtaatcctagtactttgggagcccaaggtgggcggatcacttgaggtcaggagttcaagaccagcctggccaacatgctgaaatcccatctctactaaaaattcaaaaattagctgggcatggtggcacgcacctgtaatcccagctactcaggaggctgaggcaggagaatctcttaaacccaggaggtggagattgcagtgagccaagatcacgccactgtactccaacctgggcaacagagcgagatcctgtgtcaaaaagaaaaaaacaaaaaaaacagcatactttgtattaggtgaacccacaaagtacaggggccaattgtaggtagtccacaaacacttttaaatctttgtgcatttattgtatgttagaaaaatttatacatagcatattaaagcattaatataaaatatcttttaaaaattaaggtatatcttcaaaagaaaggaaaacatcaagtaaacaattatagataaataaagtacaggtaaaaggcagatgtggtaacaattgtatgaagaggaatacaagtgtctagggcttgggggccacacactaaacctggcatcagaaggcccagatctgggacccggctcatttgttttctagcactaggttgtttttcatccttgtataacaccatggcccaggtactactctaagcactttataaaaattaactcctggccgggtgcggtggctcacgcctgtaatcccaacacttttggaggccaaggtgagtggatcacctgaggtcaggagttcaagaccagcctgaccaacatggagaaaccccatctctaccaaaaatacaaaattagccaggagtggtggtgcttgcctgtaatcccagctactcgggaggctgaggcaggagaatcacttgaacccaggaggcggaggttgcggtgagccgagatcgcgccattgcactccagcctgggcaacaaaagcgaaactctgtctcaaaaaaaaaaaaaaaaaattaacttcttggccaggcacggtggctaacacctgtaatcccagcactttgagaggccgaggcagacagatcatgaggtcaagagattgagaccatcctggccaacatggtgaaatgccgtctttactaaaattacaaaaattagctgggtgtggcacatggctgtagtcccagctactcaggaggctgagacaggagaatcgcttgaacccaggaggcggaggttgcagtgagccaagatcgcaccactgcactccagcctggtaacagagcaacactccgtctcaaaaaaaaaaaaaaaattaactccttggccagacatggtggcgcacacttaaatcccagcactttgggaggctgaggcaagaggctcacttaaggttaggagttcaagaccagcctgagctacaaagtgagaaaataaataaataaataaattactcctttaatcctcacaaccgtctattgaggtaggtactgtcatcatacccatttctgagaaaacaaagtctcagagagactaaatagcttactcaaaaccacgcagcgcatgagaggcggagctagaattcaacatcaaggattgtattagaaaaggcaataccagcttatcaacccaaaacacgagaggagagtttatctctccttcacgcagttgtccagggtccccaactccttcctccctagatggaagatgggctttttttttttgagacataaatatatatatatatgtgtgtgtgtgtgtgtgtgtgtgtatacatatatgtgtgtgtgtgtgtatatacatatatatatatatatatattttttttttttttttttttttttgagacagggtctcactctgtggcccaggctggagtgcggtggtaccatcttggctcatcacaacctccacctcctgggttcaaacaattctcgtgcctcagcttcctgagtggctgggattacaggtttgcattaccacacccagctaatttttatatttttagtagagatgggattttgccatgttggccaggctggtgtcgaactcatgacctcaagtgatccacctgcctcggcctcccaaagtgctgggattataagtgtgagccaccaggccctgccaggaagatgggttttatttgaaccactgggccctactgggatgggtagaattttctgtatcattctgggatccacatcctcctctgaaaatggggttaataatgctagttctatttacccctcagggtagctctgctgctcaaggggatagaggcaagagtgtcctgcaaactgcaaaaagttccttgaatgtaaaatgttagtatgtattgttaatgatattgaccaaagctacattaccatgttacagtgaagattaattgaaacagtgcatggaaagaccttggttcacatacagacaaagtcagctgtgagtaatagccataatagtaatgtggttatgcaatttaaaatattgatttatctccaaattgggatatagttgtataggatctttcttactagcaagttaacacattacgtctataactaaaaaatcaagaagtcttgatttcttgagaagtcagtataaccatgatgtttagaaatacaaacaagaggctgggcacggtggctcacgcctgtaatcccagcactttgggaggccgaggcgggcagatcacaaggtcaggagttcgagaccagcctggccaacatggtgaaaccctgtctctactaataataccaaaaaaattagctgggcatagtggcgggcacctgtaatccctgctactgtggaggctgaggcaggagaatctcttgaatgtgggaggtggaggtttcagtgagctgagatcacgccattgcattccagcctgggcaacaagagcaaaactccatctcaaaaaaaaaaaaaaaaaaaaaaaaaaaaactgggccggccacagtggctcaaaatgctgtaatcctggcattttgggaggatgagtggggggatcgtttgaacccaggaggtcgaggctgtagtgaacaaacatcatgccactgcactccagcttggatgatagactgagaccctgcctcaaaaaaagagaaaggaaaataaataaataaatgaaaatttaaaaggaaaagaaaatatttaaacgctatttcaaacaatctcaaatgtacctggaaacagttgggacaggaagtcatgaagggaatggggcagagttagagaaggtcagagtacagccatgtttcacatcccagctgaaactcctccaacagctttgtatcgcccttcaaatacaacctgagctctttttctttctttctttcttttgtttttctgagttggagtctcactctgtcatccaggctagagtgcagtggcatgatcttggctcactgcaacctccgcctcccaagaagctgggattacaggcgcgtgtcaccatgcccagcaatttttgtatttttaatagagtcagggttttaccatgttgccaggctggtctcaaactcctgacctcaagcgatttgtccaccttggcctcccgtgagccgccgcgcccggccctgggctcttttctttgaccaaaaggctctcacaggctctgactcttgtctgatggtctctcgtctttctccctttggtcactgcagtcagccacactggacttttgttttttttgtttgtttgtttgttttgcgacggagtctcactctttcacccaggctggagtgcggtggcgcgatctcggctcactgcaagctccgcctcccgggttcacgccattctcccgcctcagcccccccaagtagctgggactacaggcgcccgccactgcgcccggctaattttttgtatttttagtagagacggggtttcaccgtgttagccaggatggtctcgatctcctgaccttgtgacctgcccgcctcggcctcccgaagtgctgggattacaggcgtgagccacaacgcccagccacactggccttttgacaatccttcaatcacgccaagcacactcctgccattgggcctttgtacttgctgttctctctgccaggaatgcctcttccccagatctttgcatagctgatttcttctcattgtcagggccttagttcaaatgtcctccactcagagcagcctcccttgaacacccaaatctaagcctgccccacctccatcccttgatagcaattccattatcctctacagcgctgaaattacgtattccttgatctgtttatcatctgtctccttcacagaagttccatgacagcagggagttaggctgtcttgtcccctgctgtatccccagcatgtagaacagtgcttgacacacagtaggcgccccataagtatttgcggaatgagcaaatacagatggggacagctgagtcagtagggtgagcagctggatgggccagtagtggagggaggaaacggcagcctctgcctgggccttgccctgggtaaacagacctctctctccccagacagccactgtttgacgactgtctgccatgggcctggctgagcctgggccgccaaactgccaacgcctctgtattctctgggacaagcagtggaggcagccatacctccagcagagtttgtgaaggagcaggtcagaaagttgtcaaaacaggcatgacgaagggcagaggaggtggggagacagggagagagcaggcggccctgccctgggcagagccagagaaactggagggaggcctgggtgctcccctgggcagcttcccaggcaaacccagctgcctgcagggctcagcgctgggagcaggttgtggtcccagctctagccctgacacacacaggatctcaggtacttgacatttgtaggccttagcttccttacttgtaagttagaggctatgggcagattagtggctttcaaacaattttttttgttgttgctttttgtttttgagacggagtctcaatcttgtcgccgaggctggaatgcaatggttcgatctgggctcactgcaatctccgcctcccaggttcaagtaattctcctgcctcagcctctggagtagctgggattacaggcgcgtgccactactgcccagctaatttttgtatttttagtagagacggggtttcgccatgttggccaggctggtcttgaacacagcaagattctgtctctacaaaaaatacaaaaattagaggctgggcccggtggctcacacctgtaatcccagcactttgggaggtggaggtgggcagatcacttgaggtcaggaattcgagatcagcttggccaacagtgggaaatcccatctctactaaaaatgcaaaaattagccaggcatgctggagcacgcctgtaatcccagctacttaggaggctggggcaggagaatctcttgaacccaggaggtggagattgccgtgagccaagatcgccactgcactccagcctgggcgacagagcaagaccctgtcaaaaaaataaattaaagaaaatcccaactttcacctcctttaaaaaaagtgaaggtctagcaacactgatacctatgagacaacagtctcctggagccactttagattctcatgcttcctctaatttgccgtagtccccactattccttagtgtccccatacggaaacttattaatgaacataaatcaccatgtttgctgtattgtttttcttagaggaacgtgtgaactttgctcacaccctatctgttccatttatttcagttacttctctgggtattgagggcacttgagtgtgggacccctgatcactgagaccaaagcagagttcatttatttgcacgagcaatcttctatttcatagatttaccatgtttttaagtgactacaagaaaagtttaaattatgtctgtggctcacattctatttctattggccagcactggccgggtccctcagattctatagcagtgtacgtgtgcttgctgctaactcattctgcctccattttccattcttgcgtagaccaatcccagtcaaatctcttgggctggtgtcttctccccaccccacagttatctttggtgcctccaccctggttagctggccacctgtctgtccagaggatccaggctccagaactccaggcatgtcttctagaattctccacatgggaaatctcactcccaggccccatctggcagccattgtgttttctttatcagacattcacataaaacaatagtcaatttgaaagctaaatacacatccattcttctgtctccagcctgtaaatttaccccaaatccagtaatttgggaggtggagttggtgggaagaggtttttttttccccctcttctccagggcaagtcatatagtttttctggagatgaggtggactgagtttgggggaagaacacaggtccatctacagtgaaagcgctgactttgtttttggagaagatggtgtcatggcttctctggggagatgagatgagggaatcctgaagacttagggggccgggaggaaaaggaatcttggcaatgatgaagacaccttcaaatgaaggggctaatagggtagtggctgagaatttgtgctgcagtcgggagggcttgggttagagctacatccacagtatgaccttggacaggtgactttatctctctgatcctcagtctcctcatctgtaaaataaggataagaatagacttgacttccacttcaacgagaagtgaaacgagatatcctaccactgcgctttgcacataaaggctctataaatgtcagctgtcatcataaagagccaaaagtggcatttggagtaaatctgatttgtttttaagagatagggttttgctgtgtcacccgggctggagtgcagtggcatagtcaaaacccactacagcctcaaattcctgggctcaagccatcctctcgcctaagcctcacaagtagctgggactacagacacacaccaccatgcctgtctaacgtttactttttaatttttttaagttttaaaattttctgtagagatggggtcttactgtgttgcccaggctggtctcaaactcctagcctgaaatgatccttccaactcagcctcccaaagcactgggattacaggtgttagccaccacacccagcctagtttaattcttttttaatcatccttctctgcatttttgtaattcctctaccatgaacctgctttagttaagtaagaaacagttaactgggggaggagaaataaaaccaaacccctaaaaagcccctaataaacccctaaacgtggggtccaacatgaggtgttatggctgggaaaaggtaagagatcaaactatacacacccttttttttttaaattaaactttttagttttttcagagacagtcttgctccattgcccaggctagaataatggcatgatctcggctcactgcaacctccgcctcctgggttcaagcaattctcctgcctcagcctcctgagtagctggaactacaggcacgcaccaccatgcctggcttctttttgtatttttagtagaggtggggtttcaccatgttggccagcctgatctcgaactcctgacctctggtgatccacctacctcagcctcccaaactgctgggattacaggtgtgagccactgcaccaggccttaattaaacttttattttagattcagggggtacatgtacaggtttgttacatgggtatattgtgtgacactgaagtttaggctatgattgagctcatcacccaagtagtgagcatagtacccaacagagagttttttagcccttgcccttcctctagaagtccgcagcgtctattgttcctctcttgatgtcaacgtgtacccaatgtttagcttccttttacaagtgagaacatgcagtatttgtttttttgtttctgtgttgattcacttaggatgaggtcctccagctccattcctggtgtggcaaaggacacgactttgttcccttttttatttttttgacactgtccttgaacttggttgaggttttgttcccttttatggctgcatactattccatagtgtatatgtaccacattttcattatccattccactgctgatgggcacttaggttgattccatgtctttctactgttttgttttgtttgagatggagtctcactctgtcacccaggctggagtgcagtggcgcaatctcagctcactgcaacctctgcctcccaggttcaagccattctcctgtctcagcctcccaagtagctgggattacaggcatgtgccaccatgcctggctaatttttgtatttttagtagagacacagttttaccatgttagccaggttggtctcgaactcctgacctcaggtgatccgcccgcctcggcctcccaaagtgctaggattacaggcgtgagccactgtgcttggctgatgtctttctattgtgaatagtgctgtgtagaacatataagtgcatgtgtctttttggtagaagaattcattttcctttggttatataccaaatcatgaaattgctaaattgaatggtggttctgttttaagttctttgagaaatctccaaatagctttccacagtggctgaactaatttatattcccaccaacagtgtataagtgttcccttttttccacagccttgccaacatctgttatttttttgactttttaatgacagccattcttcagatatcaagggtggggacaaaaaaagaaacttaataatcattttgactagtgtgagatggtatctcacgatttcatttgcatttctctgatgattagtgatgttgaacattttttcatctttgttggccgcttgtacatcttcttttgagaagtgtctgttcatgtgctctatccactttttgttggggttctttgttttttgcttgttgaattgtttaagttccttgtaggttctagctccttgtagaattgctaagttccttgtagacctttgttggattcagagttcgcaaatattttctcccattctgtaggttgcctgtttactctgttgatagtttcttttgctgtgtagaggctctttagtttaattaggtgtcacttgtcaatttttggttttgttgcgattgctttggaggatttagtcataaattttttgccagggaaatgtttttgttttttttttttgagacagggtcttgctctgtcacccagggtgttaataacttaacaaactgagaccccaagaggaaaggtgattcggccaaagtcatacagtaagttagtggcagagccaagactagaatggtggactgtgggtgttggaagggaactttgaggttgttagggcagcctttcctaaggcgaggcccctcagacaagaaggattctattgttagatgtttgaaaactgctgaattaaagaaagctgcacaaatttcattatccgagaacttctcagaattcttaacacatgacaataccttggccactccaagaaatgcctgcagtgtatagggccctgaattagtttcaagagtcccttgaaggacattgacacctatgcaagctctccctgctctcagacagagaaatgctatatcttagatatactcctagttgcttttaaaaaataggattctagggccgggcatggtggctcatgcctgtaatcccagcactttgggaggttgaggcaggcggatcacgaggttaagagtttgagatcagcctgaccaacatgatgaaactctgtctctactaaaaatacaaaaaaaattagccgggcatggtaattagccgggcatggtggcatgcacctgtaatcctagctactcaggaggctgaggcaggagaattgcttcaacccgggaggcagaggttgcagtgagccgagatcatgccactgcactccagcctgggcaacagactgagactctgtctcaaagaaaaaaatatatatatagatttctagatttttatccacggttgcttgtcattgtgcaaattgttgtcattgtgcaaattgtatgatttttaaaattatactaccaaattgtctgtcgctggtatgtaggaagatggttgacttttttttataatctcatttctcctttttttaaagtaagaaatattacaaatatgcagagaagtatagagaataatattatgaacatttatgtatccacctctcaattttgtcaaatcttactacatgaccatgttttctttggatgttgtttgtttgtttgtttgttttaatgacaaattaaacattacacttagagttgaagccccttgtcttcctgatcccatcaccctgccacccttatcagtggtgatcatggtcaccatttggtatttatcatgtgtatttggtatttatctggtaatgtgtcattaccagacacattttcacagttctaccatacgtggctatataagcaaagtaaaatattttgcttatctggaaaatttatttaaatgatatactgtacatatcctgcagcaacttccttttattactcctcataataggtctctggatcttttcatgatgatacaagttgcaccagaccactcatttaaaatgctgtgtaggctgggtgcagtggctcacctgtaattccaacactttgggaggccgaggcaagtagatcacttaagcccaggagttcaagagccagcctgggcaacatggtgaaaccctgtctctatcaaaaaataaaataaaaaagaaataaaatagataaaatgctgtgtatccatgaagtactatacagtcataaaaaagaatgaaatcatgtcctctgcagcaacatggatatggctggaaaccattatccgaagcaaactaatgcagaaacagaaattcaaataacatatgttctcacctatacgtgggggctaaaccttgggtacacatggacataaagatgggaacaataggcactggagaaaccaaaggggttagagagggagggggcaaatgttgaaaaactacctattgggtaccatgctcattacctgggtgatgaattcattcatactggaaaccccagcatcatgcaatatacctttgtaacaaacctatacgtgtacctcctgattcgaaaataaaagttgaaataacgggccaggcaatgtttaaaaacacatgcagccgggcgcggtagctcatgcctgtaatccaagcactttgggaggccgaggcgggtggatcacttgagatcaggagttcgagacaagcctgggcaacatggtgaaaccctatctctattgaaaatataaaaattaaccaggcctggtggtgggcacctgtaatcccagccacttgggaggctgaggcatgagaatcgcttaaacctgggaggcaggtaaaaaaaacaaagttgaaataacaaaaaataaaataaaagtgtctgtaaatatcctgagtatatttattctgttttgtttatttgtttgttttgagatggagtctcactctgttactcaggctggagtgcagttgcacgatcttggctcactatctcagatgatgctccaaagactattcttatacctgtggatgagagtttctctaggtaacatgcagagatggaatttctgtatcttagacagtggatatcaacacttttaagagatgttgctaaattgctcattcttgaatgccaacttccacttccaacaatagttacagagttttggttgctctacaacctcatcagcacttgattttgtaagatactgaatgtaaaattatgcttcactttcaaatttacatttcctctattactagagaaggagaggctcttttgccatttgagcttcctacattatgagtgtgcttgtttgtatcctttgaccatttatctattgtattatttacctttccttatcaatttgtaggcattttttagcactcttagaaacatcttttatgcatgtatttttttttttttttgaaacagagtcttactctgtcgcccggctggagtgcagtggcgtgatctcggctcactacaacctccacctcccaggttcaagtgatttttctgcctcagcctcccgagtagctggggttacaggcatgcaccgccgcacccagctgatttttgtatttttagtagagacagggtttcactatgttgcccaggctggtcttgaacacctgaccaaaggtgatccatccacctcagcctcccaaagtgctgggattacaggtgtgagccaccacgcccagccgaccatttttaaacgtacagttcagagacattaaatatattcacattgtaatacaaccatcagcaccatccatcacctgaacttttttcatcttcccacactgaaactgtacccattagaaaatagctccccttgggaggctaacatggagaaacctcgtctctactaaaaatacaaaataaatactaaaaatacaaaaaaattagccgggcgtggtggtgcgtgcctgtaatcccaggtactcaggaggctgaggcaggagactcgcttgaacccgggaagtggaggttgcagtgagccgagatcgcaccactgcactccagcctgggccacagagagagaccccgtctcaaaaaaaaaaaaaaaagaaaagaaaagaaaagaaaatagttctcctttcttcccaggccctggcaaaccccttctactttctgtctctgtgaatttgactactttcctgtaggctagtggaatcatacagtatttgttctttgtgactagcttttcccctagcataatgccctcaggatccatccatgttgtagcatgtgtcagaatttccatcctttttaaggctgaataatattccattgtatgcatataccacattttattgatccattcatccattgattgacacttgggttgcctgtaccttttggctattatgaataatgctgctatgaacttgagtatacaaatctctcttccagatgctacttttggttcttttgggtatatactcgggagtacaattgctagatcatatgatagttctatttttcattttttaggaagccgccatactgcttgccacagaagctgcactattttacgttcccaccagcagtgataggaacgtaaaagggttacaatttctccacatcttcaccaacacttactattgtctgttttgttgttgttttataatatccatcctaatgggtgtgaggtggtctcttattgtgtgttttgtttgtttgtttgtcttggttttttttggagacatagtcttgctctgtcgcccaggctggagtgcagtagtgcagtctcagctcactgcaaacttctcctccagggttcaagcgattctcctgcttcagcctcccaggtagctgagattacaggcatgtgccatcacacccggataatttttcttttcctttttttttttttttttttttgagacagagtctcactgtgtggcacagactggggtgcagtggcgcgatcttggctcactgcaacctctgcctcccaggttcaagcgattctcctacctcagcctcctgagtagctgggattacagatgcatgccaccatgcccggctaatttttgtatttttagtagagatggggtttcaccatgctggccaggctggtcttgaactcctgacctcgtgatccgcccgccttggcctcccaaagtgctgggattacaggcgtgagccactgtgcctggcccacacccagataatttttatattgtttagtagatttgggattttgccatgttggccaggctggtctcaaactcctgacctcaagtgatccacttgccctggcctcccaaagtgctgggattacaggcatgagccactgtgcccagcctcttattgcagttttgatttgcacttccctaatgattagtgatgttaagtatctttttatgtgcttaatggttatttgtatatcttccttggagaaatgcctattcaagtcctttgccaatttttttgttttcttgagacaggtcttgctctgtcacccaggctagagtgcagcagcaggatcgtggctcaccacagcctcaaactccttgactcaagtggtcctcccacctcggcctcccaagtaagctgggactacaggtgtgcagcatgcctggctaatttttaaatttttctgtagagacaaagtttcactatgttgcccaggctggtcttaaactcctgagctcaagcaatcctcctgcctctgcctcacaaagtggtgagattacagacttgagccactacacctggcctctttgtccatttttaaagtttttggttgttgttattgagttgtaagagttctttatatatttcggacattaaccccttatcagatatatgattggcaaatattttctcccattctgtaagttgctttttcactcagtcaagtgtcctttggtgcacaaatttttctaattttgatgtagtccaatttatctaatttttaaaaatttcctgtgcttttggtgtcatatccaagaaatcatcaccaaatctaatatcatgaagcttttcccttatgttttattccaaaggttttatacttttccgtcaaactcatttttagttaattttcgtatatggtgtaaggaaagagtctgatttcattcttttgcatgtggatatacagtttcccaaacatgaatttggttttgatagtactttgttaattaagacttttgcacctggtagacgctctttgacctctaacccactggaatcctctcaccatccttccctgacagttgaccatttagcttgggcttaatacttccaatgacggaatactcactacttaataaagcagcttttcctgtggtagaacaattgtattttatagaaagatctccattttgagcctcaagtttcctccctgtagcatccacattttggtcctcgttcattctctgaagctgtaggaatcagtgagagctttttttttttttttttttgagacagagttttactctgtcacccaggctggagtgcagtggcacgatctctgctcactgcaacctccaactccagggttcaaatgattctcctgtctcactctcctgagtagctgggactacaggcacatgacaccacatctggcttatttttgtatttttagtagacggggtttcaccatgttggccacgtgaaactggtctcaaactcctggcttcaactgatctgcctgcctcagccccacaagtgctgagattacaggcgtgagccacttcacccagccagtgggcactcttttccaaaggaaagtactttgttgccttttttttgagactgagtctcaatctatcacccaggatggcgtgcagcggcacgatctcagctcattgcaacctctgcctcccaggttcaagtgattcttgtgcctcagcctcccaagtagctgggattacaggtgactgccaccacgcccggctaatttttgtgtttttagtagagacagggtttcaccatgttggtcaggctggtctggaactcctgacctcaagtgatccacccacctcagcctcccaaagtgctgggattacaggcctgagccaccgcacccggcaggaaagtactttgaattgagtaaataacgcaactatatgctgggcagctacctgccaggtttataaggtttaacacatttactccacaaagcaatctatgaaaaggtcctatcattgattcctattttatagatgaagcaaataaggcttgaagagcttatgattttagcaaggtccaacagctatgtaaatggcaccactgatatttcaaaggcaatggccctgaccactctgctacaccacctttctctcctcttctccaatacccagcccaaaactcttttggatctttgattattcttcaaggggcatagctttctttctttctttctttcttttttttttttgagacgaactctcgctctgctgccgggctagagtgcggtggcgagatctcggctcactgcaccctccgcctcccaggttcaagcaattctcctgcctcagcctcccaagtagctgggactacaggtgcgtaccactacgcaaggctaatttttgtatttttagtagagatggagtttcaccatgttggccaacatgatctcgatctcttgacctcgtgatccgcccgccttggcctcccaaagcgccaggattacaggcatgagccatgccgctgcactcggcctaaggggcatagctttctcatcctctgccatcctaggaaaattttaagtattcatattaaaatgaaaactaaacacaattgtccatatatgctccttaggagtagaatgccaaggacctcttagctcctctgacctgggaactacattctctctaatgatacatacgactgggttagaggtttgggcagctgccaccaagtaaaacctctagaattttgctatgtcactttctgctaaggtagcttttcccatctacactaaataaataaatcatccaggtgatttatttttaaccaatgcagaggattttttacttatctccatggagttcaaacatttctccaggctgggtggggtgactcacgtctgtaatcccaacactttgaagactaagaaggggcagattgcttgaacccaagagttccagaccagcctgggcaacatggtgaaatcccatatctacaaaatatagaaaaattagccaggggtggtggtccacacatgtagtcccagctactctggaggctgaggtaggaggatcatctgagcctggagacttggaggctgcagtgagctgtgatggcgccactgcactccagcctgagtgacagagaccctgtctcaaaaaaaacaaacaataattcaccaaatctatttggatctggatcctgccatcattttataggtaatgcctccatagcactcactaagtgccaggcacacttctaagccctttttatacattaacacaaataatccccaccacgacctaatgccatacacatcattatggtcactattttgcaaataagaaaacagtcacagagcagttcagtaacttgtccagggtcacacagctagtccatgactgaaccagaatttaagcccaggatgtcaagttccagaattggtacactcagcctcaatactgtgctgccttcaaatattctgacaatcttagacagctttggggatccaaaagattgagaagtactcttggggacctcttttttttttttttttttaaatacggagtctcaactctctcccccaggctggagtgcagtggtacaatctcagctcactgcaacctccgcctcctgggttcaagtgattctcctgcctcagcctcccaagaggctgggatattacaggcacatgccatcatgcccagctaatttttgcattttaagtagagacaggatatcaccatgttggctagggtggtcttgaactcctgacctcaagtgatctgcccacctcagccccccaaactgctgggattacaggcatgagccaccgcacctggctcccattttttttttaagacggagtttcactcttgttgcccaggctggagtgcaatggagcgatctcggctcactgcaacctccgcctcccaggttcaagcaattctcctgtctcagcctcctgagtagctgggattacaggcacatgccaccacacccggctaatttttgtatttttagtagagatggggtttcctcatattggtcaggctggtctcgaactcctgacctcaggtgatcttcccacctcggcctcccaaattcctgggattacaggtgtgagccatcacgcctggcccctggctccttttttttttttttttttttttttttaaataaagaccaaaggtccagaggctttgaaaggcaaatagtattaagtcaggatttgatatcaggatttctttcattctgtttattttctcattgctttctacttatgatactgtttcatttggtagtaataatatttctttctaaaataaattgaagtaaaaagaagtgagttgatgtaagaaaaatgttacagatatgaaaaaatcataatggtcattaaaaaattagtgaaactttggaaagactgtgttcagtcaagtgaagtgaagttagcttgcaaccacaaaaaaacccctaagtctcaatggtttgaacagcaaagttaattgctcacctatagtacacgcccagcatgggtcggcagggggcgctccgcgttgtggaacgattcatatctatacttgcttccccaacaagggcagcactggcctttaaagcttctgcccaggtgtgacacaggttgtttctgctcacatctcgttacctgaaacaagtaacatggtcacatctcatttcaaaggaagcaagaaaatgtaatccccatcatgtgccggaaaggagagaaatagaatagttgagaacagccctcagagagactataagtaagggggcataaaagatgggtctagagagataggctgagtcatgactcactgaatttgtctgacgtagatcatgatggcccatcccaccaagtggccaacatttgttcccagaaaagggagtgtgatgatcccccagaaagaacacagtctgacaacattattctgatgagcagacacacctctcaggctgccactcaggagtccttttgggtggggaggtggggatgctgatatttcctaagtggtttcagctgaactctgtgatcttttttttttttttttttttttttttttgcctattccctgaagggagatgaggcaatttgggctttggctgagctagggtttggttctgtcaccacttgctatctagggaagggtaataattggaaaggagaggaattcaaggagagggtccaggtgggtagggagcctcacacagggtttggtgatcaggtgattgagaggcctccttgaggagttttcaaagtgcggtctgagggcacctggtatcagaagtgcccagaagctcattaaacacttgggccaggtgctccatggctcctgcctttaatcccagcactttgggaggctgatttgcttgaggctggggttcaagacaagcctggacaacatagcaagacacctccccccgtctctattttttaattaattaatttgtttgtttattaatttatggactctcactctgtcgcccaggctggagtgtagtggcctgatctcttctcactgcaacctccgcctcccaggttcaagcaattctcctgccccagcctcccaagtagctgaaattacaggcatgcaccaccacacccagctagtttttgtacttttagtagagacaaggtttcaccatgttggccaggctggtcttgaattcttagtctccagtgatccacctgccttggcctcccaaagtgttgggattacaggcatgagccaccatgccccacctctatttattaaatattttcttttttttaatctgatgactaggcccactgttggtcctggcacctggaggtaggaccccaggcatctgattttttttgttgttttttttaaggcagggtctcgctctggcgcccaggctggagtgcagtggcacgatcttcactcactggaacctccacctcccaggttcaagcgattctcctgcttcagcctcccgagtagctgggattacaggcatgcaccatcacgcctggctaattttttttttaatagagacagggtttcaccatgttggccaggctggtcttgaactcctgaactcaggtgatccacccacctcccaaagtgctgggattacaggcgtgagccaccgtgcccagccaccatctgatttttttttttttttttttttttttgagacagagttttgctcttgttaaccaggctggagtgcaatggcacgatcccggctcaccacaacctctgcctcatgggtttaagtgattttcctgtctcagcctcccaagtagctgggattacaggcatgtgctaccacgctcggctaattttgtatttttagtagagacgaggtctcaccatgtttggcaggctggtctcgaactcctgaactcaagtggtccacctgcctcagcctcccgaagtgctgggattacaggtgtaagccacctcgcccagctgccatctgaatttttaataatggccccagatgattcttatggacaccaagatttgagaagcattgaatgactgagagaaaatttcttgtaagggtagaagcccagcacagtggttctcagtggagataatttcaacccccaagggacatttataaatgtctggagatagttttgattatcacaccttgagggtagggaaaagtgctgctgacatctagtggctagaggccagacatgctgccagggacaatgtacaggacagtccccacgacaaagaattctctagcccaaatgtcattagtgcttaggtcaagaaaccctggttagccattaagagtttgaacctttctaaatgttggagcacatacgatttttaaatcttcaatttttattttattttccaaaatttctactatatgcatagaatccttttcattgaatacctgttacgcaccgagcacttgaagtttacatcactatcagttcctcttgaaagaccttttcagtcattcatccaacaactatccattaaacacttactaaaatgtattccaggccaggtgtggtggctcatgcctgtaatcccagcactctgggaggccgaggtgggtggatcacctgaggtcaggagtttgagatcagcctggccaacatggcgaaaccccgtctctactaaaaattaaaaaattagctgggtgtggatcccagctactcaggaggctgaggcaggagaattgcttgaacctgggaggcggaggttgcagcaagccgagatcgtgccattgctctccagcctgagtgacaagagcgaaacttcatcttaaaaaaaaaaaaaaaaaaaaaaaaagaagtattccaggcagaggggaaagtatatgcaaaggcccccaagacaggaaagaaaaactttaaaatggctagtatgcctgctgctgataggggtgggggcaagtggaatgaaatgaggttggacacggagggatataaaaacaagggcgtgcatggcctcacagtgttaagtgggagttgtatgagttttgttataaatgcataggaagtcataaaaatttaagtagaagaggatctgagccaatgtacatttgtacaagatcacccttggcccctgagtgaagagtagggggtagggaagccacaggagaaaaagtgaaggggtggggtggaggcaggcggggggggggggaggcggggggggcggtggagcgggggagatcccctccccaaccctggcaggtttaaaaaaaaaaaaagggaagaagtgaaaagacttttgcagacctccagagatgatgcataaggttggctggggtggagatggaaagatggaaaatctagattctgtttggagggtggcaagaactggattttctgatgaactggaaggcatgagaaacacaacacaaagattgtgacttgcaagatgttggcttgaataattgagagaaggtgggtgatgatatatgacatgtagatatgactatcattctcttttgacgactgaggaaggggaggtgagtcgtcctacttcacaaagatagtatatgggctccaggtgtgtctaacccaaaggttataatttttccacactcctatatccacacattaatttttttttttaaattgagacagagtctcactctatcacccaggctggagtgcagtggcgccatcgtggctcactgcagcctccaactcctgggatccagcgatcctcccaccttggccacctaaagctggagttacaggcatgcaccatcacgccctgcctatcttaattttcataatgggtatgacatttactgatagtaatatcattatacatgccccatacatgctaacatctgcttccacatggaagcagcacaaagcctggaaccttcctcaaagaccccccccacccccgtacattggaacaaggtgctgggaacagaagtttagtaggtggtggaagggcagcggctgctaccctgggaactggttttaaaatcttacgttctgattgctgccgtggccatgtgctggtgtgtgatggggagatgttcttttaggtaactaaatccaacgagctgtgattggtgatcgaaccgagcaggcctcctctggatttggagagacatagtgcgtctgggcctgtgattggcgggattgctgtgattggtgaagtccctaaggctatctaagtttctgaacaccagttcctgcgttggccacgaggaggagcccaggaagcgcaaagcgcagcactgcggagagtcttggccgcctcctccgggacgccctccggcccagcgcggtgcctgccctgccctgcgccctggggcaaccgcgggatgaggtggggcggcaaagggtgtcagggctcccagctgcggcccgggtggccacgcttctctgcacagttcctttggcctcttcccctggctcccagccccacagaagacattggctgacccgaggggtggggctgcgggttcgcgaaggtttgtgaaggcccagatccaagttgcaaaactgtggagtctatcaagtgagacttagcagccccactccctcaggtgcgccccttgccctcctcagagtccttctctcaagtttagcagcctccaccgtgccctttaagatcctcaaagaacttttgcaaagtggcatctcattggagctaaaatgacctgtgcaggcaaaggccactagctcaggggatcgtcctgcccatccccaggtgctatcacatcgcgctgtgcgtcttcactgcacttaaccactgtttgtaattgacttcgtttttcatgtatttacttgcttatgtctgcaacccgcctctccaccaaaacgcaagctctgtgagggagggtgtagggttgcccgacacaacacaggacacccagtttcatatgagtgtcagatgaacaccacagtttaaaagtataagcaggtcccatgcattatttgggacacgctcatactaacgaagtatttcttgtgtatcttaaattcacatttgactgggcatcctgtatttttatttgctcatctgcacccctctgagggggatattttgcccatggtcttccctgctgcatctccaccacccacaacgatgcacgcagaaggtgctgaataaatgttgactgtttcgatggacgatttccatcctttattcactcagttattcatccagcctatttatatcaagtgggtcctgggaatacaatggtagatgggacacagtccagtggaggaggcacacaaccagtctaattaccatctgactaaacgatgatgatgtaaagctttgggggctatggggggacagaggaggaccccggcgttctgtttcccggaggaagatgactaagatgggacttggaggatgagaaggcaaagaaggaagtgcgacagctctctgcttgagaccacggggttctggaagctgcagggggctggggagggcaaatgtgcagtgtgggcgtggcagtcaggaaaaggtgagaaggagactcacattcactggatgttactacccaccagccagcacaagagggatgccatgttgctattattgtgcccatcatacagatgaggaagctgaggctcagagaagtgaaatgcctcggctaagtttacagtcgtggagggaaaagctgagcttcaagctcaggtctggcagactctgaagcctgcactcttctagaaaagccactgggttaaggattacaatgccaatagggggatggagaaacacgctcagaaaggtgatagggctctccctgtgaatatggctctgtccagttgagcagaatactgaagcaatgcaagagttatggttttttccaagccctccagagagacaacaggagggccagagcaggacccaggagtccagaccactgtgtctcccattcctattggggttggctctctaggagccccttgcagagccctggggctaattccttgcatggatcctggacaggtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccaggtatggtcctgactccacatctgcctggaaggaaggatgggatggtaggagagagacacagaaccaagggggaggattccagactgggagcagtgtggaggatttgtaccctcatcccctaacccaggaacgtccatggccctgatgggtgaatgacgttccaatcagagaaggagaatccagacgacctcaacaaggtgagaggagccccgtagagtattaggggtagtccaaggctgcctaaagaccagatctcttatctctctcattttgcagttggggaaactgaggcacggagagggaaaatgacttgcccaaagccagtgagtcagcaaactgaagcaggtcaagaatccagagggaaccctgaagttccctgagcagaaaacaatcggttaaaatctcattgccacttctgccttgaactccaaatcctccttcctgagctccaggcatggggtcccctccatcccctcacccagagcttgtctcatcggccatgcttccctccctgcctctcatcctcctcctgacttcccctgccacccgcaccacctgaggctggcagagagttcctggcaggttctccagtgctgacgggcacagccaccaggcccccactattccatccaggggacaccttcccactgggtccctatctggatgacttgggacattctttgttctacacttcatcctctctttgggatttctgagtccagacacagtgaggaccccgacagcccccctcctcacctcttgtcctgggaaggccaggcctgcatggcagagatgtaaccagactccaaagctttctgggccgggcttcatggaaggccgtatcggtgcaggggcataaacacaagctctggagccaggtagagatagttctaacaccattgccttggctcactgggaaaatgatgtttcttctctgagcctcagtttcctcacctgtgatgggagacgagaacccttccatcctcaaagcttgctctcagctgctatggaagcatctccaggttgtgatattaaatgaaccaaacaagatacagaacagtgtaagagcagaggctactcatgtatgatcttacatgctatctggtctgtataaagaaaccttggcagatacatctgtaagggatgtggttccccatagtgaggaagtcaaggagaacaggtgaacaggagacagctggaagcaagacttctcaatttacaccttttatgttttgattctgaaccatgcgaatgtagcaccaattcaaaactaaatgtaaagatgttcacaaattaagtaaaatattaaataataataataacacatacctcaataatatgaccggtgtgcagtcaagatttaggcccaggtactagaaattgactcaaagcaacagaggaggcctgtcttcaagtcaccgaatccttgacctagaaaggccctttattttgtcaacgtcaaattgcccataacaacaataatagtcttggtagcaagaatcaggagctccctacttggggaacatggtgccaagcactgtctgaacattatctcatttaattggcattttgattttgtgaggaaacgatcatcattccctctttacagatgggaaaactgagcctcgctgaggttttgactagtaagttgtagtaagtgatagaacttgatgccatcgaaggctttccaggttcaaatttgaagcccccctacagtgggtctcaatattggctgcacaaaaatatagacgcctggcacctccccacccctaccccaagattcgatcattgatctgtgatagggactgggcatctgtctttaattttaaaaaatctttttaaaaaatagacatagggtctcactatgttgcccaggctggtctcaaactcctgggttcaagtaaacctcccatctcagcctcccaaagtgctaggattataggtgtaagccaccatgttcggccaacatctgtatattttaaaggtttcagatgattctatttcatcttcagagatgagtctctgctttgttagacaaaacttctccaatgggaaaccaaggccagggagggaaatgaccttgcccaaggacacacagtggctggaaccagagctggggcaggacacccagcagcttacatgaagccctagggcaaataagaaaaaggcaccccactctgggcaggcagagctccatgggcacttcgcttggcaagtggaacaagggctgggtttccatccctacctgccctcttggctggagaacctttgtgcagtgagcaacctgcacaactgtacagggcagtaactctgatctgagcctcaggacttccaaacacttcaccttagtgacctggcaaatccctggggcccctcagaacaagagtatggggagaccaagggtggcttctgggatgtgggctcagccctcactccccaaaccagagtctgggtcaggcaggggctcccatcagccttcaggccccacaagggccgggaaggccgcatctaattcccaaggtcacccctgcagataaattcaggaacataaacaggagggatgaacataaacaggaggacagcaacaccctcagcccagatgtcataagccacctggcaggaggcagcctgcggagaagctccacccacacagatccaagtcctcctggcttccttcctgatcattctccagaccatactctctgccctacctccggagccttacagtcagcatctcccacagtgccctgctctctgcccttctcctggccatctctcactggcatccctggaagggaagggtagccctggagttagaggcacagactctagagacagactgcccaagttccaattccacttcttgtttctcatcagctgtgtgagcatgggtatatggctcaacctccctgtgcctctggtgtgtaaaaaattggtgaaaacattgcctacctcccagagtggctgggaggatcaaggaagtaacacatgcaaagctcctaaaacagctgcatatccagtggccatgatgatcaatgtgtatattttgcttcatttcattttcatgacaaccctggaagttaagtattataattcccaatttacaggtgaagaaactgaggctcagagaggtggagagagtcagggcagggctctacatctttttttgtgatagggactgggcatctgtctttaattttaaaaaatctttttaaaaaatagacacagggtctcactatgttgcccaggctggtctcaaactcttgggctcaagtaatcctcccatctcagcctcccaaagtgctgatgcctccagagacaggacgtggctgagatggattataacgtagtctccggtttgcagtgcctggctgctggtcatatcctcacagggcccatgggacacagagccaggtgcattcccctgacttgggtcttccaatggctctcaggcacctctctgcttccagccagccctgggaggagggggagaacggcatggcaaggcgtttgcagagccgtcttgttcaccaatgtctttcaagacattgcccgggtccacagagagcccaccattcattcccatgctggctggagcccctgaatacccgaggtgaccttctgtccttggacaagtcacttccccctctgatctccatctccccatctgtgcaatgaggggatggggctgaatcagtggttttccaaccctcaaataaaatattaagactacatgtaaaagggagtcgctggttgaagctgggcctgtggatgcatacccttggctcctgggagcctcggaacccagcttgaaaaaccccagcccacatcctcctaaagattctcctggctctgacactgcagagttctagaaccccaagctcaaagctgccgcttcccatccctgtttggaaagctctcccccagctgcctttatctctctttggtaacagagcaaatttgctcaggacccagcacagggggaacaagcagactgttgactcttgagcaaagcctcttctttggagagcagccgaggtggccgtgggctatgcgttgggaggccagcggcctcttgcataaccctggaggcctcctgcccacccaggccttttcagggttaggggtgaggaaaaccgcaaactcatgcccagttaattttttaaggcaaaatcaacaggctcagcaatgattagcagctgggtaagttggtcttaatcaggctaaggacagggagggaggaaggaggcccagggatggggcccagttatcagttaaccacatgaatgttgcttccttccaaacccactggccttcagccccaagctccctcatcttcctctcggaaatactcctgtgacaagccagtggccacccatcatcgggtgaacaagccagtggccacccatcatcgggtgaacaaacacaatgccactcatggtctgtgatgaagtagaaagtgctcgttgttaagacaaagctcacccaccaccgctgcgtggacttgagcaagtccctttcaccctctgaggctccgtgaggggccccaggtctgggccccaagtctatggttcagtctgtggccagctgccactcccctgacggcctcagtgtttccgtccactaaatgggtgggttagccaaggcatcttttccagtcttgaagctttgtgggtgcctgatttgattaagccacagtggcctttgccgagtgcagagggtggtatgagtggcattttaggagctcaaggaagagaaagggaggggacctacctggtatctgccgttggtatcagcaagtgtcagatcccagctccaggaagagggctgtcctctcagatgggaggcaggggtccagtggggtggctgtggctgcagggacagcctagcagagcctcttggtggcccagaccccctgtccctggaccttggaagccgctaaaggaagcagcaagaccaggccagctggtggctgcctggactggagtttggtcagtggttggggacctatattgtgagatagttaggactttgtccacaaactggaatttgaaatttcaaaggggcaaaactgaagggccctaccccagagtagagatggctcttggcttctttcctccacgacttttgttctttgtcttgataagtcccagttttctctgcacctctcccggagtggtgggtggggaagaaaagataggagataatggtgtggtgagcgccaaggggaagtgaagatgccaagcagccctggggtggccaggcgtgtggaggatgcccctgcccctgcctataccccgggataaggtgctttacttctcaggtccttgagttcccctgcaagactgaggcagtgaaaccaccagctccagtgccttagaattccgaagtcctttcagggattccaggagtcatgatgcaggcaatgcgtagaggggtgaagccctcaagctctggaggcagactcgggttcaaacaacagcccctcccttacgagctgtgtggctttgggcaagtcacttcacctctctgagcctcaatttcatcatctttaaaatggggatgacaatagcccctatctcaacaggcagataatatgagaaggctagaaggtttttagcaccagggctagcacaaaatttctctgtaaacattagaccttattataatgtaaaagagaaacaatgtggttcgtagtggcagctcccttaccaccgtccacagcagaggcacaagctccctacacatgcctccccaactgcaggttgcccagggcaatcccttcccgtctcaactgggtctctctgtgggctctgaggtcctctgctatcccctggaatctgctgcctcttgagctggggcccgacagcaagtgagcagaggtaaagaacagctgctaaattgatggcattgaggctagtgcttgttcatggctgggtgtgtggtacctggagctgtcctgagcaggggtcctgattccaactgattatgtggccagtgtgtcatgcaatcaatgaccaatgacagtgattgctactattgtactgtatgcctacacgtggtcatttaatgcttgaaccatccctacaaagaaggtatcaacccaatttttctgatgcttaaactaaggctgagaaaagtagaagttgaggtcacagagtttggtacattggcactgcctggattttaacctagatctatctgacccacaaggtctgtggtttattcccctaaagagaggtcaggggaagagaggctaagaagcttatctactctctcatttaatcttcacgacaaacgacaagttagaccccttgtacagaaggagtaaccaaggcttcgaaataaaaacttgccttgtgcagacagctggccctgggcttggaatataaatagtcactggtatacaggcaccagagaccaatacccacaggctaacacccactcagtccacagaaagaagcttaatattttttataagcatagaaataaaaaccaaaccaatactgtgacatttgctctgtgacttcctgtatttattatgtgctcatatgaaagcacctaagcattgtcaggataatgttcttcctcactggagggcgttatgaagttgctttcttttttccactagttaaaaaaaaaatcccttggaggaagggaatgaaactttttataattgatacataataattgtacatatatatggagcacatgtattttgatacatgcataccatgcaaagtatttaggatatccatcacctcaaacatttatcatttctttgtgttgggtacatttcagatcttctcttctggctattttgaaatataaagtaaatgattgttaactataatcgctctactgtgctataagaactagatcttattccttctatctcacttatttttgtacccatgaaccaacgtctcttcatcccctgaagaaaacattctttttttttttttagacagagtcttgctctgtcacccaggtgcagtggaacaatctcggctcactgcagcttccacctcccaggttcaagtgattctcctgcctcagcctcccaagtagcctggactgcaggggcatgccaccatgcctagctaatttttgatttttgtatttttagtagagacagggtttctccatgttggccaggctggtcttgaactcctgacctcaggtgatctgcctgcctcggcctcccaagatgctaggattacaggtgtgagcccctgtgcctggcctgaaactttcaaggtctcaagacactgtacatttaaagtaccccaatgttttccttttccacctcccgttctttctccttatctaacatgaagaacattgtattaaatctgatttttaaggagtttttgtctgttatgtgttaagggtttgtttggtaccccaatgaaaacattctgcattgcagaccaaagtgtgcttatttcaggggcatgggatcattgcgttcttagccattgtcacaaaatacatggagtcatatttaaaatgtaaagttgtaacatacatatgtttaaaatggaaatacaaagcaaaaagatggatgtacaatgtcatgtgtattcagttctctgtacttagtaaatgtaacaaactttctgtctattactgaactataggtgcaaggacacgtctccagttactttgcatctgtaatccacaaagattctgggcagctgtattatcatagcttggtttaaataaactatgtagtaacaatgaacaacaagaacaaaagaaataatagcttgcctgaggtcacagagccagcagatcttataggtggtgcgtcatttatatgaggaatgtgtatctaggagatactgtttggcgttggctaagggtggaatgaatcatgtatgtaatagattatgcaatttacagtgatgagtggatagatttacttatggggtaggttataatgtggtgggatgtgaatctagaatgtgcctcctaggcagtcatgcagattgtgcatttggtaagtcaggtatgtcatgattcatgtatctaatagctcttcatttgcagtgtccacctagtagctcttggatataacgggtcatggctgtggcatggtgtggttgatcttggttgatcgtagaccttatttaattgaatctaagatgtcatctatggaaaaatgcattgttatttttgttgccaatgaaattctgacatgacattgatcacattccccgttaagcaatgtggaactgtgcctcagagtggaagaggccatgtattcctggattgtgtggggagtagctgtgcctgtggcctgccataggtgccaggcaggtggcagaggcctgggctcagcccttggaggctcctcccggagctgccctccacatctcttctgtgtttaccccttggtcggatcttctgtttcttcccacctctgcactgcccccaaggccggtggagccaggtcagatactcctgaggtaggcatgggaggaacccgccggtatttggtctctttcagccccttatcaagtctcatagtgtgggttgcagggggctgcctcttgctccctccctcagagtcttgtcctggctaacagaaaactgagccaggatcatctttctattttacagagggagaaattgaagccctgagaagagacgatgtaaataaagttatcggaatagtgactgagctagttcctaaccccaggtctcctgacatcaaatctagcctctcttgtcctccacaacagttgctccctctcccctttccctacaggcaatagcactccccagtcatctcagcttcagaggtcagatcaagtggacagaataaagctaagcagggcagagaaagggcttctagcagtggaaagaacatgaagatgcctcctcataccactcgaacacacatgccctgactcccgatttgctcactcattaatccacccacacattcactcattcactcactcattaattcacccacccattcactcattaattcacccacccatttgctcacttactcagtaatttaccctcattcgttcattcactcactcattcatgcattcactcaactcactcattaattctccctgtctctaattcactcactcctaattcacccactcatcaattcccccacacactcactcattaattggtgctcccactaattcgcccactcttgctcacaggtgtcaccgaggccctccaacctgcccttccagccagcagtggaggacaggctcccaggcctcccaagtctcaggcttttcttcctctgccctcactctctgccttctacatcaagactttacttccccagattgattggcagcccttgaaaatgtctgcacagaaggcaatgagggctggagggagtgagaagaacagagtgcaccatgagcttcagacagccaggaccagctgtgtaattttcagggccccgtccaaaacaaaaatgcacaatcccttgttcaaaagtcatgatgaattttaggacaaccacagcagagcactgaaccaggaaccaggactttctaagggttgggttgcctgtgactgcactggcgatacccccacaaagcccactctgaaggtaggagacgggtggagagaaacagggggatggcaagggggatacgaaacagggagagggaggagggggaagaggatggacgtctaccaggccccacttggtgcttgatttatgccatctcatttccttctcaaaccaccctttgaagttgattgtacattttacagaaaaggaaactgaggctcggagaggagaatcatttacccaaggtcccagttagtagacggtaggtgcctgaatgtaaatccaggtctctgcctgctccgggagggggtgggggtgagggaaacaggagaatgtgatgggaaaatccgagatggagccagcctgggccagaaacactgggagctgtgggagacggagaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcag

SEQ ID NO: 139979 - DNA, 305 bp, Homo sapiens
gacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcag

SEQ ID NO: 139980 - DNA, 571 bp, Homo sapiens
tgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtgagtaccctgcccgagtccctaggtaacccaaacagaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgag

SEQ ID NO: 139981 - DNA, 1832 bp, Homo sapiens
acctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaaggtacggactggggggagcggtggctggccactgaggctgtggtcacatggtgaattgaccctccacaaagctttccttgccttggggtggggccctgactgtacctattgcagaattcctgcccaggaggcagccaggcccttgtgctccagacctcagctctgggcactgcaggagaagagggggttcccttgtcaagcctaccctgctgggcacctgtgttgacccagctctgtgggtgattgtgtccccctggggaccaggcagctagggcagaatgagggtcttgggctgagccatcgtcttacctgaggtctgggtttcttgtttctcaaggctcaaagcgggctctgagaaaaaaggacagacatttgtttttccagtgatatttgtgggtccttcctaacttcacacccatcaaaatctcacagattattttattgaatcaccacctcacaaatacacagaaccagatacatttatgaagaaatcaagttagccgtgagacaatcttatgttaccaaactaacaaagaagctttttttttttttttttttttttttgagatggaatctcgatctgtcgcccaggctggagtgcagtggcgtgatctcagttaactgcaacctccacctcccgggttcaggagattctcctgcctgagcctccagagtagctgggattacaggtacatgccaccatgcctggctaatttttgtatttttagtagagatggggtttcaccacattggccaggctggtctcgaactcctgacctcaggtgatccacctgccttggcctcccaaagtgctaggattacaggtgtgaaccactgtgcctgacccaatttttgtagttttaatagggacggggtttcaccatgttggctaggctggtcttgaactcctgacctcaggtgatccacccacctcggcctcccaaagtgctgggattacaggcgtgagccactgtgtccagccccaacaaagaagctttaggacttctttagacatttaaaatagttgtgttttttttttgttttgttttgttttattttgttttgttttgttttgagatggagtttcactcttgttgtccaggctggagtgtaatggcgcgatcttggctgactgcaacctccacctcccgggttcaagcgattcccctgcctcagcctcctgagtagctgggattacaggggtgtgccactacacccagctaatttttctgtatttttagtagagacggggtttcaccatgttggccaggctggtctcaaactcctgacctcaggtgatccgcccacctcggcctctcaaagtgctgggattacaggcgtgagccactgtgcctgaactaaaatagttttaattaaagttttagaattactttccttctccatctcccctccaaaaaaatttcttctcgttacttccaaatgtcaggagtgtttacaccttatacataatcgggccctttggcacagcctccctcccacctcctggtggcctttcctcacctgttcttggtgcttcagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacg

SEQ ID NO: 139982 - DNA, 4511 bp, Homo sapiens; identical to SEQ ID NO: 139867

SEQ ID NO: 139983 - DNA, 314 bp, Homo sapiens
aactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 139984 - DNA, 4896 bp, Homo sapiens
ccagactctcctctgaactcgggcctcacatggccaactgctacttggaacaaatcgccccttggctggcagatgtgttaacatgcccagaccaagatcccaactcccacaacccaactcccaggtcagatggaacctcttcttcccaggcccttctgttcctctcctcagcccctcccacctcccttcagaataagtctagactcttatcgctttcaccaagcctgcgcccagcatccctgcacagggattgttaggacagcctgacgccctgcttccaccctgccccaagatgcccctgctctgcagcccggcgcctccaggcttctcacctcctgctgctcacagctcagcctcactccctccctccccgcctctgctccagcctcagtgcaggtcccctgctcccatcttctggcagcagctgcccgacctggtccctcttcatctgtccccattccttcaccccccagcctgtccccaacttgactgaggttctttcctgcagatccccgcccttgagaggggttggtcccactgtcaactctgcttctgtgccctgtgccgcacctggcattcagtgagcatctgctgaagagatgagggtcagatgccctgcagggagtgtgggggcgtcctcaggcaagaaaagttgtacgtttggctgtgggccctgattatgtgtcctgtgacctcttgggtgaggtcagcaagagaaacctctgcaagctggctggggctgcctcccagaggctgccagggggagggacaggctctgtctgtgctcttcttccgaggctacacctggggcgccaggctctcagggctccccaggtaccaccacatttcctacactgcttgggaaagccctgtaagtttgcacagacacccagcatgaggctcgccagagagatacttgtagctggggtctgggcaccaggaacagcttggtgctgggcctgaagtcgggcaggatgcagcctggccaggtgagaggaaagcttggagccagtgcctgggttcaaactcctctgtggcctatggttctgtgggcttggggaagggtttgtacctctgtgtccagtttcctcacttataaaaaaaggagataataaaagtacccatgtcccagggtggctgtagcaataatagggaggggtgcccagagcaggtctggcacacaggaagtgtgcatcagcctcagtccctgccattgggcttgtcctgggagtctgtgaagccaacctctgctccacaatgtgacccccaggcttgtgagaccaagctgggtcagagcttcctcctctggggttgcaccaggaggggaacttctgcaggcccagatgcaccctgaggaaagggcttgttcccaccaagaacaaggctcacctttggaggatgctccccacatgagaggtgaacccccaggtctactggtgactgcagcctcggaagctgacagcatctatcctccaacccatgcccactgggaagtgtgtgaggggtcctcataggccctgcggtgtggacaatgcagagaccctgtagcatctggctagggcggggcccagataagagccctgtgccaggagagcctggccggttctgccactgtggggagacaggctcccccaccccatgtcccctgcttccctgcagcccacagagaatacagacctacttttacagaaatccagatttttgtgtaaaagtgtctctattttaagtagattttaagtggtggcagcaaatttaagcttttgagaatattatacagaacaaatcagattcacaggccagatgcaactttatttacagaaatgggatcaggtcctacctcaggtcccatctcacgttttcacttatgcctatacgtctccttcacgggaaaggccacaagaggccctgcggtaagtgtcccggtgttgatttaaagtccccaacagtgaatatgagggtcctcactgttgcagcaagaggatacccccctgtgtatcttggaaatgcctgcagccctcttgctgcagaacagattcttaggagagaaactgtcagatcaaagttaaacttagagaaactccaaattgccctctgaacagacggtatcagtttgacatcatccaataccgggattcctcggggagaactttctggcctagaaggcagtagagccaggacttcacccagtcagtggcagggccacacgtgggccttgatacagagggggaagacttgagcctcctcgacaccctacagggcccagcctcccaacatgtgataagagaaacaacagccaacttgtacctagctctccttattctccaagggctgggccagttctccccacagccctgcaagggaggatcactcaagggccccaactgtctgacaatacagccacactctgatcagccacctgggcataggctccatgccattgtcctccgccaagacctcagactgaaatgttggctcctcccatgaagaacctggggccaaaggaccagagtccaggtccgtggctgccaggatgggccacttggagagaggcacaagggtggtgccaggcaggtgtgagggctggacctttgcaagagcagcatcacttttgttgagagcccacaggtatcttataattgggtcctaggacttcctgccagtagccattgtgtgcatggatttgggtgctggcctcaccatggtgtgctggctgcccatgcctgcaataatgacttctgtaagcctttcttcatctgcaagatgggtgctgctggcacctcctccccggtgctgtggtgacagggcatagtgtgtgaggctgctatgtgaagcacctaatgcagggcctggcatatggaggaattcagcaaatgacagatgccttcacagttagttcctggcatcctctacattggtgggtgtaggaaagaaagacagaggaggcaaaagttgtagctgtggggcattgaggacagcctggattgttccacagagccctgaggacatctccaggggtgtgctctgcaggggcagctggattggagggttaggggtcggggagggcgtgcactcccacccatgctcacagcctcggaacagtgcctgctcagccaacatgggtgtttgattctgtgtcttttgtcacagactttatcagccccatccctttctgaccttgcctcagtttaaattttacatgtggggcctcattaagagacatggttcttaactaaagatctgtatccattaggaatgctttgggctgcaggaagacaaacacctgactcactgtggcataagtggtttgcgtctgctcccataagctgcacgtggagggtggatctggcattactctctcttccctacatttgcagtatgctaacagctttaacctccagccttgtttcttcatggttgcagggtggctatcacagcgctggccatcacatccttacacagctgtgtttacaaatttagggggacattgaagctcctcccctgctaaaatcaggcttcccttcacctgtcattggccagaactgggtgaaatgcccaactctagaccgatcatcagtaagaggagtatagaattgctgtgcccaccttagattaatcatggcgcaatgtgctccccataccaacaaaatctgagttctagaaactgaggaagaagaggaaaatggccgtcttgcctcctggctgggattcagagcatctccaaccctctgagcttatgtgtaagactgtgggcaaaagtgtgtgagtttttgtggaatggatccacggcttttatcagagcatctttcctttttctttttgattcaagatgaaaatattcttatgattatttttctcaccactgcccagagataaccagcacattaacatggccttttctccatgaatagcactagggtgcccagtggacagacacatagctgtccacacaccagcttgctggggatgcataggcagagtcacatctgcactcacggcctgtcctcacactgccatgtggagagccagcagccacaccatgggccgtccatgctcacgggagtggcagtatcagatctgagcttcgtgtgcccaggcgtctctcacatcagtgcatagggaccctctttgttctgtggcccagtgtgcccatgccacagatggcttcagtcagcagacacctccttctagacactcacactcactcctggctggcccttagcacacctgtgcagacaggcccatttattttcttgtgtaaatcccaagtaggaggactgggtctctctgacagcaatgccagctgcctggcaccctccagacaggtggctcaagccccacctcgccagctctcccagttagcccctcctttccctggctctgacctgagggacgaagcagggtgctacaggacgctgtgccacagggatatcgtcagggacagaagctactctgccctctgctgctcacccctccaacacgctgtgggctgcatttgttgagtggctggtaccagactctgctcttctgactttccagctggttttacctgtagtaaagtttgagaagatgggtcatcctgaccccggggtcagaagacagaaggaggcccatggcgtgtgggggagatgccccgtgaggccctcggtgtgcagatgcctggtgacagccccaccctgaggtccccagcctaccccctccccagcccgactgctcccatccccctccctgtgcaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcag

SEQ ID NO: 139985 - DNA, 883 bp, Homo sapiens
aacatcaatgcggccaaatctagtttcctcccagaagatgaaaagagggagcttctcgacctgctctataaagcctatgggatgccaccttcagcctctgcaggtaggttcctgtctgggcttctgggcagttgccctgtcctggccccagtgtggctttctgtgggacttctagcaagatgcccttccattcttgggcagcgccatgaatgtgtgatgactccctggtttctgggccctggctgggagcagcgtctcattagatcggtttgttttctataaaagttcttgagaggctgttctaaggggagactttctgaagcccagtcccaaaggtctgggcagttggggacacctccatggctgcccaaagccaagggcagggagaggggcccaggcctgttctgctcctttcttcctatgtggtcttggcaaggcatcttcttgccatcataggaaggagttcctttctggttctggtgttctatgatttttacaacatcctgggtactacaagttgcctgatctttttgcttctctgaaccaacgagcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcagca

SEQ ID NO: 139986 - DNA, 1863 bp, Homo sapiens
accaagatacttggtagtgaccgggtgaagctgatggagagtctagtggttggagacattgcagagctaagaccaaaccaggtgggcccttttatttctgctctatgagttttcttagtcatgagccagcaaatgggctgagtccctacctcaggcttaggggcacagagatgagtcaaacacagcttctcagggcttgcagtcttggacagaatccctgagtcatttccagagacacagacatttgtagggaggggaatatcccagtcttactacatcaggctaggaggccagaaaccaaggttaatatgctgctctctggccatcccttctgcttaacccctctctattcaacatgtggtccctggccaggcgacgtgactcaaacacctgtaatcctggcacttggggaggccaaggcgggtggatcacctgaggtcaggagttcgagaccagcctggccaacatggcaaaacctcgtttctactaaaaacacaaaaattagccgggcgtggtggcgcgtgcttgtagtcccagctactcgggaggctgaggttgcagcaagctgaggttgcaccactgcactctggcctgggcaacagagtgagactcagtctaaaaagaaaaataacaacaacaaagtgtggtctctaaaccagcatctttggagcttgttaggaatatagtctcaggcactgctgcagacctgctgaatcagaaccttcattttaacaagatccccaggtgattcatgtgaccccctcaacctcaggctttttgtccatccagtggggaggctaaggaagttttttgggggcattgctatggagtacttaggagagcctgcgatcatcaagatgacctttgaagcttttgtcctgtgggttgccacatgggctaagtcgtcccaggtttgggtaggtgaagcagcaggtcctaggtgtcatagattaagtgtcagatgggactctcagtacagagtggggaggggtgcagaggttgcaccagatcagggaagcaccccaaggtagggaggggatgaaaacttacttgatgcatgaggatcaaagaccttggacttgggcccagacttgtaccttgcacaccctgagtccttcacattagggttcataaccttttggtaactaagtgggtccagggttgtgtctggctcacccttggccttgccctcctggacctggaagccaaaacgctccactttggtcctaggggacactgtcgctgtttaccaacgaggctggaggcatcttagatgacttgattgtaaccaatacttctgagggccacctgtatgtggtgtccaacgctggctgctgggagaaagatttggccctcatgcaggtataccccctctgtgttctagacaccttgtcttccttgttcatagagcagtatccttgttgtccaagacagggttggcacagacaagggacctggaaaatggctctttcagtgaatgaacagctatgagactcaagagcaggccctctctggagcacgccagggtttggtggtgggggattaccaggcatggggagggggtcttggcccctctggtgtgaggtggcagaactgggcttgggtcatctctatcacttagtagctatgtgaccttgtaagatgggaaccagcctactacctttttttttcctccctcctcctcctcctctccactgtcctactactgtccagctctgcagcgtccagcccatggtagctgctcagtaagtggccccagatgctcttgtgtttctgtcttttaggacaaggtcagggagcttcagaaccagggcagagatgtgggcctggaggtgttggataatgccctgctagctctgcaag

SEQ ID NO: 139987 - DNA, 36123 bp, Homo sapiens
gagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtatctcgccctccattgggcattctgggagtgtttgcttgcctgtccccaacattccatggtttgtttgagcctcagaatctgattttatgcacaggctctttgagaagggtcttgccaggggtgccttctggggcaggaaggcccctactgcctggcagacccatccagctttggactctggtcctgcgacccggaagtcaggctgccaagaggtccaggcagtggcctccactggggaggggctctggagagtttagagccctagatgtgggggttagggacatgaggtcttgtggacaaagcccactacctgattttgagacaacactcactagacatggtgacaagtcaaagatgccttgcctcctaccaggaatcacttcgcagggagcccgagggctgctgtggcctgctgaggagtgcagggcagttactttttccaaaaacaaagagaaatccaggcatgctctgagccagccctgagcccagcagtgagcaaggagagagctggagacaggggactttgctgtgaaacactggggggaatgtgcctgcatcaccccagctgggggcccaggcagagtgggggagaaggggtaagtgggcagagccagtcactttgggcatgcttccctctcgcctctgtgtgaaatgaccaggtcagcataaaccccgggctggctgtgcttctggcagagctaatgatgttaggaggaaaacaaccaacccaagtgagagggtgcgcagccagacagctggaccggccgaggccccaaccaagtcccagatctgcctgtcactggtgctatggcagcaatttggatgagaaatcctgcccaaagggccccttcaggccacccggggagaaggaagcggctgtctttggcatgaccagaaagatggctcggagctagggagaggtggacatgtgggctgtggagatctggcactttccccaaacaaggagagaaagcatagtgtgcctatgtgtgaatgtgctatgtgtgcatgtttgtgcctgtgcatacctgcatgtgtacatgcatgtgcacatatgtgtgcacagggaatcactttaataaaggccacagcagagctgtccctgagccccttgcattcacagtggcatgtgagtgaaccaccttcttaggctgggcatccagtctcagactctggggctgcccatgccccatcctttatctgctccacgtgtgaggggttgctggtcctgaccagggccagctgtgaaccccagaatcctgggaagtcactgacattcttgtcagggccaagagtggagcaaggcaatgcctcgggcacaaactttaaggggtcaccagaaacatcaatcatcaagatatatgctattttaaataatcaaaatgaatgcaaaaaaaatttatgatggacaacataccaaattctaaacaaaggcaggatgagtatcactggcttctgcacttttctccacccagtctacccctcttctagtgcctggatcgcagggtgccaaggcctggatgagggaagcgtggagctgcaatggccactcctgtctgcctgttctggctgcacagaggactcagtccttgtcttgggggaacctatcttggttttagggtcatcctaaggatctgatgttttccaagtgagctggctgtccaggcccacccaggttcagtccagtcctgtgtctctgggaagtgctgcccctaccccaagccagtgtttgaccttggagcaatgagcaatgccctccttccactttcaaagttgtccccaagacgtcagctgtggttgtctctgtgcagacaccgaggaggaactgtcttctttctccttttggttgctttggaggaaagtaaagtgttgctggtttccctctttctacttctttgattgagagcagccgtcttgccggtaccaaccttccagatcttacctgtggttgcaggagcctgtggcctcagtcctgtgcccagtgacttctccatgtggatgtcagctccttaggggcaagcctgattccactgacactactcccacccctcataagccccttcttaccagctgcagttgcctggtaccccaccatcgctgactcattcctttggcatcaaggttcatcccttactgggccaccacttctgggtggcctgaaatagggccctgggcatccctcttggggaccttttggtctatattttcactctcacctcactaaggacagatgagtaaatctggttaactttgcctgatagatttggtgaccttttttcaggaaggagcctggaaagatgagattcaggtgtattggtcagcttagactgccataagagaataccatccactgatggcttagaaacaacagaaatctatttctcactattctagaggctggacgtccaagatcagatgccagcatggtcaggttgcagggagggctctcttcctgacttgcagaccgccaccttcttgctgtgtcctcacatcgtggagagagagtgaaaacaagctctctggtgtctcttcttataagaatgctaatcctatgatgggggctccccctccttacctcatctaaacctaattatctcccaaaggtctcatctccagataccatcacactggggttagggctttgacatatgaatctggggggacacaattcaatctgtaacaccaggagggcatgccgggaggaactgaccttcctccctccagctgccctggacacctttgccccattgaaggagcaggctcagaagtggaatgaggatggaataaggtgcactccatcatgcttacccacatccctggcaggaattgtcctgggccccagcaggagagatgcccccccatactgccatggcacctgctctgagacaggtgtgcagagtgcaaagctccaggtggcccccaagcaggtgtgctgggaggaggggcccgtgtgggaggagcaggcagcgccaaggcctagcggagcagtgacaggtccctgacttcagggaatgggcacgctgtgggcaggcagctggtgtgggggtgagggctggggctgcatctgtgggaccagggctgggccatccatcatatgccgtgtcacaaccccagtgcccctgctgtagccaggacaggaggctgggccaggctgggaggtgacaagagtgggggctgtccccaggagaagcactctgctgcctgtgcccaggcctctggggatgaggacccctcagaaggagtagctatgtctaggaagccccagggcaggagcaagccaaaggggacatcattagtgagatccaggggatcagtgggccacagaagccccagcgtgagcccctctgactgatgcagctaggcccacacctgcacctgcccacagcaagacccccaggaggagaggggacagatggagagaggcacaaagtgcccctggcctctgccttgaagccaccccaaggcaagagagatttgagcccctgtttagtgacctccaggggaacattctggcccatctgatgtgggaagccccttgtggagtctgtcattcctcagctgagccaggcctttggaggcagcccaggcatgtcccctgtgtgctcctatccctgtgttgggacacctggcccagcccctccttctgcctttctcttcccttcccttctcaggagtggacacttcctcctttagccccctcacagctgtgtgaacttctctgtatctctctctttctgtctctttctccccctctctctctgtctcattgtctctctgtgtgtctgtctgtagtattctctctctgtctctgtcactctgtctctctctctctctgtgtctacctttctgtatttcgctttgtttctttttctctgtgtgtgtgtgtgtgtatctgtttttctcactctctctctgtgtctatctttctgtatttcgctttgtttctttttctgtgtgtgtgtgtgtgtatatctgtttttctcactctctcaatctctctctctctttctgtctctcttttgctggcctgagcaaagagggagccccatcctgatgctacataaccgtgaaccagcacagacagaattgtaggaaagtcctgcaagtagaaggatagaaggatgagggaagaaacgccatgtgagtcatgacagatccctttccaggagccactgactcaccctgcctcctgccctcccactgtgacactattactcacagacaggcccggattaaacctatgttccaggtgccctgtggttcccacagtgtggctccctgggtctggcctcaggctccacaggtgcccagccctgccaaagtctccagagcagctgtccagctggggagctgcggggccccttcacagagcgcatgggaagaagttccatcctacacattacatcgagagggacgtgcctgagaaggggagctggagcccgtgcagccccctgcttgcgtgcagaacatagtgtaccctgagcatgccatgaaaaacacaaacgcacaaagttgtaaagaaaaaagaaatgacaggtggctgtaaaatcagttatagcccacgagaggcccactaatgagtggtgatttcagctgattacaaagaaatgatggtgtttctgtaatgaactaaacatgcactcgtgcgtgcacacacgcgcacgtatagtcacataactgaccagccctatgcatcacttgttaattacttagtaactgtaacaataatagtttccaataagtgagccttagtctctgcgcaagggtcagtttattgagcacacgggggccttgcagtgggggcaggtgatctgctcctgggagccgccagcctctcctctcctgctcttcatcttcctccgtggtgggaaattgtctcactgcttctacacctgaggctgaacatctccctttatttcagtctgaaacacatgtaaaaatatactggaatgaattaaggttgcaattattgatatcaggcagtgagtacatcagggtttattatactatctcctttacttacttcgaagttctctattaccaaaaaattaaaaactataaaagaaagaaaaaggaaatgaggctagattcaacacagattactcttaccaaacccttcgtagtcccaggagtcccctaacacaagcacttgtgacctggagtgatattcacagcattccttacctggcaatacctgagtattagcccccccagtgggatctttgttgtagacaaccagcaactatcagcccagccaataaacaagtaggaaaggggagtgctggagaggccaagaagtgggattttccatgctcctgggctgtgatccagagggcacggctgtgaggctgatctcaatgaacactctgtcttggaagtacagggatcctctgctacctgaaaacgttctgagtattcactttcatggattgcaaagtcatttacccaaaattcactctccaaatgaaaagtgagtatgatgaatcagtattcaagttccacctgggtcctgggagagggcatggacatcatatcccagctgttccgacaggaggacccaatctgagtctcactgcctgcctgcatcgtttgtctgctgccagcctgcacagtaggaagggaaaacatgatttgtatctgttttaggtcaggttcccaagaagtagagcctgagattggaattcttggaaaatggtgtttgcgggagcgctgtcagcagaagctataaggaagttggggggacagaaaacgagaggtaagaagccagtcaaaaaggcaggtccagcttaagtccgcctcagtctggttccacaagggctctgatgcatgaagaatatcacagggttgtccctcctgggagaggggccagcctattgtacctgtatcaaagccaccagctgagggccagtggggagggaagatcttccaggcatttccaggaaactctcaggagaagggtgtagctgtgagcagtctgcagctgctgctcactgcggctaaaggctgggtgtgcaggccagtcagccagtgaggtgccaacagcaggcactacagtccaccccttgactgctcagacctactgctttccactttaagctctctccatccaggcacagcttcagggaaaacttacaattggagaaacagagggatgaactacaatgcccacttctgcatgtgattgtaagactgtcactgatactcaccatcatgccccatccccaccatccattctagtgtccccttccccttggctaacactgctggtctaggtgacttccctagagcaggagccaaacccttatccctgaggcatctgaatcctggattcctttatcaggctattgttgttgtaagttgtccattcccaattacaactggacatgagactaccaagaaacaccctggcaaatcatctgagtgcaagccatattcttcctgctccattatgtagcggtagtcctacctcctaatgacaagggtaaattgccacattttgctccttgtgccaggatggtaatacctttctctacctgcttggctactggcacaaggaagcacagcatgaccaggaggcaattgtagctgtacatttagtgaatgtgttaatgtatcacctggtggaaggaccccctctgagaaccaggacttctagacccacaaaacctaaagttgtgaatggcggaagcacaaatttcccaagtggatcatggagagtgatgaagagttcttggttcccaaacccacatattttacctttcaggaacatggcctcatcccatagccattagagtgcatattgcattctggaggagactgggccctcctcatgggtgtcatcttcaagatgacagctccactgtgcctccaagaggatgctccaccaccctatctgtgattccttggttagcaggacaggctgctgcactgagggtaggaaaggcaagtccattgatggctggaatacatgtcaatccaagtcaagagaaaatgccgccctttccaggttggaaggggcccgatttagccaacttgtcacccagtagtggctggttggtctcctccaggagcagtgttataccaggaattcagcaccagtcgctattgctggcagttcttacattcaacagcagcaaaactaggtcagccttgatgagagggaatgtatgcttctgggcacaggcatggcttccttctctgactccatgactatctatttctgagtgcatggtggccgacattcagctgcctgcccatcctatccacttggttattattgcctcttccacaagaagtggtttctggctgtcattaatgtctcatactttgtgcccactcacacaggtttagctctacaacttttccccatgccaccacttttccacaatcttctaatgttgctccttccaagctactgaagaacgagctaagctattcaccaatgtccatgagtctatatttaccttaggccacatctctctccacacaaagtgaataagcaggtgcaccctccaaaactctactaagaggatttcttctccccagtgtctttcagggccaccttgagtggggctgaagtacagcagaagtccatttccagcttgcatcaacattccaaactaacctatccatgatcaatgcatagatgggtttttccctcctccagcagctagacaaaagacaccccccaccaggaggccatatttgcatgtgggtgaaagagaggcacaggggccaatattcgtgcaacagtggtagatggcaggtgggtctgggccacctgtccctgcagcttatctgtgccatctggacctgctcaagcctgattccagatataccatttccatcttatgatggatggcttatgacctagtgggtctgacagcaccaaactcataatgggcagttatggccacatggtcacttaatgtcctatggtcagacactctgctgagtggcatgccaggaaatgctttacaagtggtgtttggttctctgctgcagatggcatgaccttggtccggagccctaggggtttggacagtgactcctgttggggcctaatctcacattccatgcagagtatcatcagatttgccaatcacatagcctaagggtcaggactgatccaaccagtttttgcagagatcaaactggagaatgaaaggttgatatgatgtgaccatcatatcacgtttttctctcttgaaaagtatgcagatgtctgaaagagacaagtgccccaggagaaaatgcatgccttcctcaggatcggcccccacctcccctcctggccacaaggagggtcaaatctcagcatggcccaacttggacctgtcaaggaagaagaaaaaaattgtatgccaaaggaactcagtctttggctaacaagtactagacatcctttaagtctttgagaatggtaataatttctgccatccctccagatttgtgtttttctgttttggctgggtgggaatgcagcattttcactttgcctttgttattacaaatgttgcttattctataaatcaaggaaccattgtaagggctcttctgatggttaagtatatccattccaatgatttattcgggatccaaggaaatgatttctgggtgaatacacagaactagtggatccaatttgagacatacctgggccagaactatatttgtcgtcttaccccaataagcctgcactctactaggacagccatgacagcactttgggaccctagatataagtgtgaattgctggctgggcatggtggctcacgcctgtaatcccagcattttgggaggctgaggcaggtagatcacctgaggtcaggagttgaagaccagcctggccaacacggtgaaaccccatctctactaaaaaatacaaaaattagctgggcgtggtggtgggtgcctgtaatcccagctactcgggaggctgaggcagggagaattgcttgaacccaggaggcggaggttgcagtgagccaaaatcacaccactgcactccagcctgggtgacagagcgagattccatctcaaaaaaagaaaaaaaaaagtgtgaattgctatgaaatcactatcaaaagatctgagtgttacccttactcagtgtggtcgaatataaatagccataggttcctgttatacacacttgctgtggtgctacagagtctttcctcatgggaacccagtccctctttcagtcaatgggttctggttcgagaactggctgaggtttggaaactgtgcctttccatcataactttccactggggtgactgaccttggccttctgttcatcctttctagcccctaagaatccaacactctattagccttctccttagacccctataagctaatcccttctagttgttagtctgaccttggtgcccaatatgataattattcccactttgcttctgatatgcttctaagtgctgcccctggtctctgcccttaagtgatctatcatccccactgccattagggggagaagctctgaaaaagagttgtctcccatcaactctggtctacaaaggacagccctactgagcctcagccatgtgcccgacaccagcagattctttacagcctgggaagcagagtgtcttccctgcctttccagggaacatagccagcttacaggctttttgatcttatagagtaggtcagttatattttgccccatttcttttatccttttgatcacttcctcttggcccaccatgtaaactcaagcatccctgcttcatttaatcgagctgttgctttttctaagctaccaagagcaaccccagcaatatatcagagccctctcttgggacccttgctagggtgttaaatcctgcatcataggagaatgcccccacatcagcaaagtccccttatcctcttgatatcccacctgccccagtccagcaccttcaggatctggtctcaatcacaggatccagcacctttgggactgttgcaagcataagatccagcacttttgggatctagtctcccacttcctgctagtacttgttagccaaagactgagttcctttggcatacaatttttttcttcttccttgacaggtccaagttgggccatgctgagatttgaccctccttgtggccaggaggggaggtaggggccgatcctgaggaaggcactcattttctcctggggcacttgtctctttcagacatctgcatacttttcaagagagaaaaggcctccttctcacagcaagactacttctgtagatgcaggtggctcgtgggaatctggcaattcaaaattctcaagtgtactcactagcacattagaaaaccagtagtacacatctctttccaaatcttcattcagtgacactatgtcagtagctggaaatgggccatggtgggtgtatttaaaccatgaaaatcagaaaatgctacaaaccagggcatcccgcatctctagacagcagattgttggccatttcccagcataccattgtgtatactccttcccatcagggccgtggcttgccttggtggaggactcagcccttgctgaagttctgctactgctcttacaattgagtcctatgcctggtctccagctctgcctgcctcactacaggagacaagcatctctttgaacactgccgagaagaccctctggctctcaggcttggctttaaatcgatagacctgagcctgccattttctcttttccatgcatcactccactgatccacaggtctcagtggcatagtccttcgggttagcatctcccccacaccctcggtgccagagacactgagtaagaaagtacctccctgtctacccccatccccgctccccacaggcagggccttggcgatccactgctgcaatgtgccagagactgtcagtactcctaccaccagtgaggtggcaaccagctgggaagtgatccaactccagagtcccgccctcataggctgatttctaggaccacccctggtatactgtgttaggttcttgaagcagagcctgagataaggattctggcacctgtgattgagtgggagggtgctctcaggatgagatggggtagaaataggcaaaggtacagattcagcagcagttgagcctcagtctgacccagcagggagctctcaaatgtgaatgacatcacagagttgtccctctgaggcaggggccagcctttgtgctcctacatgagtcagtcactggctggaggcccctggggaaaggctagggctgccagctttagcaaataaaaaattagggcactcagttaaattgaatttcagataaacaacaaattattttttagtatatgtcccaaattgtgcataacataatgtgttttctccgccagccctgggaagggcgtaacttcccaggtatttctaggtgaagtaactttgtagatcaggagtaagtcccaggaaagaagtccagctcttctcttcagccctgggcagctgggggtaggcacaggggcccagcaggcacccatagcatctcctacagcatctgaaatgaacagggtcatcacgtactacatacaaatgtacccactgctgagttcttcagggattatatcattaggtacttggtattttaaatacattacattatgcagaagtcctttgtggattgctatatttggagagttttgtgatattggggggattagatggagttttcagatgggcatcatacggtttttcatttaaaaccctagagtattgtaatcctagggagtgatcctgcgattagtaaattagctctccaatagattttcaatgtggttgcaaaggacatgcatgtggttcaccctcccaggaaatccagaagggcagcattggcctgagtggcctgagtttggctggttgggctggtaatgctggacaaagacaatgggtggaatggtttgcttccctcagtcctttcagacacagcccagcccaccacgtcaagccagtgggtgcatctgcaaccaatccccatgagaactgcagcctctcagaggtgggcaagttggcccgggtgggtcaggaggatcagatgttgaggaaatctttggattggaggcaggcagagcagggaagcatcgggtgattctatgacagacccagggctccaagctgcagttcaggaggggcactggcacggcctctgctcaactcccccttgagtgacatcaggtgaagtgccgacaacacagaaggcagcaaatgctgccagtcaggtctgcttcccaggacagccagttgctaacccttctccagcacagcactggattttggtcacctggctgggagctccacctccccagctgctgcctcacctgcttttccaaaccccaccctgtaaacggtaactacattttgtgcccactacgcctcgtttccatctctttggagcacctctcacgtggagctgaacagaacgacctgttaagcccaccgtgtctgttagggttgtctaggctgtatcagatacccaactaaaactggattcaccaacaggtattgtcaaagcacataagaaagagtccagaggcaggcagctctcagcctggtgtcaggctctgggtcagctttccagattctcttaaccttccccacatctgccagatgccgccacaggcacaggaggtacaaacaaacccaaaaatgttctggaaacaagaagggaaggggatccccaccatatctccccagaggccttccttctcacatctcactgtactgaagccagctctagcagaagacagcagggtgaatttgtccagggtattcagcccccagtgctgggtccattactacttgacccctgaataaaacagaggttccatgagcaagaaggaaggggaactggatgttagagggcaagaatgtatccatcccacccctaggagcacgcatggacaactgccccatttttgctcctattgcagcccaggggctagcccagagaccttgccagtgctgagtcacaagatgctgggaaagtgagaccagagcctggtcttggggaacagctcaaggccgcattggtctgcaggtcatagagcagctgctgagcagtgagagcccacgatgggccaggccctgggtcttggagacctgaatgagatagactgggttcctgttctcctgggcattgcctcttagagggcaaagacaattaacaataaacaaatagaacatgaagtgttttccgatagtgactgatatactttggatatttgtcctctccaaatctcatgttgaaatgtaattccttatgttggaggtggggcctggaaggaggtgtctgggtcatgggggcagatccctcatgaatggtttagtgccatccccttggtgatgagtgagttcacgtgagagctggttgtttgaaagagcctggccccctctcattctcctgctcccactcttgcatgagacacctgctcccccttctccttctgccatgattttaagattccagggacttcacaagaagcaaatgctaacgccatgcttcttgttctgtctgcaaaactgtaagccaattaaacctcttttctttgtaatttatccagtcttgggtatttctttataacagcacaagaacagcctaatacagtgatgctctccaagtgacctttgggctgagacctgaagaagaaggggaagcagttaggtctgatagctcatgcctgtaatcccagctctttaggaggctgaagtgggaggactgcttgagcctaggagttgaagaccagcttggaaaacatagcaagaccctggctctacaaaaatattttttaattggccaggtgtggtggtgcacacctgtagtcccacctacttggaaggctgaggcaggagcatctcttgagcccaggaggttgagactgcagtgagtcatgttcacaccactgcactccagcttgggtgacagagcaagacctgtctcgaaaaagaagaaagaagaaagtaggaagaagaagaagaagaagaagaagaagaagaagaagaagaagaagaagaagaagaagaagaagaagaggaagaggaacaagaacaagaagaagaacaagaagaacaagaagaagaacaaggagaacaagaagaagaataagaagaagaaggagaagaagaagaaggagaggaagaagaagaagaggaagaggaggaagaggaggaggaggaagatgaggaggaggaagcagaagcagaagaaaaagaaagaaaagaaagaaagagaaagaaagaaaagggaaggagggaaggaaggaaggaaggaaaaagggaaggaaagggaaggagagggagagggagaaggaagaacaaagaagaaagaaggagaagcagaggcttgtgctggatagccttgcttttgccaatgaccttgctgattttcagggggtcctggtgtcttagtccatttgtgttgctgtaaaggcatacctgaggctggataatttacagagaaaagaggtttatttggctgagagttctgcaggctctacaagaagcatggcaccaatgcctacttctgatgagggcctcagtctgcttccactcatggcagaaggtgaagcagagcctgcatgtgcagatatcacatggtgagagaggaagcacgagggggcagggaggtgccagcctcttcctaatagtaagctgtcttgagaactaatagagtaagaaataactcacaccctgcccccaaggaagggcattaatctattcatgaagtatctgcccccatgacccaaacatctcccattaggccccccacctccaacattgaggatcaaatttcaacatgaggttccggtgggcaaacatccagctataatactgggcaatgctgaccagactcttcccctctcaggcccagagctccttggccctgtaacaacagaaaattgcgtttgagtgtcaagatttttcctttagtccccatgcagctccttagaatgaggtggcatcttctcccttttcataggtgaagaaacagaagctctggaggaacgaatcattcatccaaggtcaggtagctagtaagcgtcccaccagctccccagatctcctgtttcctgtcccaagtcccactgagtgagctggaacaatggcttcactggcacctgccgggaatggtggcaggtgcctataatcccagctactcgggaggctgaggcatgagaatcacttgaacccgggaggcagaggttgcagcgagccaagatcacaccactgcactccagcctggataacaaacggagattccatttaaaaaaattaacatataatatacatacagtaacattcactttttaagtgtacagtttgatgagttttatcaaatgtatatggttatataaccaccatcaccattaaggcagaatcttcccatcactcaaataattccctcagccccacctcttgctgtcaatcacttctcccaccctagccactggaaatcattcatctgttttctgtccccttggttttgccttttctagaatgttctatacatgagaccactgagaatatagtcttctgtgtctggcttctttcacttaacataatgcctagctcagcagtgtgtcaatcctccctcccttgccattgctgagcagtgagtattccactgtatggctgtgctacggtgtgttcatccatttattcattcaccagctaatgggcatttggattgtttccaggctttggctatgatgagtgaagctgctgtgaatgttcaagtacaagtctttgtgtagacaggggttttcaattggcgggataaatacctaggagtagtatcgtgtggttaagcgtacgtttaaacttagaaaaactgtcaaactgttttccaatgtggcctgtaccatgttgcatttccatcagcagtgtttgagaattccaattgctccacatcctcctcccgacacttggtttcacccatcttttaaatattagccactctggtgactgtgtagtgatatgtcagtgtggttgtaatttgcatttctatgattgactaataataatgttgcagatatttctgtatgcttagtgggcatttttggtgagtttttaaaaattgggttgttgtcaccgtcttattgagttggaagaattctttatatgttctggatgtttattcatgtgtgtgtctgctaagaggtgagactggttctaccctggtcctaacaagcaccctgggcctgcatccctttttgtgtctgtgagctgggtctgcagccctctcctcccactacctactgcccagcagtacccctcacccatcactgtggctcctgcaatgacatctcagcctgtctctccctccctccagctagccagaggcaggatggctcagtgacacagggtgggccctgaagacagagtgccagggtttggaccttgtattagcaagagtcacaagggaaacttactttatctctccatagctctgttgtgaggatccaataaattaatccatagaagagcttaggacagcacctggcacaaagtatacatgagctattatgatgttattcttccaacccattgtttctgtgttgtcataaacatgaatgcaggactcagtgtcccagctctgtgtccctcgcatacattccctaacagcccacaggtcttgcctgtcaccgcctcattcaataagtgatgactctgcctcttccttggctggggccttgcattggacatttctgtatccatatttgttttttaaaaactagctgttggccgggcgcggtggctcacatctctaatcccagcacttgggaggcagagacaggtggatcatgaggtcaggagttcaaggccagcctggccaacatggtgaaaccccatctgtacaaaaaatacgaaaattagctgggcgtggtggcatgcacctgtaatcccagctacttgggaggctgaagcaggagaatcgcttgaacctgggaggcagaggttgtagtgagccaatatagcgccactgcactccagcctgggcaacacagcaaaactccatctcaaaaaaaaaaaaaacaaaaaacaacctagctggacttgacactcttgttagaggaagatttttccacatctgttaacttttcttctattgttatccatctgtgcaggtttttctgtcctcctgagtcattttgataatttatattatattttgaaaatcatccatttcctatagttgtttattagtgtcttctctgttatatttgatcagattaccaaatcttgctcattgattgcccatttattttattgtgtttatttttttgagacagggtctcactcgacagcccaggctgaagtgcagtggtgcaatcatggctcactgcagccttgacctcctgggctcaagcaattctcccacctcagcctcctgagtagctgggacctcaggcacacgccaccacagctggctaatattttatttatttatttatttatttatttttgtagagatggggtctcactatgttgcccaggctggtttcaaactccttggttcaagtgatcctcctgcctcagcttcccaaagtactgggattacaggagtgagccaccatgcccagcccctatttactttatagtaagtgccttcatgggcataaatgttcctctgagacagctttggctattagccatacttttaatattttgtacattcatggttattcatttataaatggtctgtaatgcaatgcagatttcccctttggcccaaatgccatttacagcagcacttttctctttctgagcagacagaatattttggtttcccctctgttgtttatttctcgtctgcctcgcctcatttgctaggtgttcccttggtgtgccttaagtatgagccactcaaatatttgtgtttctctaaacacccctgacactgtcctgctggtttctctatctggaatatccttcccttcttggccagttccccctagtgcatcaaagaaatcctgctcttttgccttcagaaaacaaaacaaaacgaaacctatcagtctccttatgtccccaaagacatagctttgctggtatctggttgtattgagctgttcatttgtctcttctgctagatggtaagctccttggaaactaaaaactaatcacttttctaacttcagactgagcacaaattaggttctcaagaaacattgaataatgagtgatccggtatccccttccaacatatttttggtcattgataccatcattctgagtagttactagggaacacttcactgcagtaaccaatacagcaaaacgtgaaatacagttacatagtagaattgtatttcttgcccatataatagtcaagtgcagttcttcatcagctgggaggttctcctccacacagtcatttaggaatccagggaacatagcagaggttgctagctctagacccaaacccatgtcctctttgtccacagtgaggacaatgccagcaacagctggccagctgttctgtagttctcagcctccctcgcagtgagatgtctccatgcaatttcagtggagcaacatataccatttccatttccaggtgtaggctcctaagaagagggtggcttcttcatgttctttctcacctttccgtaggctagctgcagataatgatgaggctttagggagtgggtggagccataaagtagaagcctggattcctaaatgacggtgtgaagtgttccctaatttcacgtaattgtttcttaatttcctgtttgggttatttgttgctaaggtataaaaaaaccctgatttttgtgtgttgatatttgtgtgctgcaactttgctgaattagcttattagctcaatttgatctcagatattagctcaaatattttgggagattatttatggttatctacataagatcatgtcatctgaaataaagatagttctatttccttctttctatcttagtccatttgggctgctgtaacaaaatgccataaattggaggctgagaagtccaagatcaaggcccaagctaattcactgtctgatgaaggcctgctttctggttcatacatggcaccttctagctgtgtcctcacatggtggaaaaggcaaggtagctctctgggattcctttttgtttgtttgtttgttttgttgtttttgtttgattttttgagacagagtctcactctgtcaccaggctggagtgcagtggcacaatctcggctcattgcaacctctgactccctggttcaaacgattctcctgcctcagcctcctgagtagctgggattacaggtacccatcaccatgtccagctactttttgtatttttagtagagacagggtttcaccatgttggccaggatggtctcgatctcttgacctcgtgatctgcccaccttggcctcccaaagtgctgggattacaggcatgagccaccgtgcctgtcctccggtattctttttataagggctctttttctttttatgtgggctctaccctcatgacctagcaccttctaaggccccacctcttaatatcatcacacagcagatttaatatatgaattttgaggggacacattctttccatagcactttccagtatggataccttttatttatttttcttccctaattgctttggttagaaatgtcttccctaattgctccactactatgttgaaaagaagtggcaaaagtgggtattcttgtcttgctcctctcttaggaagaaagtttaagtcttttgccattaaatatgacgttagctatggggttttcatatatgacatttatcatgttgaggaaattttcttcttgtttcaatgatgacagggtgttgagttttgtcagatgctttttctgcatcaatcaatatgaccatgtagtttctttgttttattccattattgtagtacattacattaatttttgcatgttgaactattcttgtgttcctgggataaatttcacttggttatggtgtataatccataaccataacctgaagatatgctgaagaggctaagtgccatggctcatgcctgtaattccaacactttgggaggctggtgtgggaggatcacctgaaatcaggagttttagaagagcctgggcaagtaaacaagatcccatctctacaaaaaattgaaaattaccgctgggcatggtggctcacgcctgtaatcccagcactttgggtggccgaggcaggcagatcacctgaggtcgggagttctagaccagcctgaccaacatagaaaaaccccgtctctactgaaaatacagaattagccaggcgtggtggcacatgcctgtaatcccagctactcaggaggctgaggcaggaaaatcacttgaacctgggagacggaggttgcagcgagccaagatcatgccattgcactccagcctgggcaacaagagcaaatctccgtctcaaaaaaaaaaaaaagaaaagaaagaaagaaagaaaagaaaagaaagaaaattagcttgatgtggtggttgtgcacctttagtcctagctactcaggaggctgaggcaggaggattgtttgagcccaggaggttgaggctgcagtgagccatgattgcaccactgcactccagcctgagcaacaaagtaagacctcatcactaaaaacaaattttttaatactgaagaattttatttgctggtattttgttgaggattttgcatctatattcacaagaaatattactctgtagtttttcttcttgtagtatctttgtctggtttcagtatcaaggcaatgctggcctcatgagatcaatcaggaagtgttacttcctcttttattttttggaagaatttgagagaattggtgttaattcttctttaaatggttggtagaattaccagtgtagacatctggtcctgggattttctttgttgggaggttttttagtactaattccatttccttacttgttattagtctaatgagattttctgtttcttcttgagctagttgtagtagctcatgtgtggaatttttctatttcatctaagttatccaagtttacctaagttaaagttccattttatctaacttgggtaagccaacaaacaatactaaattgttcatagtattctctcatagtcctttttttctctaaagtcagtaataacgttcactctttcattttttcattcctgattttaataatctgagttctttctctccccctccctgcaattgagagtcatttaaaagtgtcttgattaaattttatatatctgtgagttttccagttttccctctgttattctcttctagttttatttcatgtgatccaaaaagatactttatatgatttcaatttttttacatttactaagacttgttttgtgactaaaatatccttgagaatttccatgcacatttgagaaaaatgcacattctgctgttgttggacagagtgttctgtatatgtctgttaggtctaattggtttagagtattgttctagtcctctctttccttattgatcttctgtctagttgtttaatccattattcaaagtagtggccgggcacggtggctcacacctgtaatcccagcactttgggaggccgaggagggtggatcacaatgtcaggaggttgagaccagcctggccaacatggtgaaactccgtctctactgaaaatacaaaaaatttgctggacatggtggcacacgcctgtaatcccagctactcaggaggccaaggcaggagaatcacttgaacccaggaggcagaagttgcagtgagctgagatcgcaccattgcactgcagcctgggcaacagagcaagactctgtctcgagaaacaacaaaaacaaaaacaaaaaacaaagtagtgtactaaagtctccaactactattgtagaactctatttctcccttcaatgttgcaaaattttgtttcatgtattttggtgttctgttctttataatttttatatcttcttaatggatgaaaacttttatcaacatataatgttctttgtctcttgagacttttttttttaacttaaaatctatttgggctgataatacagccaccacaactctcatattggttgttattttcatagaatatcttcttccatccttctactttaaaattcttctatctttatatctaaagtgagcctcttgtagatagcatataggtggataatgttctctttattcactctgccaatatctgccttttaactggagtttaatctatttatatataaaataattactgattaggaaggacttacttctaccactcagctattttttttctgtgtgtcttatacatttttaagtttctcaattcctccattactggatttttttttttacttcttgattttgtgtctgtgttgttacattttgattattttctccttttgatagcggcaggaggcagccaaatgcctggcagatagaagcttgtcccccatgaaaccccaccttcaagccaaaaaatagcctgaaggctgaaagaccggactgctggtcccagatgaaacccatgatccagagtgagaacttccattcctgtttgcctgccctctaaataatcccttttaaccaatcgaatgttgccttttccaatactacctatggcctgcccctcccccattctgagcccataaaagccctggaatcagccacattgggggcactttgccaacttcaggtagggggaccacctctgtatcccttctctgctgaaagctgttttcatcactcaatgaaactctcaccttgctccctctttgattgtcagcgtatcctcatttttcttgggtgtggtacaagaactcgggaaccagtgcacaagccagacttggtctgggcagcacgggttagtgggccatctcccacagcaggtagcatggccaagtgaggcctgggcagggcatcaccaaggtccctggcttgcaaagtgaccaaggaaaaaatcctgtgtcactttccttttctcatattttttagttattttcctaatgattgccttgaggatggcaattaacatcttacacttataagaagctagtttgaataatagttccaatagtacatgaacactctactcctatatatctccatccttcttcctttatattgttattcccacaaattatgtttttatacattatatcctcactaacataaacttattattattttctgcatttgccttttaaatcatacaggaaaacaagaatcacaaagaaaaactacattaatatttgctgttatatttacctatatagtgacatttaacagtgtatttttatgtcttcagatgtctttgaattactacttagtgtcttttcattttagcctcaatgtttccctttagcatttcctatagggcaggcctgccggtaattaattccctttggttttctttatctgaaatgtctaatttcttttttattcttgaagaatagttttgctggctataagattcttagttaatagtttttttcccagcacttcaattattattaaagtgttattattattattattattattttgagatggagtctccctctgtcactcaggctggagtgcagtggcgcaatctctgctcactgcaacctccgcctcccaggttcaagcaattctcctgcctcagcctcccgagttagctgggattacaggtgcccgccaccatgcccagctaatttttgtatttttagtagagacggggtttcaccatgttggtcaggctgatcttgaactcctgacctcaagtgatacacccaccttggcctcccaaagtgctgggattagaggcatgagccaccatgcctggtctaaagtgtaattattattacagctgccatttggcctccttggtttctaatgagaaatcatctgttaaacttattgcaaatccttggtatgtatgctatgtgtcatttctctcttgctgcttccaagattctctctctgtctttgtcttttgacaatttgactataatgtgtttcagtgtgaatttcttagagtttatcccacttggatttcattgagcttcttggatgtgtacgtttgtctttcaccaaatctgggaaattatttcaccatttctcaaatatctttttcttcccctttccatctctcttcttctggagctcccgtatacttagttggcatgactgatggtatcctactggtccctcaggttctgttcatttttcttctttctttttttctgctctgcagactggataacttcaatcgccttttcttcaagttcaatgattatttcttctgcctgctcaaattggccatttaacccctccagtgactttttcatttcagtattgtacttttcagatccagaatttctatttggttcctctttaataaattctttttattgtcattccccatctgttcatacattgctctcccaatttcctgtagttctttgtccatggttttctttagttaattaagcatatttaagacagttgacttaatgtctttgactagtaattccaatgtctaaaattccttatggatagcttcttttaaattatttttgtcctgttagagagtcatatcttcctctttatttgctttgtaatactttgttgaaaacttaacattttgagtagtaaaatgtggtaattctgaagccagattctccccctcctttgagattggttttgttgtttgttgagggctgcagttgtccatttgtatagtgacttttccaaacgatttttgcaaagtatgtattctctcttgtgtctggtcactgacgtttctgttctggtgcctctgcagtcagcctatgacctggaagagcattccttaaatgcatagatttttttaaaacccaagaaacaaaaaacctagcatgtatgtacctttttaaaaatcttctgatagatgccacctggaaggctgctgctgcctgaaggggcagaaacaaaggcaagctctactctgagccctcagggaaccaccagataaacaaaagaaatttgattctccaaatttctggaagacaaggtcctttctgcccactcctgctccagccagctgctctaggaacacaattactgtccacatggccacaggaatgttgaagaatgcaggatggtagctggtttgcccacaccactcacttatgagccatcagcatgcctctcccttcatcgagcactcccatggttgctgtaagtgtccaatcaggttccagaattctgaaagagttgactcttacaggatttttttcttttctaacttgctggttgtttagatagaggaaccaattcctgaagtttcctacgttgccagcttcatgaggatcattccctagtaactcttttcagacaaaaagcttcattgatttactgtaggactagcatcaaagagtctatgccacctagtctgtctccttaaaacacagaaataatcagtatgcattggggtaggagtttggcattagatctgccgtaaatcaagagctggggacagcccatgtcttaaactctgacccaagggctaaaatatcctttggtagcaacaacagctacaaactattgaacaacttgtatgtgccaagagccttacctgcattatcccattgaatcctctcaacagccctgtgaggtagtagaattgttgcctgccccttactgaggcctagaaacattaaggaatttgcccgaggccctagagccagtgagtggcaaagccagtctccagactcaggctggagatcctacagttctgtgttaccccagtgttatcctgcctctcagcacagagtcttggatgattctcctaacccctccctaggcaatgcacagggctgctccctgcacccttactcatgctctgctcttcaaccccaacagtgctggccttaggctttatccctgacacccagccccaggctccattccatctgttgacagaggcaaacactggggcaaaactgacctctgtggataccactgtgtccacctccaccagcttcagctgaagcctctgaacatctccagcatggaagaagccccaaaggatatttcctgtcccccagcatatgcttgaccctgaagccctccccatctagtcaagaagaccaaactgttaacaatcctggagtcagagtgacccatgggtgaatcttagccaagtcactcatagctgttgcatcctagtaaatcccttaactcccataggcttcagtttccctgcatataaaatgacagccttcagctcatcggccagtttcaatccatctaaagggtctagcacatcccctggcatgtggaagccacagggcacacactagttgtggtcatttgatcctggcatgctctgctgtctctcggctctccccttgcctctttccctgatgtcctggccatcagccactgcctaacaccctcccactcaccaggcccttagcctgccccttagcacaagagcacagccggtctcaagtctaccctgctgtaagcaaacacttgcaacatcatgctgacctccaggccctgttgcatcagcgtgcccacacttggtgcccagctggtactgagggtatcagggaacaggccagtggtggaagggcggacactttgggttccctggtttcctggctcccaatatctttcccaatggcatatggggtctagcagcttggctcatttaactgtgaacctctaccctttagaatctgggcctccaggcttgcttctgtgcaaaatggcagataaggctcaacctttctttttttaacttcattgttaaatattactccattaatacccatttactgcagaaaaggtaggaaatacagataagcaaaaaggaaaataaattaaaatcctcataccaccatcatcaagataattactgtcaccattttggtatatttcctcccaatacatatattatctatatcgtatatacgacaaaaatggatcatactatgtttcctgttcttcccctgtgttagtcatctattgctgtataacaaactgcctcaaaacttagtggcttcacctttccgtgtattatgatgacaagaatgtggtatgacactgtcttatatctggatcatatgctaaaagatagaaaatggtttctaaacttatttgttctgtaataacaaaattttatttcataaagtgtttttaaaaaaaaccatagtagcttgaaacaacaaacctttgttatctcacacagtttctgtaggtcaagaattcagaagcagcttagctgggtggtctggcttggtgtctctcctgaggtcagggttttggctggggctgcatcacctgaaggcttgactggggccagaggagctgcttccaaagtggtccactcacatggctggcaagttggagttgcgtattggcaagagacttcgcttcttctcaatggatcttcccagagttcttgtaggcaacctcatagcatagcagttggcttcccccagagggaacagtccaggagagaacaaggcagaaaccacagggtcttttctggcttaggctccaaagtcatactccaccatttctgcattatcatattagttacacaggctagacctattctgcatggaagagactataccatggggtgaataccagaagcagggctaattgaaggccagcttcaagggcggctacacattccctttcaacagtatgtcatgaacatctttccatgccaatagagcagatgaatcttaccatttttaatgactacatgtaagtgtagcataatttatttaaccaacctcctgtagttgggtatgtgggttgtgtctcgttttttgatagtagaattaatcatcttgaatatccatcaccaaacttgtcatattattttcttttgatgaatgaaaaagaaaatcaagtcatgtctgtcaatcagaaccctgagcaactaagaaatgggggtaccactgggacatagagcaaggtcccttctgattctgctcttgtctttctctccccatgaaatggggagttcactatctactgagacatcctagcccacagctgcacagttctgtctttttagaaagctctaagcagaaacaatgttcatccatcctcctcgggacagcccttgagctactgaagactctaagcatgtcctggtcatcctccatgagccatcatctctgaggccctccccttcttggcccctcttctctggacaggttctggacagtcttgcccttccaaaattcctggaaagcaggaactgttcctgctacaatgactctcaactccagtgcagtacagactgttggtgtcaccccttatcctgaagaagaggcactgagacaggacaagggtgggtgcccaggagggctggcatgagtcatgagaatctggtcccggagaattagacggtgtggggaagtaggggtgttgggccgctttctggcctcatggatgccaatgaatatcagcaggtggctcccagaaaggaactctaggggatgcctgttgctctaaatagaggctagagagggcactggcagttcagtcaaccaagaaagggggcccacttgcctcagcttcaggctttgtacacatcctcagcctttcttgagaactgaatttagattctcctcccctgtgctgtgtgcttggcccagaagaagggcaagtctcgctgggtggctgcttcttggcctggctgaaccagaaggccccagtgccactccaaacctgggtgtgagccctgcccccatgagcaaacagtagctcagagctgggggctgtgggggtcagtggcctgtcacatgagatctgatgaggccatctctgctctatattgggaaagggatcaattgtatcaagggctttcttgggagtgatcactctggccattggcgagagacctggcattctgacaaggcaccctccataccctgacccacttgccagctccagctaattttagcaggctttggcaggtgccagcaagtacatagcatgtggatgtcactcccaggtgagcccaaggagaggcctgggccagagcctggaagtcatggtctatgcccatggaggcacccaaagcaagcctgaggcctggactttgcagtcacaaaattaagaatgatacccctgttttttgtttgtttttgatcagttggccaccttcctccaccaccccttccccaagttccatacagacccctggattgtatgaaatgcaaatcgaacctctctgcagatgaaaatccactggggatccccttgcctccaagagcaagtccagacctgcaccagcgcgggccaggcccccttaggaccccctccctgtccaagggcatttcagtaagtgttctgtggccaaggcagcctggtgactttctgcccgcacaaggctgaggaatggaagatgggtaggctggctctgcacaccccctcctgctgggcagcaatccctaccccatgttcacagagtgtggccggctgccccatggctctgtccccgtggccctgtcaactgttacccacatggcctaccctccctttctgccctgcctctgaccccatggcagggggcagagtatttgagcagccgccaggctgagccctttcagtgcagaagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctggtaagggtcacaccaaagttagggactttgcactgggagagcagcacccagggcagggcccttggttttgcagattaccaaaactaaggctgggggcagggaaggcgagcaggcttggggcaccttggaaggaggcacatgggccttgggggtcctggctagggcagctgtgcctgccactggccctctgcccaccacccctcctcactgtggctatccagtgtccagcctctcgaggggttctagggtacttattcctggagctaacggtgacccaggacaccagtgtccggggcctggcctggggcttttatggggggagctggctggctgcccagggctgtctggctctctgggggctctgcatggcatttccaggggttggtggatcagggattctgtccctcaggagaatgtgggcactagcccaaggccactcacttctgtgtacatagccacctgagggcccaggaatggagggggccaggctacagctggacatctggcactcggatgggctctggagcccccaggcctgcagcatctgcccagggactgccctggcccttggccatttcctcagggacccacagctccaccagccggcccctcccagtgctggaatagacagttcctcagtccacatctgccaaaggcggcactagaaggcatcctgccttttttactgcgttctggaggtggggtcacaaagcactgctcactgcataaaagggacagcatcctgcccctggcagccctgcctgaccagctccgcctctcccactgctatccaacctgtacaccctggtgaccatgtccaggccagtggccttaaggactgtctctgtactgatggctccacatctacctctccagccagactctcctctgaactcgggcctcacatggccaactgctacttggaacaaatcgccccttggctggcagatgtgttaacatgcccagaccaagatcccaactcccacaacccaactcccaggtcagatggaacctcttcttcccaggcccttctgttcctctcctcagcccctcccacctcccttcagaataagtctagactcttatcgctttcaccaagcctgcgcccagcatccctgcacagggattgttaggacagcctgacgccctgcttccaccctgccccaagatgcccctgctctgcagcccggcgcctccaggcttctcacctcctgctgctcacagctcagcctcactccctccctccccgcctctgctccagcctcagtgcaggtcccctgctcccatcttctggcagcagctgcccgacctggtccctcttcatctgtccccattccttcaccccccagcctgtccccaacttgactgaggttctttcctgcagatccccgcccttgagaggggttggtcccactgtcaactctgcttctgtgccctgtgccgcacctggcattcagtgagcatctgctgaagagatgagggtcagatgccctgcagggagtgtgggggcgtcctcaggcaagaaaagttgtacgtttggctgtgggccctgattatgtgtcctgtgacctcttgggtgaggtcagcaagagaaacctctgcaagctggctggggctgcctcccagaggctgccagggggagggacaggctctgtctgtgctcttcttccgaggctacacctggggcgccaggctctcagggctccccaggtaccaccacatttcctacactgcttgggaaagccctgtaagtttgcacagacacccagcatgaggctcgccagagagatacttgtagctggggtctgggcaccaggaacagcttggtgctgggcctgaagtcgggcaggatgcagcctggccaggtgagaggaaagcttggagccagtgcctgggttcaaactcctctgtggcctatggttctgtgggcttggggaagggtttgtacctctgtgtccagtttcctcacttataaaaaaaggagataataaaagtacccatgtcccagggtggctgtagcaataatagggaggggtgcccagagcaggtctggcacacaggaagtgtgcatcagcctcagtccctgccattgggcttgtcctgggagtctgtgaagccaacctctgctccacaatgtgacccccaggcttgtgagaccaagctgggtcagagcttcctcctctggggttgcaccaggaggggaacttctgcaggcccagatgcaccctgaggaaagggcttgttcccaccaagaacaaggctcacctttggaggatgctccccacatgagaggtgaacccccaggtctactggtgactgcagcctcggaagctgacagcatctatcctccaacccatgcccactgggaagtgtgtgaggggtcctcataggccctgcggtgtggacaatgcagagaccctgtagcatctggctagggcggggcccagataagagccctgtgccaggagagcctggccggttctgccactgtggggagacaggctcccccaccccatgtcccctgcttccctgcagcccacagagaatacagacctacttttacagaaatccagatttttgtgtaaaagtgtctctattttaagtagattttaagtggtggcagcaaatttaagcttttgagaatattatacagaacaaatcagattcacaggccagatgcaactttatttacagaaatgggatcaggtcctacctcaggtcccatctcacgttttcacttatgcctatacgtctccttcacgggaaaggccacaagaggccctgcggtaagtgtcccggtgttgatttaaagtccccaacagtgaatatgagggtcctcactgttgcagcaagaggatacccccctgtgtatcttggaaatgcctgcagccctcttgctgcagaacagattcttaggagagaaactgtcagatcaaagttaaacttagagaaactccaaattgccctctgaacagacggtatcagtttgacatcatccaataccgggattcctcggggagaactttctggcctagaaggcagtagagccaggacttcacccagtcagtggcagggccacacgtgggccttgatacagagggggaagacttgagcctcctcgacaccctacagggcccagcctcccaacatgtgataagagaaacaacagccaacttgtacctagctctccttattctccaagggctgggccagttctccccacagccctgcaagggaggatcactcaagggccccaactgtctgacaatacagccacactctgatcagccacctgggcataggctccatgccattgtcctccgccaagacctcagactgaaatgttggctcctcccatgaagaacctggggccaaaggaccagagtccaggtccgtggctgccaggatgggccacttggagagaggcacaagggtggtgccaggcaggtgtgagggctggacctttgcaagagcagcatcacttttgttgagagcccacaggtatcttataattgggtcctaggacttcctgccagtagccattgtgtgcatggatttgggtgctggcctcaccatggtgtgctggctgcccatgcctgcaataatgacttctgtaagcctttcttcatctgcaagatgggtgctgctggcacctcctccccggtgctgtggtgacagggcatagtgtgtgaggctgctatgtgaagcacctaatgcagggcctggcatatggaggaattcagcaaatgacagatgccttcacagttagttcctggcatcctctacattggtgggtgtaggaaagaaagacagaggaggcaaaagttgtagctgtggggcattgaggacagcctggattgttccacagagccctgaggacatctccaggggtgtgctctgcaggggcagctggattggagggttaggggtcggggagggcgtgcactcccacccatgctcacagcctcggaacagtgcctgctcagccaacatgggtgtttgattctgtgtcttttgtcacagactttatcagccccatccctttctgaccttgcctcagtttaaattttacatgtggggcctcattaagagacatggttcttaactaaagatctgtatccattaggaatgctttgggctgcaggaagacaaacacctgactcactgtggcataagtggtttgcgtctgctcccataagctgcacgtggagggtggatctggcattactctctcttccctacatttgcagtatgctaacagctttaacctccagccttgtttcttcatggttgcagggtggctatcacagcgctggccatcacatccttacacagctgtgtttacaaatttagggggacattgaagctcctcccctgctaaaatcaggcttcccttcacctgtcattggccagaactgggtgaaatgcccaactctagaccgatcatcagtaagaggagtatagaattgctgtgcccaccttagattaatcatggcgcaatgtgctccccataccaacaaaatctgagttctagaaactgaggaagaagaggaaaatggccgtcttgcctcctggctgggattcagagcatctccaaccctctgagcttatgtgtaagactgtgggcaaaagtgtgtgagtttttgtggaatggatccacggcttttatcagagcatctttcctttttctttttgattcaagatgaaaatattcttatgattatttttctcaccactgcccagagataaccagcacattaacatggccttttctccatgaatagcactagggtgcccagtggacagacacatagctgtccacacaccagcttgctggggatgcataggcagagtcacatctgcactcacggcctgtcctcacactgccatgtggagagccagcagccacaccatgggccgtccatgctcacgggagtggcagtatcagatctgagcttcgtgtgcccaggcgtctctcacatcagtgcatagggaccctctttgttctgtggcccagtgtgcccatgccacagatggcttcagtcagcagacacctccttctagacactcacactcactcctggctggcccttagcacacctgtgcagacaggcccatttattttcttgtgtaaatcccaagtaggaggactgggtctctctgacagcaatgccagctgcctggcaccctccagacaggtggctcaagccccacctcgccagctctcccagttagcccctcctttccctggctctgacctgagggacgaagcagggtgctacaggacgctgtgccacagggatatcgtcagggacagaagctactctgccctctgctgctcacccctccaacacgctgtgggctgcatttgttgagtggctggtaccagactctgctcttctgactttccagctggttttacctgtagtaaagtttgagaagatgggtcatcctgaccccggggtcagaagacagaaggaggcccatggcgtgtgggggagatgccccgtgaggccctcggtgtgcagatgcctggtgacagccccaccctgaggtccccagcctaccccctccccagcccgactgctcccatccccctccctgtgcaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcag

SEQ ID NO: 139988 - DNA, 257 bp, Homo sapiens
gaggcagcctggaaggtgacagatgaatgcatccaaatcatggggggtatgggcttcatgaaggtacaggacggtcttctgcagagcctcggctgggccaggggtgggtaggcacatctcagcacgggcatataatttgtgtggccctgtgctaggaacctggagtagagcgtgtgctccgagatcttcgcatcttccggatctttgaggggacaaatgacattcttcggctgtttgtggctctgcagggctgtatg

SEQ ID NO: 139989 - DNA, 5089 bp, Homo sapiens
gtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagaggtgagcggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaaggttggtttattctgcattctcttggacggggcctggggacaccgtggcgcttctatgggatggcaagtgttgacagggtgctcttcctctcctaccccaggatcaggttcattccccattgttgtcagaaaggtcagttgtctggggtacaaatattaaactgccctttacgatattgccttctgaaggaagtgttcaaatctttgcttatgccaagtgctgttttgtacctggaaggtttcacagagctagtgagactgtcatatatgcagaattccaccctcttgtttcacacagcattcctctcccatcccagtccaggttctctgtaacatcacattctctggtgactttttagacagcttgtttggatccgtcttcagaaaatagccacattgaatagtaaatggaagttggttaggatggattgctaaatatagatcatagcttacctcataaagaacaagatgagcttgataagagagtaatgaggcattaagattcaaagctgaggtttcagctagagaattcaggaagccgcatgagatagaccacacttgattttaagagccagccacatcccttgtggaaagattacaagcagtaaggctgtaacattgtagaggtgagagtgagttagtttgttgtaagaagtgggcttatctcacctgtgcatttttacctttgactccagagcatatgaaacagtacagggttgagctgtcataaagcatgactttgtatctgacctcgcaataattattggaacacactgattagcaaagaaaagcaaactgttggcaatgaagaagtttctaattcctggaacatgctcctttgatatggtgatgcattttctgaaacatgccttacacacctccttactagcttttgaaatctgcattgcacaggcgaatatcatgggcatggggtttggcaacccgggggttaagcaatgtcaggctgacgctattcgtgtaaccagcacaggtgcagggttttagtgctgtagcagccaatcaggggcagacagtgtgggttgagtcatattttccgtttacagaaccaatgggtattttacataacgacagggaggtcacgctgaggacatactgaagttagcacatgtatactacactccagggaacaggaaggcagaaaaaaaaaaaaacagacctttgagaggaaaaggaattgacccatcagccagtaccaaatgtttgcatttaacttcacaagtgacttactgaaacgggtatttcagagaagcaggcagagacagggtgtcactggatatcagagcttccccaccacatggctttgagctttgggggatccaggagacttgggtggctggttctgaataaggaggcacctgcagcttcataagagagcctttgactgaaggtgttttagactttcgttgttacctgaacagagaccccccctgtagaatacatatgctcacatgttgatgtgccatcccagggggagtgtgtgtccctgtgtaagaatttcagggtccctgcgtccctgaaatccatcagccacttttgtttgctcgcataacctctctgtccaggcaaagtgttctttgcagttaaacaccccaataaatgtaattaacattccttgcaactttcccatcctaattgttgcagcctgggcccaggaggacaaagtttgctctgtgtgcatgtatcagtgtgggcaccagcgctgatgacctgtgtgtaatagcagtgactttgggctccgtgttctgtaatgcagtgtgggtccaggtagccctggcagtcataagagggaagatgggttcgtaggatgctcaggccctctctgaagaagtaggatatgctgctcttccctgctagcttttgtagagaatgcagcattctgagacaggctcccagttctgcaatgggaacttagtaaattgcgtaactcctattaggatatctcttgtaagctccagcattatgaatactatttggggctttgcctcataccctccaccccaggcgctctgccgatactttgcaaacatttattgcagttcgtgttagtttgtgaaatcaggagccctcggtagttgcagggcactgcttactggacgaaggggtaaatagcattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaata

SEQ ID NO: 139990 - DNA, 3289 bp, Homo sapiens
aaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtaggcgctcccgggccaggacccggctggggtcgggggcgcgggacggggtggtaggcaaaggtgcttggggtccggccaacgcttgggctgggcacagggcggatcagtagattgggtcagataagacgccatttgaccaggttcacgtttttgtggatcgaggggtttcccatggagtgatataatgggggcgcctagaggaagtgcagtgttcagtggctttctctatctgttcctttcctcagcgcccagtgtagcgcgtggcgttccatataagttgtggaattgaaatggattccagggccatgccattccccttctctcattctcctcgctctccaccccccctcccccgccaatgtcctggaaggacgccctttagtgggtgcctcctaggagcttggagcagctggcagctctcttgccgggcttgcacggcacccgggctcagttgtaggtggtaagggggctggaagactgtgtccggctcctgccttggggattccgaattgaatccgcgctgagactagaacacgccctcccaagggagcagtcccagagtcatccacccgaggcggaggaatctgctcggagtagaaatgttgaaaagcccacaccggccaggaaccctcgcttcgattcactttattttccagccagcgattttcctttgaacatagggatcccatccaggaggaggagacacagctcctagaaacaggatccgccgggtcctcctcctgcgcgggtagacgcagaacgttcccacagtctactttatgcgagcgtggcacccctgcttgaggcaccccagagcaccctcgggccgctccttttcacccgaaagataggatcaccccccagttaagtcgcttctgggttttccgcaactcacctgacactcccaacaccccgaccccgtcccggggctcgctgctgccacctactgcccaacccgaatgaaatttcagacgcatgatcaagcccagtttaatagggaggaaaaaaaaaccttttcttctccatgactggggctaagagctgttctgggacaagcatgtatgtgtgtgtggtgggatgggatgggatggggtgggaggagggggcagcaggggatttttctagctggtgccagagcagccaggcctcttagaggtggggtgagtctggccattgtgcaaccccttccagttcctctgagcagataatagctgaatccagatggtgacagcccgtgtgtcaccgtttccagttgagtctaggatatgagtaactggactgaacaaaaggcctttaaagagaccagccagcttcctagaagagaggagatgctactcatttctaggggtggggtcgggtgtggggggataaacaaacaagtggaaaacccattcgcaggattccatacccttcctgtgagaattgtaactcaaggctgcttacacttgagtcggactgtaggcaggttgcttaaggctgcattgtcccagcctccccctccaagtcatctgttccttctgattaatgacagctctgcatgttctctggcccctgcttccccttggaggctgcagagtcaccacattctgtgccctttctgtgttgagcactttgggtctgcaggaggcacatgcacgtccagggactgcttttcagctcctggacaggccaggggcttccttctatcagccactcaactagtgtggcctgcaaacaggaaagggccacagagggtggggggtttgcttagctctcaggagctgacagaagatgggaacatgtacaggagacagttctttcaaatcatctgtgtgaaagcgggtaaccctttgggtatttgcaagtctagagctttaggtgttactggttttaaaggtgtcaggggcagctggggctgcgtaaggtaaggtggcagaggaaaggagtaggtgaatggaacttactcacatcctaagcccacaggttgagaacttctgttcagctccctcaggggtttgggaggctgcctttgcttttctagccccctaaacgggccccccttctctctacaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagag

SEQ ID NO: 139991 - DNA, 1916 bp, Homo sapiens
gcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgcgtgtctgggtgtgtatcggttgtgcatgcatttgtgtgcatgcctgtgtttctctgaaactcttagggccatatgaatttctaaaatctattcagattttagaaaggtaatctggggccaggcgtggtggctcatgcctgtaatcccagcactttggaaggccgaggtgggcagatcacttgaggtcaggagttcaagaccagcctggccaacacggtgaaaccccgtctctactaaaagtacaaaaattagccaggcgtggaggcacgtgcctgtagtcccagctacttgggaggctgaggcagaatcgcttgaacctgggaggcggaggttgcagtgagctgagattgtgccactgcactgcactccagcctgggcaacagagtgagtactctgccaaaaaaaaaaaaaagaaaaagaaaagtaatttggtggatatgccagctatcacataacactcccagcagggtttgagacagccccctgtgatcaaagcactgctatttctgcagccaaagataggatttccacaaggcagtttaaacactcataacctcataccaggttcaggctgggtttcgccaccaaatgagctctagtgccaatcttaaggaaatcttttggtttcagacctttttggaatttgggactgggttaagagatttggggcctgtgtatgtctgtgtgtacatggttgagagtgtatgcgtgtgtgtgtgttacatttttatctgagtcactgtgagaatatgtggtttatgtgcgttttcctagtgtctgtgtgtctcttgtagggtctatgtgtctcctgaggggtgggtggaggtgctgtaggcaaaacatggggttatatttggaaaggtggcctggagatggaagtactgctgtcctctgccttgctctttgacaggggccacctgaacttactacacagcacctgagtttagtacagtagcacctgtgcttagtacatagcacctgtgtttagtatagtagcacctgtgcttagtacatagcgcctgcatttagtacagtagcacctgcgcttagtacgtagcacccgtgcttagtacagtagccctgcacctgcacctcccgttccctttcatacctgctgtctccaggtgacaagaggagctggagttggtttctggcctcctccaggctcccctgcatcaagcgcagctgagcagttccctgtaatggggagagggtctgtccctttatctggagcctccagttttgaaaatcagccctggatctccaactgctgcccagtctggctgttcagcaggccccatgcccccctttccccagtcttgaggcctgggactagggctgtcaggcacgtctgccacgtctgcccctctctcccctgcggccagccctctacagccacaagcccgaggtggcccagtacacccacacgggcctgctcccgcagactatgctcatcaccgacaccaccaacctgagcgccctggccagcctcacgcccaccaagcag

SEQ ID NO: 139992 - DNA, 479 bp, Homo sapiens
accatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtctttgaagcccaccaggtaactggtggtatggggcagtgagtgcttctagcctatccttgtcggtaggtgaatccccagtacgatagcaccttcctgtttgacaacgacttcccagctctgcagcctgatgcccccagtccag

SEQ ID NO: 139993 - DNA, 13162 bp, Homo sapiens
gctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacaggtgaggagaggactggcaggggacacggggcagaggaggcacagcccagtgcagtggggatcctggccctctgcaaacgccatcatgtggggcgcagagtagcagagtgctgaaggactggagccggaagcctgggttcacgcccagtgcggtggggatctgctctgccactcaccagcagtggggcctggagcaagctgcaccacttccttctgtaaaacaggccaaaggatggtaggtgatgtggatatgggctttcgtgagaattaaatgagtgggcatctgtaacacatgtcatcatcattattagtattcccaccactgttaacacaaggcatctgagaccaatctccactaacagcacactagaaagatcagctgtacctgggattgttatgatcagtcgaaacacacagttcaattggtctggtaataattatacacatcatcattgagccgtatcataattagataaaaatgctaagcagttagtatgaataactcaactaatattatttttatgcagccaagcagttgtagcttctcctgtctcacttattggttcccctttatttatcagcagtgcagacagttttctctagtaccctgtactgttctgtcatcttcatcatcatcatgttatgtttaccttcaaaagcacccagaatccatgcagcccctggctttccctgctgcagttccccctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccgcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtgaaggctgtggaggtagcgcaggctcctgtttgggtctgcagctaagatgggtctgaatcctggagccacaccaccttgaacctgcaaagcaagtcccagaattttgcagaagttcttcctcttcagtgtatagagttgggtggagggagtatagagccatcattcagtccttctcatctcacccaggatcacctgggagtgaccaaagtaggccaaatgtgattctagggccaaagtgaaggtgtccgccattccccgagtaagcaacttcctgtctattggctggtaactgggatggctttggagacacagcctgtctcagaagagaggaacagctaaccaggagtgataattcactcagtgccagtagcacatactgttctaaatctgaagaaggtagggagggttagaaagcaaagggaagacagtggggactaagaatgagtgtgggatgtcatgaggattcaggggagaatgcaaggagaagagacggccacagggtttgtggctatgccgcctgccgtggcccacctcatccccacatctgagcccaggcagatggaagtcccctgcagagcagtgttctgtcctggagtttcctccacaccccttcttgggaccagggctgtttcccaaatagcatcactgttcccgtgcaggccaggtgaggtgcctgggagcaggggtagggtgaggcaggcatggcggtgacctctcaggcagcttcgttgtgggatttagggcacagcgggaaacgtccagggcagaggttgcctcaccagtcacatggtactatgtaggcggtggtgtttaatagattctgtttatcaataagtggatgaagtggagatagacttccttgttcagtcattgaaacaggagagagggttacttgacataatcactttgtgttaaagctgtagtgtatgaaaagttcccaaaaattctacaagacaagcaacctagcaggaaaatcagaacaggtaacagtaagacaaatacgaatggcctgaaatcccgacaggtttttcagtctaaccaactcaaagaaagcaccttaagttgcaatgccatttcacctgtcagatgggtggggaggacttggtcctcccaccaccaggggtgaaagggtagtgtgggccaacacttcttaatgtgtgattctttttttttttttttgagacagagcctggctctgtcgctcaggctggagtgcagtggcacacgatctcaactcactgaaacctctgcctcccgggctcaagcgattctcctgcctcagcctcccaagtagctggaattacaggcgtgcaccaccgtgcctggctaatttttgtatttttagtagagatggggttccactgtgttggccaggctagtcacgaactcctcaggtgatcctcccgcctcggcctcccaaagtgttgggatttcaggtgtgagccaccacacctggccaagtgtgcatttcttttaccctgcattcccacttctaggaacgtgtcctgtgtaagtacttgctcagcatgctcagagattcccatgccagcttatttactgcaggactgctcataagagcaaaaataggaacgtgcccatctgtggggaactggttatgtaaactgtggtagagccatatggtggaatactctggagtcattgaaaaggataaggctggtttatatatatattaaataagttcctgacaagttggggatcccattgtttaaaatccttatgtttcatagaaggcaccggaagagtctataccgaaggactcaggggctaactctgaggagcaggatcatggttaaggaggctgtgtcataagatcctgcatacccttctgtgtttttctcaacaagtctgcactacttccataatttgaaaggcaactgtactttttttaagggtaaaattaactgtttaaaaggggggtgaggatctggcaggtgaggggccctggagacagagcctgatcatgtgtccagagcagaagggcttggagatcacagagaccagggcaggcatcccaggtctgtcactgtgagctgtagccctcgccagtgccatcacttctccaagtctcattctcttcacctttataggctgtgtcctacccagcctgagggccagccaggtgagagtcagtgggggtatgtgacacatcgcaggtctcagcacctgctagttctctgccccatccccatgagttattactttggcctcgggagtcccctgagggacccataaggacagcgcacagctttgagccctgaaacagcaggaaggctccacagtcacccctgaccaccctcctcagcagttcagcactgactctcagtgcagatattgagctcaacacctgccatgcaccttctcaccctccccccagccaggcaggacagaccttcccatcaacaaggaaactgaggttaccagaaacccacttgccagggtcccctgggcgtgtaggagtagagacagctagagccaggattcacctcccattcccattctcatccctcctgcttcagtgacatccatcccaatcacccttgagaaagaggaagataaagtgtccttcctcctggcctcagcacctcctcacttggcaagcacttggtgggcatcaggctgggcccagcactgtgcccagggctggccatacagtggtggacaaggctgagtgcctgtcccaaggagcccacagttcaggcaaacaggacagcagaagtaaagaggctgctcagtaacccagcctcaaatccctgcagaatttggcctgacttcagaagctgctgggtgcttgtttgcctgtgagctctgccagcaaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaacatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccacagtggggccacggtaggcactcagtcttttttcttaaggccttcagttgttggatgagggccactcacattatggagggtaatctgctttactcaaagtcttctgatttaaatgttaattgcatctaaaaaatatcttcttagtggccgggcacagtggctcatgcctgtaatcccagcactttgggaggccaaggtgggtggatcacctgaggtcaggaattcaagaccagcccagccaacatggtgaaaccccatctctactaaaaataccaaaaaaaactagctgggcgcctgtaatcccagctactcggggggctgaggcaggagaatcgcttgaacccgggaggcagaagttgcagtgagctgagatcgcgccattgcactccagcctggggaacaaaagcgagacttcatctcaaaaaaaaaaaaaaaaaaaaaaaaaaaaaaaaaaaacaccttcttagcacattgtttggtcaaacaactgggcaccgtggcctaatcaagttgatatgtaagaccaacatagccgctgccagcaagttactaacacttctgagccttggagcctcggcttccttgcctgtaaagtgggggtaagaagaccatcttgaaaggttgttttgaggttttacgtgagatgaaatgggtgtccaatggagtgcctttagcaggacacctgcttacccccacctctacccaggacatcatgatgcgggggaagtggtggaaccttcagaacccagcccctagtatgagaagaattctgccatcacctttctttcagcagagagggaagcagtccccttccgtgacagtcacatgcgtgagtgatggctccttccaatatcctgcacttcttactgccccttacctggcgttgctccactctgtctcatgttctagttttcttatctctttctctttttttttctattttatttttttcctgtaggcacaagtgagttacagtaggttaagttacaccttacctttccttgtttttcttgtttatttatttgtttatttatttttttgagacaaggtcttgttctgtcaccacaggctggagtacagtggtgcaatcacagctcactgcaacctggacctcccaggctcaagtcatcttcccacattcaggcaatcctcccacctcagcctcccaagtatctgggactacaggcatgtgccaccacacccagctagtttttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttactttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcgtgatccgcccgcgtcggcctcccaaagtgctgggattacaggcgtgagccaccacacccagccctgctgttacctctttcttacctcagctatttgaggatagagtctaggtcctgtcctgcatatagaaggtgcttatcatgtgtcttttgagtgaacacagagggtgacattgtcacgtgcagtgccaacagaaaccaaatgactagacacctgctgaccttccatggccacagggaggatgagaaaggcacctccaggaggtgtgaataatctgagggtattggccactgtggacaagactcggtggtggaagtgagctcagagatccaaagggaacgtgagtagagacatgcagagtctcgcagaggaagcagacgtgcaggccacaaagacaaaattacaagaaatgccccaacacgagcatatgctcacggactgcacagattcaaggaggaagtgccagaaaccctgcctgccccagcatctgcacaggcatccacaaagggtttctgtcatgttatctctttttcttccaacatccggtgctgtgagttttattgtccctgttataaatgcctccaggagtggcaggtcctgcccagccccatcagccagttggtgctgcagtcaggacacccaggcagcctgaggactgccagatgtgcagagagctatcgcgtgcctgctgcgtgcccagcacctcacacagctctcagtgtctgaccacgctggtgccctggtggacaaagttcctgcccttgtggcccttttgtctagtgggtggcttccaacaatgaacacacacaggatatgtcaggcggtgacaaaggctactgagaagaccaaagcggcttcaccctcccagagcacagcttttccctcccaggcccgagagatgtagggagcccactgtcccagtctgggtcaagaggaacagttacaacaccttggaatgactgaagttgggagctaaggtgccaggacaagacaggccattttaggaaccagagacttgtgttacccctaaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttcggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcctgaagtcatagccttagcaaactgcctttctcgccaacacactcaacaccccgtggttcaaacatctatacgtctgatagaaaaacttggagaaattcagtgtgttgcttaatcaatatgactgatacctaagctgttctactcaagaagttttcatgggaatgaacttgagcttcttgaagagattgtttacagcatccctggagtctatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaaggtacggactggggggagcggtggctggccactgaggctgtggtcacatggtgaattgaccctccacaaagctttccttgccttggggtggggccctgactgtacctattgcagaattcctgcccaggaggcagccaggcccttgtgctccagacctcagctctgggcactgcaggagaagagggggttcccttgtcaagcctaccctgctgggcacctgtgttgacccagctctgtgggtgattgtgtccccctggggaccaggcagctagggcagaatgagggtcttgggctgagccatcgtcttacctgaggtctgggtttcttgtttctcaaggctcaaagcgggctctgagaaaaaaggacagacatttgtttttccagtgatatttgtgggtccttcctaacttcacacccatcaaaatctcacagattattttattgaatcaccacctcacaaatacacagaaccagatacatttatgaagaaatcaagttagccgtgagacaatcttatgttaccaaactaacaaagaagctttttttttttttttttttttttttgagatggaatctcgatctgtcgcccaggctggagtgcagtggcgtgatctcagttaactgcaacctccacctcccgggttcaggagattctcctgcctgagcctccagagtagctgggattacaggtacatgccaccatgcctggctaatttttgtatttttagtagagatggggtttcaccacattggccaggctggtctcgaactcctgacctcaggtgatccacctgccttggcctcccaaagtgctaggattacaggtgtgaaccactgtgcctgacccaatttttgtagttttaatagggacggggtttcaccatgttggctaggctggtcttgaactcctgacctcaggtgatccacccacctcggcctcccaaagtgctgggattacaggcgtgagccactgtgtccagccccaacaaagaagctttaggacttctttagacatttaaaatagttgtgttttttttttgttttgttttgttttattttgttttgttttgttttgagatggagtttcactcttgttgtccaggctggagtgtaatggcgcgatcttggctgactgcaacctccacctcccgggttcaagcgattcccctgcctcagcctcctgagtagctgggattacaggggtgtgccactacacccagctaatttttctgtatttttagtagagacggggtttcaccatgttggccaggctggtctcaaactcctgacctcaggtgatccgcccacctcggcctctcaaagtgctgggattacaggcgtgagccactgtgcctgaactaaaatagttttaattaaagttttagaattactttccttctccatctcccctccaaaaaaatttcttctcgttacttccaaatgtcaggagtgtttacaccttatacataatcgggccctttggcacagcctccctcccacctcctggtggcctttcctcacctgttcttggtgcttcagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacggtgagagctgaccagggcaactcacgggctgctggctccacacagcctgaaaccaaggtccagggagcccttggggcagcctagagggggcacctgtagagcagtgcctggcgcacagtaagcaccatggctgttggctgttggctttgctgatctggaccttggatcttagagcctaagacctgccacttcctcagactgccagcatctaccatgggtcccaggcgtggggtagtgtttacctccctatacctgaggtttacgcattctggcccagaagggaactgataattgataccagcttgaacaatttggggaacaccagtcccagaaactcaagcctgtctcagatgacctgacacagcatgaaagctactgccaaggccaggtggcccttcttggttatagaaggcaggcagtaaccagtaagtaaccacatttgtcaactgccaggagccaggcagaagtttcttggaggtcacccactcccaggagacagagccttctctgccctgtgctccaggcctcctgcagagccttgtcttcggaccccagggtaggatattgcaaagcccacctgtcccctcagtacctctctgagtaagacccctagaggacaggggagagcctcttgtgatctctacaggcaggttagctgcttggccagcttttacccagggatgccctaactgccttgcatcttagagggtagcagtacctgagccctccatttgcggctctcctgggtaatggggtctggcaggtctgggtttgactcctttcttaggaaatctcggaactgactgaatccctctccttacgctaactccaggagaagtcgaattcgtatcctactcaattactaatgacaacaatttttgagtgcttactatgtgaggattcttatttaattgatctaataactcagtaagttttaaaaagtattagcctcatttttctgattaaaaaagaaaagtggccaggtgcagtggctcacacctgtaatcccatcactttgggaggccaaggtaggaggattgcttgagtccaggagtttaagaccagcctgagcaacatagtgagacctcatctctacaaaaaaaaaaaaaaaaaaaaaaaaaatttagccaggcttggtggcgtgcacctgtagtcccagctactcagaaggctgaggcgggaggatcactttagcccaggaggtcaaggctgcagtgagccatgattgtgccactgtactccagcctggatgagagtgagaccctgtctcaaaacaaaaaaagaaaaaggctgggcatggtggcacatgcctataatcctagcactttgggaggccaaggcgagtggatcacctgaggtcagcagttcaagaccagcctggccaagatggtgaaactctgtctctactaaaaaaaaaatacaaaaattagccaggcatggtggtgggcgcctataatcccagctactcgggaggctgagacagagaattgcttgaacccgggaggcagaggttgcagtgagccgagatcgtgccactgcactccagcctgggagacagagcgagactctgtctcaaaaaaaaaaaaagaaaagaaaaagaaaagtgaaggagtctgccccaagtcacaaagctagtaaactgctgagctggaactcaagcccaggcctttgtcaccaaagtctgtcttaccccagctagcgtagctcagtcactcagtaagttagagtccttgtgtgctgggcactgtgaacaaaacagacaaaatcactgctcttgcaaagatacaccaaaaaaaaaaaaaaatcacatcttgtggagcttgcgatctggaggggccaccccatcattcctaccttgctgactctagagcttctgggggccttaggctccaaaaggatttggcccatgcacctgtaaagggatggggatgtcagaggtgctggggcctgcctgggctccttgctgactgcccccttccctgtgcagctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcg

SEQ ID NO: 139994 - DNA, 969 bp, Homo sapiens
ccgtccagaatgagcgggaccggatcagcactcgaaggtcaagctatgaggacagcagcctgccctccatcaatgcgctcctgcaggcggaggtcctgtcccgacaggtaccggggtgatcctgccacccacccagggatcccccacactacagaggagctcacctcctccacctccattctccccagccaggccctggagcagctgacgggaggggcctcagatattacagaagggacactgagtccggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccccacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccag

SEQ ID NO: 139995 - DNA, 3050 bp, Homo sapiens
gaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacaggtgagaggccctggctccaccccctcccttactgtccctgcccccttccatgttggtcccaccccttctgttgctgtccgtcactgtggggctgtgcatgcagcaggcctagggctgctgtgaggaagcactggcaggcgtggaggggtggggtgggcttccatgaagcccaagaggcacaggcgaccccaggaagatggggcccaccttacaagaacatctcagggactggactgaggaaaatgatgaagtaattgttagaggcagtggagagtaacgataaggaccaggtctgtgagccagaagcgactcttgcatgtgtttggtttggcttggctcagggttgaacattctttgaatttgttgccaacatttcaaaatcaggaattttcacatagaaatccagatttctggcatcttttggaaaattggaaaaattcatattcccatataacagtgcaccaggcctcactgcatccactcacatcggctccaatgacccctggcggtggggcggtcacctgagtttgtaatctatgatgccattgtcaggagtgggcactttggagtcaggtgggtgggctttgcagcctgcctttttgcaagctgccccctttctataaggttcctggacccggccctggcagctgtcatgacagccactgaggccattctgtgtcctggcattcaccccatgaggcgtgtccatgaccacccccattttacagatgagaaagtggacactcaaggaggggagggacttgcctcatctcccacagctaccagatggcagggccaggactcgaacccaggtcccacctcaaagcccattctcttaaccattgccatcagtcagggttctccaggaacacagaaccaacagatttatttgaaggacttggcccgtgtctgcggggggctggcaggcctgaaatctgttgctggcagctctggggagtgaattctgcagccttgaggcagaattccttctctgggaaaccggtttttgctcttacggccttccactgatgtaggaggcccacccatattttcagggtaatctccttcactcaaagccaactgattgtggcattaaccacatctacaaagcacctgcattcacagcagcgcctagattagtgtttgactcagcctagccaagccaacacgtacaactacctacctcggcatctcaccggggcttctccagtgttcacactaagatgtactcaggccactccatgggcggccgtggaccctggctgggaggctccctttgaagaaccgagggtagaggtgtgactttggggttcctgttatctgctgtgatccaggaggtgtggccctgcctccccatcctgagtacccctagggacaggcaggtggggtgggtgtgggtgcctggtgggtggctagcagccttgtttgcctctgcagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaa

SEQ ID NO: 139996 - DNA, 320 bp, Homo sapiens
gaacgtctggtcctaaccagtgagcactggttagtactggtccccttctgggcaacatggccctaccagacactgctgctgccccgtcggcatgtgcggcggctacctgagctgacccctgctgagcgtgatggtcagtctcccaagtaggatcctggggctaggcactggatggaggttgctcccagtagggtcagcatctggaccccaggctgagagtcaggctctgattccagatctagcctccatcatgaagaagctcttgaccaagtatgacaacctctttgagacgtcctttccctactccatgggctggcatg

SEQ ID NO: 139997 - DNA, 643 bp, Homo sapiens
ccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaagtgcagagtgggacagaaaaccgccttatctgctcagcgggggactctgcatggagccccagctctcgctaaggtgacgaccaagccattgaatgtgtctgagcagggccagagccctccagcaaggctcctggcaagcccagcctgctgccctcagcctgacatgtgggaacatgtgtcaggagacaagtgtcctgcacccagggtgacttagtgcttggggacaagtgttttgtggacacttggggacaagtattctgtacccaaggagactgggccagggaagaggctaagcgccaggtggttgccctggcaaccaggacttggttctctgtgtgtgcgttcgtgtgtgtgtgtgtgtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcag

SEQ ID NO: 139998 - DNA, 704 bp, Homo sapiens
gacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacaggtaggaagaacagcagcccgtggccacacccctctcaaagccgcagccaccaccagtcccagtagtgttggacctgcctaggatccagatgccctgctctggccttgccgccttctgtcacctgagtcagacatgggacctgagctagccctgggtcctggaagagtcacacatttctaaggcctcctctgactctggcctccctgcagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaag

SEQ ID NO: 139999 - DNA, 243 bp, Homo sapiens
atgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgag

SEQ ID NO: 140000 - DNA, 2503 bp, Homo sapiens
aacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacaggtgagagcccagtggcctgggtccttagcagggcagcagggatgggagagccaggcctcagcctagggcactggagacacccgagcactgagcagagctcaggacgtctcaggagtactggcagctgaacaggaaccaggacaggcacggtggctcatgcctgtaatcccagcactttgggaggttgaggcaggcagcccacttgaggtcagtttgagaccagcctggccaacatggtaaaaccccgtctctactaaaaatacaaaagttagccaggcttggtggcaggtgcctgtaatcccagctactcgggagactgaggcaggagaattgcttgaacccgcaaggtggaggttgcacagtgagctgagattgcaccactgcactccagcctggcaacagagcaagactccatctccaaaaaagaacagaaatcaatgaagcaccgagtgacagggactggaaggtcctaattccatgggtatttacggaacccctacgccgtgtggagtcttattctagacagtggggacgaggccatgaacaaggtagatgagagaggagatttctccatcctggtcagggaatttgttaaagactgatgaaaacatgaataaataattgtgtctagtacattctattcgtgaatctcataacagacagtggtagagtgaccgtgacccattcgccacacagtagagtcacttttttggtttgttttttagagacagggtcttcctctgttgctgaggctggagtgcagtggtgcagtcatagttcactgcagcctcaacctcctgtgctcaagcaatcctcccacctcagcgtcccaagtagctgggacagcaggcacatgccacgggttgggggaccacaggcatggtcaaggggctggcagtcaagcaagtgtttcatgagaaagtgacagttgaccttcgtcttggagggtgagagatggaggcagcaaagacctaaggagaggacaagccagcatagcccagggtcaggctgaacaagaggagatggtgggacttggggataaggctgaggggtgggcagtccctaagtcttgtgggcaaccatgcagacactgatttttccttggaataaagaggaagcccccataagcttttttttttttttctgagatagggtctcgctctgtcgttcaggctggtgtgcagtggcatcatctgggctcactgcaacctccgcctcccgggttcaagcaattctcctgcctcagcttcccgagcagctgggattacaggcggctgccaccacgcccggctaatttttgtttttttagtagagacagggtttcaccatgttggccagactggtcttgaactcctgacctcaggtgattctcccacctcggcttcccaaagtgctgggattacaggcgtgagccactgcgcccagcctcctgtaggtttttaaaatggagaaaaccacaatctcactggccatgttttaaaaaacttaatctgccagtcaggcaccatggctcacacctgtaatcccagagttttgggaggccaaggtaggaagatcagttgagcccaggagttcaagaccagcttgggcaacacaaccagaccccacctctacaaaaaattaaaaaattagccgggtgtggtggcgtgcacctgctgtcccagctactcgggaagctgaggcgggagcatcgcttgagcacaggaggtcaaggctgcagggagctatgactgtgccactgcactctggcctgggcaacagaggaagactctgtctaaaaaacaaacaaaaaaagtgactctgctgtgtggcaaatggattgaggggcaagaatgcagggaggtgtgttaggaggctggcactggcatccaggcaggggaaggtgatatcccaaagaagagtagcagctgtggaaagaggaggaggcggatctgggaggtttttttttttaggaaaagccgcccatgggaaggtgagcagaagcaagaaagcaaggcccctcctaagagtccatttgagctctgggtttaaaccacttggagaggagcaggttgccgggagccagtctcagaggtccactgggccccctgccatcctctgcacccccttctgctttcacagacgggacaacttgcagagctgcaaccccaggacagagctggagccagggccagctggatg

SEQ ID NO: 140001 - DNA, 483 bp, Homo sapiens
ggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtgaggagctctggacactcctggccatcttgcctgtttgttccccactctgtctttggccttgacctccggtgactcccctgggacaagttgtcctattgacagccctgcccccgcctcccctgacctgtcatggttttccctggacctgggatggggaggaggaagatgcagagagggaagaagctgcagcttggatacgcctcctcctctgccaggtacccggaacgtgatcgaggcttgtgtgcagaccggaacacggttcctggtctacaccagcagcatggaagttgtggggcctaacaccaaaggtcaccccttctacag

SEQ ID NO: 140002 - DNA, 307 bp, Homo sapiens
gcctccctccacctgtcttctcagagcaggtaatggcaagcatggctgccgtgctcacctgggctctggctcttctttcaggtgggtctccgaccctgacttcaacgtgggggtgtgggtggaggctggccagagggccctgtccaccctgggggaggagagcccaggccctgattacctagtccctctccacagcgttttcggccacccaggcacggaaaggcttctgggactacttcagccagaccagcggggacaaaggcagggtggagcagatccatcagcagaagatggctcgcgagcccgc

SEQ ID NO: 140003 - DNA, 2120 bp, Homo sapiens; identical to SEQ ID NO: 139927

SEQ ID NO: 140004 - DNA, 4006 bp, Homo sapiens
atcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcagccagggggctgctggcccacctgggatatagccgtggactggcttgattttattttatttaacaaaatatgtagtgcacacacgtgtctgaaactttaaatcaccttacaaatattaactcagttagctcctccaacaactctatgaggtaggtactaaggtactattattactgccatctcataggtgaggagattggggcacagagaggttaagtaacctgctcaaggtcacatagctactatccagcatagctgggattagaacctggcaggaagctccaaagtccaagctcctgaccattgtacctgaggctctcccagggggatgttgacagggaccctaggacagggatcaggagattttggcttaagctatggctctaagactggttgtctgcctaatcctgggcaaatgagttcctctctctgagcctcagtgttctcttatctgtaaagtggaaatgataatatccactttagagtgtggttgggaggattgaggacattggtgtctgaaaagtacaaaaatcaggtgatggggcaagctgcacagtggccagaccagagctggtctccctaaacattagtttcttccttgtttcccaccaaaacgattgaactcagcatcgtgtttcccaccaaaacaattgaactgagcatcatatttcccaccgtacatttttttggaatactgaaatgtccctagggggaagaaagggttgaaggaaggtggcgtgtgtctgaggacagatgaatttcggagatgccacctatgaagctcctgcccagagcacccctgggcctccaaagagatgttacccatctggggaagaggagctgggctgggccaccttctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactccttcggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgttaacctcgatttcccacccaaacctccctggctggggctcagagcattctcagagagcaatgatgggtggccaataacacaggacaatcattaacacaccaccccgacctcccggcccaccccccagaacagctgccatatcagggggttgaacctgggatcagaagggttcccagctccccattcctggtatatgaggagcccagcttgcccaatgcaggtggggcatccctgggaaagtcgggggcattgtcctccaaagggcttcccaattttgttgacattgccccagaaactagattcccagttggtgtgcttcttgggcctggatacaattgcagaaagagattggggcttagagagagacagaaatttgcctgaagtcacagagcaagttagcgacagaactgggattcaaatccaggtcttccgcttcgcgatgtgaaggccactggagtgactgatgaaagacttgcacagtgcccagtgcgcaggaggcgcttggcaatcagcatcctcggcctccctccatactggtcatggaaagtggattttccctcccaggcagtttcctctttttctgttttcctcacaggtttctatccatggggaatagaaggggcaaggacaagtggctgcccaggagcagctagagctagagaggaagtcaagatgtttgctcattcattcattcatttcccctttccttccttcattcaaatatttattgaaggcttattttgtgccaaatatcttcagacaaatgccttctttcctctaacaacaatttcacctccttagaggccttctctgacctccccatctaacgtagccattcttgccccattgctctcaccatcctttccactcccctccctccctccttcccttcctcccaccttttctccttccttctttcctttatgctgtgatcaccctgtgtcctctgtacttatttgttctctactatctgttcatcctctctcctataaatgttagttcgatgagattagagaccttgtctctcgtttttaaacattgtgcctccattgtcttaaaaagtgtctggcatttagtaggcatttaggatttgataactgaaagaatgaacaatcaaattaatgaacaaacaaaggattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaatggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtggttcacacctgtaatctcagcactttgggaggctgagttgggctgatcacctgaggtcaggagttcgagatcagcctggcaatatggtgaaaccccgtctctactaaaaataaaattagccaggcatggtggtgcacgcctgtagtctcagctactctggaggctgaggcacgagaatcacttgaacctgggaggcggaagctgcagtgagccgagatcatgccactgcactccagcctgggtgacagagtgagactctgtctcaaaaaaaaaaaaaaaaatagaatctgtatttttacaaagcacccttcataattctccatagctggtccatgggtgggaatttgggacccacagttttggaactttttgggatcatagacctttttgagaatctcaaaaaagaaaaaaaaagcacacagaatgttgcttacagtttcatcaggcacacagaagaggcccagcacgaagcagtttcttgcccaaggacacagcagttcaaggacagagtcagcgcgaggtctctcagctctgagcacatgttctttccccttccaggtttctagttttatgggtagtagttttatgatgcccatttcacagttcaggcaggtagaggcagaggggagcattaagctgacttgcccagcgtcactgagttggctacgggcagccttcccaagggtacagatggcaaacactgttccttctctctttcaggtggccctgctcagagcccatgctggcgagcacctgctgctcggagccaccaagagatccatggtgttcaaggacgtgctgctcctag

SEQ ID NO: 140005 - DNA, 85634 bp, Homo sapiens; identical to SEQ ID NO: 61513

SEQ ID NO: 140006 - DNA, 84231 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcaccgtgagtaccggcgcccggctcctgtcccggctcggggctctccgtcccaaccctgtccagtcccagcgtggccccggcccctcgcgctcaggtcccatcttggaggcctccctggcttctggtccctcttttcgttctttctctccctcgcccggtgtttctaatgcctccagtttctctcctgccttctgtcacccattcttacctctctgtctgcctgccttcctaccttccctgatccctatcacctgcctttgctctttctatccgctccttcttaggtcatgggatccacggcctcggagccctggttccagccaccctctccctagtcagcctcttgccctgggctggggggcaaattagcaggcagttttcagggtgttgttttgttgttttctctgtcttttctctctttctctcttcctctgtttgcctccctctcctgtctccccacatctttatctttctcaaacttaagagtcgtggggtccaggagactccaagagtattcagcctcagtgtcaggacaattgggcagaagagtgtgggggtggggtgcccccttctgaccctcatctctcagcatctccaggcccttccagcccagcataggcttcttgtgggttggtttgaaatattttcttcctcttcctttctttcccaccccccttcccttgccttcccttcccttcacattgggaatcccaggttgtcaagacacgatggtcatctttccctgcctctgcctgggggatgctctaaaaacaaagaggggctccgagaagaaatcgaagtcagggagagagccagcagcgcagccttccaggtgggcccccggcagagtgcagctctgctctcagctctggaggctccttgcctagactgccgactccccattgaggatcacgcagccagcaacctggccagggggtcagcaaagagcaaaaaatgagggggaaagaacaaaaggaaagcaaatgccaaagctgaggagaaaggaaaagagaaatccaaacacgggaaaggaaattaaagaaagaaagttgacatgatgttacagaagaaaagggagaagggagaaaaaaatagagaaaagagggaattattttaataaaatttgaatttatgccatgtctttagcttgaaaaactattctgagattttttttgcaggcttttttttttaaaagctaaaattctaaatagaaaactcctccctatctgcagattaataattaaggataatttgtaacttttcacaaggaaactttagacccggcttggacctgtgtttaggacaagagagccgaggagggagagctgtgtttttcgctaatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccggtaacgcgagttctcccggggcctaaattattgatggtcggggtttggagggaggggagggtgagaagtggggctagagatagggagattaacggggtgggcaagggggtaaaagaaggggcttcagtctctcccagcaacgcgatcagaggtctttccccagggtttcaccgagcttgctctaggtaccccccgagaaagggaggggagagaaatgaggggggcacagatgtccccgctttctccgaaactcgcgtgaggctagcggggcaggggctgcagcttgccagtccgggccgacccgactcggccgctagaagtctctgcgcttggattgctcagtacctgcggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtgagggcttcgcagctgtcccgggagacgccttgcctacttccccggccagccctgggtctccagctggaggacgtggctaaaagtccagcgtgccaagccagagagggagatccccaaaggggtctggagaggtgctccttttggagagagtgttcagatggtggctgaagacccaggagcgagggtggcgcagtgtcacccagtgcttgccctgcccctggtccctggtgagaaggcagcccgtttctggcttcagaaagggaaggatgactttcctaatggagttaaggcagatacggggtgggagacattagaggaatggggggggagtgaaaatgggtccccgagaggagaagcagcagcatttgggaggcagaaggagggtcctggttcccacagatgctctgtgcccagtaggaaagggctcgaggtggtgcctcaaccctggcctcccagagaccttgcagcgctgttcgttttgctcttcccaagtgaaaggctgggctttcactcccacgggtgcctatttgggctggtgcgaacccagcccctggtgtggccgtctccctggagggatggtaccccttgtcctcctactccgcggcgctcctcctagccaggcaccctcaggaagtcagctcagccacactgggccttttccctccactccgctgcctcggccgggcaggagagtggctcagcagctctggaacctgcagcccccctgccccgccacagtccgcttctggctgaccccgccggctttcccggcgcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacaggtgagcaagccacccgggttttcagggctggactccagctcctggctcctgcctgcaggggtgtcccacgcccagtctctgctctttgtccagcctctgccctttctccctgcttccagccccaaatccttctgtcagagaaagggaacctgtgaggcagagagttagacagacagacagggctgtctgcagttcagggctgggtattccctgccaggcttctcccgccggcgtcctggaaatgaatccaagtgtttgtggtaattaagactccaagattacgagcatccagccttgggatcttgagacaatcacagcctgcagccggagcctttaaaatgaccagtgtctattcatccctccaaacagactggcctttctaaaggctgctccttccccaggggccgccgcttgtcctggctccctcaccctccctgccaactcccacaaagctcacctcccaggagtctggtcttgctagccagctccacacaaatttctggcctgtaggcactgggatccgggcttgcagaacaaatgccaaccaccagccagcaactggcagggagtagaggagctggacaaggagggagtgccaagcagggagggagaactccagactttgagactgaaccttgggtgataccctcaaccacctaaggtgcctgtctccaggctgaagtctttgcactgatgacaggctcacacacgtgaggacagcacagggctgagtcagcttgacgtgtaggatatttaggtctcctggtctccaaacccctccagtgtgctctcggggagaacacatgtgcacactccatgcatgtccaccctagccagtgtgccaatatgcctatctgtggtagctacagaacatacaagcagcactgggctcaggaacccaggctggtttcaagatcacagaactgtacaaactgacagttgttcacagagtccctgcacaagtcacacaccagccttggccccccattttgagacaccccaaaatgaaaagagggctaagcagttcatacctttgttattttttgcattcttcataagctcattatcagggcaactaataattcacatggtgccttattctgaaattggcatcacatataaaggattttttaaatattttgcaaatgatatggaattatcccaaatcatcctgaaaacagcaggtaaaattagctggtagaatgtaccttggctaaagaagattccctctgccacactcgtgctgtaatgtactgcgaggcgaccccagaaattatcccagtgtgtgccatctgtattaaaatggttattcagttatgaacagggtaacataatactgatcagctaattatacaccctccgaaaaccctccagctccctcggcctggctcagccaggtattgaaagcatagcgatttgacattcagataccttccaaaggagctggagaaagacgctgggtggtttgggagaggaataagccctttgctttaaaagccaggagaggaggctggggcagctttgggctgaggcaagagtggcacttcgggaggggaaggggacaaagcattgttttatgagccatgtagagactcagtctcttggctgattgctggtcctgggcatgagttggaactgagatctcaagagaagaacagccaagggccaagagtggccctgctgtgtgcagtgttgctgggactgggtagtggtcttctgcagaacatttaagagaaatgcttgttgtcagtaacagaattttcaagcctttggagaaacccaagtcatgtaggatttaggtaatttgtttctcttgaatggggtagaggagtggcgcaacaagtcaggtgtggtggccccgtccaacaccccctgcccctcccctcaacaacatgcactcctcattggctgagatgattttggaagctggcttaggcataagtttggaaatacttctatcctgaaaagccatggagaacaagggccaggtgaccctaggatcaagctccagaggtcttgaggtgcacccaccagaattaggacaaagtagacaagtgagccacaagtgagatgagggtggggaaagagtagcctcagcttgacagctgtgacagctgcagaacctgcccagcacagagccctatcacctgaggggcacacaggcttcctttgggtgtggagaaatagccatctgtgggcagatgttgctggagatggagagggagtaggaggagaggaacaggtaagccaccaacaacacgggcagcctaccctgggtccgtagttaggcttcatggctggctttgtctacaaggagcaggaaaactattcccaattttgcttttgtccagaatcctctcatggttcatattttggaaagaattctgggggcttccctgtgtgctgctgagttggggctggagaaatccacctggggaaccacgctctcatcttcatccctgtaggtgctttttgctctgaagagggaaggtttatctgagatgtattgtttcacccaaaagcctgataaaaacaggatgtttctgctagtgctggttatatcagaaactttgccttttatcagttctgggaattctcactcactgtaggaagagcccggagattttcctgtgtgcacaaagtgtggtgcaccggggaacgggtggttcttgagtttagagctttgttggtagtgacctgcccacttgtgttgggtactttataacagttatgagtaaggttgtgcatgagctggtggttggcaagaaaagaagtccacacatgctcacccacctgagctagtggtttttcatcttctccttcccaaaacagatgctgtcgccacacttgaaatatgctgttatggttataaactaaattgcttttttcactctttaaaaatggttttggcattctctgattctgttgtgataaaggcctggccatccagcctgtattctccactagcaaatcctcagaaatgcctctctgaaccagaggactgggtcaggaaggcctccccactgccacaaaccacgttcaaaaatcccaaggcttgactgggctccttagcatgtggaatttatctgaatctttctaaacattgggttaccaatggctgagcatggagttgccagctttttggtttgtacaccgctgctgtaaagggcaggtgtttataaacaggggactttagattgaaacctggtgtgggacatggcctggagaggggagaggtggagggagatccatgctactgaaaaaggaaaaagtcgtctagttacatagctgagcaattgtctaagcaggagggattttcctgattatatgccaaaatcttctggtttggctgttactctgggcagagaatacacctcctttgaaagaacaggcacagaccccaaatagagtctggggttactgacaatcccccgagggtgctcttttgggaagagctgacaataagggtgtcaccttctaacttttttagcttgcctaacactctttggagtcagggcactctctgcccctagatctttggagtggaccctggcagaatcaacttctcacggatctcccactatccacactctctcttagcctgttaggctctaggtgagtacattcattctcctagcagtggcaacccagggctgtgttaaggaattccatcctgtatcatttgggtgtccctcttctgtcattctcaggtctttgagtcattctcaggtcattgttccccttgggtcaggcagtggggtgacaatggtctactagttgttcgttcaaagacctttccaaataagctgggagctattaatcctagccccgtgaatgttgaagatatgttccgggctagggtctgtttctccctctctgaaactcaggttccagaacattgcctattctactcttggacctggcttggcatgaagcttggccagaggggtggtactgcctaccacatctccatatctttgtagctgtttggtggtcagggctgttggtctcatggcaaagagacagggcaagttggagagttcagaaaaagacttctatccacagaggaatggcagaaacaaggacagggaactcaccttctgtggcctgagcctagcagattgggcccacaaatagcagaccaacatgccaatttctgtcagagaagcctcgctcacctgtcctttcccagagacagtcccctactgtgaggttacccatcattggaataacatttgaaacaggcatgatggttgaaattctcattccttaaaatgagctggagttgtcctcctgaaaagcctctttttgtttttgtagttgttttagcctgggcttcctggcccacagtcctgttggtctgactgtctccctgttggctggttctgtgggtgttcaggctacaaaaggggtttctggtgagagcaattgctgcttgccctgccttcctacctcagctggcaactctcgagaagaggcagacaggaggcactgggcctgacaacagctccaggtgcatttcagaaggtgacgcaaagaagaaaagagagggaaaacccaaaatgaataaataaatagtgtcccaactgttctgagaactcaataaaacaatcacatcaaatatgaagaggcataaatcttgtgtctgcacaggtaacctactcaattgcttttattatcgctcaggctgcctccatttattaccgttcatggcctgggcaaaggaggctgcgtggagggtggtctccagtgcaatcctacaccctgagaggcaacaatcagcccatacagccagagatttcgatgggagcccaggaagggcccatctgtctgcatgaaaaccaatcaataactctgtaaccagagcccttgtcacagggaaatggacaacacaacagttcaatagaggggccacagggggaattagccaagtggagatggggccaaacaggagcagcccctagagaagggaaacaggggtgcctggagtaggggagattagggaaggggtggagatgtggcaggggagagcaatagcttcatatgcatgttggtattagatggggagtattgtgcaaaatagacccagggaatgacaggcaatgttggaagttgaggtggtagggaacatgtgttttggacagcatttgggaaatgggcttgttctggtgcacatgggagagtgtgactatgcatgatggcatgtgcttgcggactagaatgttacagcttctacagaaagaggaacaatagtagtaactggtgtggaagattaatcacactccataccccctaaaacccctctgaaaagggggttcctatgagcccacatgggataggggtcctgcttcccagtcttcttagcaggactgatgaaagagccccattgtccgctcccagcttcttaggtgtccaacaatagctactctgcaggttgcctcttaatactcaagtctatcttcaccccctccttgtgtctacctggaattggagtttttatattaagaagagaacaatggtgtaaaagtgacaagcatccagtagaaatcatacttcaagtacccaaacaaccattctgtttctcactttcaatacagtattcaataaattgcatgagatatccaacactttggtataaaatagtctttgtgttagatgactttggccaactgtaaatgttttgagcatgtttaaggtaggctaggctgacctatgatgttccatagattagctgtattcaatgcattttcagcttacaatattttcaacttatcgagccattaccctgttgtgagttaaggagcatctgtacactgaaaataatttatttttcacttcctgtcctttaaaagaatgctcatccgacctgccagttctctgcatccctgctgtttcttctcacacttcccccgcccctccaagccaggtgtccagagctcagattcttgcaggggaagcagcttcaggtgcagctatccccagtgcagctccccagccatgcagttgagtccagagaaggggaaagggctcctgaaactgagatgtgggaaatagagtctcacaaccaatgcccaaatagcaagtgaaatattagacagctgaaacattaaatcacgtttggtttttctatctaccactgaactactaggttgagatggttttctcttgtggaacaggctatttgttttggggctagcaaggcatggcttgaatatattcatgatggtttgcagtgtagaagttgatatcttctgtgcgtgtggatttgtgtgtgtttgtgggtacctacctatgtctgcttttaggtgaaaaggccctgaggccaagaggagaaaagggaggaaggctcacaggacatgacctgcagtcacaggcaaggctggacaccttgtacttgggccatcagatcaattggcaagtagtcattgggccactgggcgaagtggcagcagcaataaggctaggctgaagattcctcatttcacagtctaggcaaattggagccacattttccttcagttatttgcattgtaacactctatagtccagttaaccctggataagaggggctttgctacaatgatgccacaagagctgtgcgaccagctgtccatccttactttgatacttgggtccaagccctgttggcaggattagttagggaccaattgcataagcagccaagaaggcgctcttcccaacacaatccttcctccaaagctgtggtcccgcagtgggaggcatggtagcagccctgggacacaacggtgggcagagctcaccccagggccagcctgcaagtctttcctcaatcatccaggtgtgaggggcatagggaagaggcttactgtttgtgagaaatgcagagctggccactgcagaaggcttggggtgtagatgaggcgtgatggcagaggcagcctcaggtctcctgaggaaggctgggcacaggggagctgttgagggtatgggaagctaaagaagaatggtctggcgctgtaggagagggagcagcctcttgtaggctgggaactctcaggtaagagaggaagtgtgcaggaaagaggtagacaggcgaggccgtagagccagggtcccctcatggcacatccgcaatcaaccatgggagaaatgaggccctttcttttgttttctgagagataatgtaatgagaacagattttgtgttttccaagggagaaggaaagagatagaaagagagcagggcagggggagcgagtcaggtgccattctttttttttttttttgagacggagtcttgctctgttgcccaggctggagtgcaatggcacgatctcagctcactgcaagctccgcctcccgggttcacgccattctcctgcctcaacctcccgagtagctgggactataggcgcccaccaccacgcccggctaattttttgtatttttagtagagatggggtttcaccatgttagccgggatggtctcgatctcctgacctcgtgatccgcccgcctcggcctcccagattgctgggattacaggcgtgagccaccgcgcccggccgtcaggtgccattctattctagaaacgttcaggtttgttgtagggatgttgggggaaggaaagcagtgcccagaagtccagactggggtttgccaaaagcaatgatggagatgcgctgtggctgcaggagtcatgagcacaaaagactcccaggccccagcaggaagaggctccagaatatgagatgaaaagtggtgagaactggacaaacagccggagcacatgggccctgcctgcaggcagtgatgcaggaagaccggattttaaaaaactctctgctgaccgaataaaactcaactttgggcctgattccatccattggccagcattcagcagcctttggttgacctgactggatggacttatctctctgccttagaccagggcagtaacatccacgcaagtggaaggggatgggacatttcctgggtcccttggtccagaagctcctggggaaggcagtggaggagagattatgactccctatagccggaggaggagaggtggggtgtgggtagggagaggcagaaagtgaggatgaggactgggagagtgaggcaggaagcgatgaagctgagaggtggaaggaagggcgctgccttgggctggacagggttgttcgggattggagcacatggctgagcaggaaatggcacggcagagcccgcaaggggagcttggatttgctcatccgagctggggccttcagtggccctgcaaggtcttgggggtggtgggaggaaacctgagctccaggcatctggtagtacaggctgatgggccctgaggaggggcccagaggtgatgaaggagaaaggggaagaggaaggtaagcaggtttctgagaagagtatggagcgaaggaaatggcatgggaggaatagcggcctggctggagctatgcagccctttctgagaggaaacctcatgagtgtgccgcaatggtctggctgtggcccctctcggcaggctgtgaggcaggccagcagtggctccagcctagtccctggcaggctggagagggagagtaggagagcagccaaaagggagggaggcaggcccctgcctgctgggggttgcagattcgagagccatctccacccagagcctttgaccaggttgctgtggacttcctcctctgcctgccctcagtcctgcctgaaccacagatttctctctgctgccacctgggaacagaacaagccagggacaggaccggtggctcctggcagggctgaggcagggcagcaggctgggaggagaactgtgttcaccctgcaggcacagtagaatcaagaaatcagagaggaaggattggagaggactgggagagaggggagcaggcagaaagggagaacaaaagtggcccctgagcatgagcaaatgggagtgagcactgggggctgctctccctggtcttggtgctccctcttggcctgggggtctttgctgggcccaactgcccagcccatacctggcaggcagatgatagaagctgaagggcatgaggagtctgcaggcagcttctggcctgcaggacatggaggcggtcaggaaggagacactcattcagcctcttagtccagaagctttgatcctgattttggagggcaagcagtggtgcctgccttagtgcgttttcccaagagaagttggtgatgtgttgggagcctctgtgcatggctctgctttggaaagactatgtgtgctggtggtatctagctaggcctggcttctatgccctgggaagctgtctaaatggccctggctcccagggaactctcgaaaggagtcagtcttgtcaaactgggagttggtggtttgctattcagaaggcttccggctaaagggattgtttggtcccagaatgaaagtccctgttatcactttgatggcctgcctgtttgggatgttagttaatgttccctggagagcacgtggttgaatggacagtagacatcctgatgggtcaatgaacgggggttctgaaaggtacacacagggtcccgacacatctagtctgtgtgcatgcacaagtttggggatgtgaacgcttatgagtagtgtgcatttgctctgctggatgagtgaaccaagccatgtgtgatggccagggtggagggtgtgtgtagtatcgcactaggagaactggaagcagttgtttcttgtgtgtctgctgacgtcctcaaagggagcatgtatttaggtagagacaaaggtcaagatagtcacctccttttatcatttgcaaagtggataccactatcccttcccccagtcccttacttttcttcctctttctcctcctcctcctcgttcctcaggttagctggtttgggttagggggccaatctcagaagactctaattaaagagtgaggagaatctgataagataaggaaggccatccttcctctagggaccaatggaggtttcatgttcctcactccccgctgcttctctgaggagctgacactagggcaggcagcctgccgactgtgactgtctggagtctgggagagccagagagaaggaggtgtgactggggttgggactcgggttcctacccatttgcaatggtcctggaagggaaaacctagcagactccagatgagagcgaggggagggtagaagagagagtgcagaagtcaggaagagagaagtgggagccagatgtgatcaacacagatatgcctcgctaagtcctagtttttggccacagaaatggactgtacggggtggggtgtggtacctttttttttttaattagggaaggggctatgaagccatttaacccatctttggggctgagcacttagctcctgcagagagtacagccctggttagggttcagctcctcctagaaacaatgctcacctgcgctctcgaccctccgccctcccacctagcacatacacttttctttttccccaccctcgtttcctctgaacttggctctgtggatcaggtcactcctggccccatggagacagccaggaaggccatgcagactcccttaggagatgacctcccagggtgggtacaaaaaaagttgagagaaattcatttcatggccagtggctgcttagaaaaggcgattccagcatccgaatgtgataaatgctaactgagcattaatcgcattaaagagggccctataaacttttcacttctaattaaatttgtccagtggtgctgcccaagcgagtactctgggcctttgtttatgtggaaaattaaaatgcaaatacaatgagatttatttccaggagtggagtgatgggctggcccctctggctactggtctccaggcctgtcaggtcaggtgactgcttctttggaggtgctatcccccttgtgacagattcttgtgtgaagggagaggccagagttcaaggtcaaatagagttagtaaatggggagaagatgtagaaagaattgaagagaaggagaaaaaggcaatagattaccaggaatatagggagacattattctggtttcccaccctccttccccaccaactcacatctctaggggtatagacccccaaaatcttacttgttaatatcaccacaagcctcctctgaagctatgagatgaaggagtacatgggagagagaatttggaggaagcagccctgccaggctcggcatggcggctcacacctgtaatcctagcactttgggaggctgaagcaggaggatcacttgagaccaggagtttgagaccagactaggcaacagagtgaggcccatctctattaaaaaaaaaaaaacaaaactaagtggccatcaggaagggtcaagggcctggatttctctccagcagtttgagggtcatctgctgtccacaccggggtttcactgggctcttcctgccagttccaagtggcattgacatggggcagtgaagcatagaggcacaaaccaaggaggacattgtgcatgcacgcctgcacgcacgcagccttcttgcacataaggagagccggtttctcataagaataaacaaatgtcccttgcaaggagtcatttagtgccgtgatcccttgataaaagtggtaatcctaaatgctactgaatggaacaatctaaatttcctatttactgagaacataaattaagtcgaggggagagaaaacctgcataagaaaaattagtagggtatatcagttagagacactgaaagatagctatgctgctctctggataaggaagttgtaaatagcattaaaaagtcaagcaggaaaggaaatggaggtaggagaaatgataaaagacagagcactaaatcacaaataggggtacatgtacgaagtcacaaaccggctttatgccaagctttgcagaatccacagcttggactgacaatacatagagatgctaaacacacaggcatgcagacttccagagagtgtcagtatgcagagggtggattggtcgcaccatgggcaagctgttgtctgtgctggactctgggattgatccatcagttcctccttgcagggatctgattgggtacagttcggtaggcagtcgaggatacagctgtatgaggtttttaaaggtctttaaacacatgagtctcttgtgagctggatccaccttctaatggatctccaaggtagcaacccattcccagaacactgcctgcttgactggttttgtcaaatagctgctacccctgtcctcctttttctgttttattctgggctactcttttcctttttagtgttcacttatgcctcttggaaattcatgagcacttgctgacaaacaggttaatgactgtggcaactcccaaacatctggatggaaaccaaaacttcagtcaatcatctataaaggttgtcgatatgatgccaaagatctggcgatttagaaatgtccacataattgattgaatttctcagttttttatccaggctcagaatcaacacattgggaaacacctattttcagagaaaaatattccaggaaacaaagtgttctcattagaaagcatctttgatgtgttcgagtctgatttctggcttgaaaggaggctgggctgggctctaagtcagatggagatctggtggttagagtagttagtattggaacgagcacagctggtgagaggtttccttcccccgaaagttggccaggagggtagatcactttgtccaaataagcttaggctgcctgttaggcctggtttctctaagggagtccattttgccattttaagggagactgtcaggttcttaagacatgtggctttttcttcatttatcttttcattcatccattcagaagcaagtaggtgcttgctaagcacctactatgtgctaggcaattcacataaagctatgtggcatagtgttagaaagcaggctctggggagaaactgccagagtttgaagctggcttccctactcactggctagagggtactgggtccaccttatatcctctgtgggccccagtttcttcactcataaaatgtgggggataattgtgtaggtctctcataagttttcatgagggttaaatgagtgagtccacataaaccagcttagaattgcacctggcaggtattaagtgctcaataaatgctagttattattattgcagtagtaataatcaagtctgtatttcttgttatgcgtctatttcagtgtgtatgcattctgctttgtgtatgcacaaacattgaatttttttttttttttttttttttttgagaaagagtctcgctctgtcgcccaggctggagtgcagtggcaccatctcggctcactgcaacctccgcctcccgggttcatgccattcttctgcctcagcctcctgagtacctgggaccacaggcgcccgccaccacgcctggctaattttttgtatttttagtagagacagggtttcacctgttagccaggatggtctcgatctcctgaccttgtgatccacccaccttggcctcccaaagtgctgggattacaggcgtcagccaccgtggccggcctgaaatatttttaaataaaaaagtttgaagagccaaaaggatattctgtgaacagaattgtgtatcatgaatgccagtgagaatcatggtccctcgtgagcccagatggatttaggaaggggacccactcagtgtatttccagaaaaaaagaccctctatgattcagtaatctgaccattgagcagaattagtcagataattgcccctttgtcaactttgagagcccagaccttgtggctgtgtgtgtgtgtgtgtgtactttgtataactgcacattccttctcttggaagcctgctattgcttgaggaattcaaggttggcattttctaggcttcatggcattttcgtaggttgtggtgctttgcattttgtagtttttttaaaagataaaatgaaatggtagtggggaaaaagtccttatttgatgcatttgaagggttccactgattcttaaatgtcatacaggggagaggaaagggaggtaaacaggaagaggaggggaagagaggagagaaaatggagataagacaaaggaagaagaaagaggaaagggagaagtgagcaaatacttaacaaattcaaatgaaatctgtctattcttgtctggcatgtctggatattctaaggaagtatgggagtttgacaatcattgcagttatttccattgctaaggagtaaaagtttttaagaaaaaaatttcaggaaaaaattactttgggcttaatctatttgatgaatggctccaactaactggacaactgcaaattctatttattctttgcctgacaagagcaaatatgaaacccagtttcccaaactcatgacaatgtgtttctcatctttatgggaacttccatggaacaagactgaggtgcaatcccattcttgcctcaagttctccctgcccctttggcttagttaggtgaccaagttcagctcaatggatggctgtaagacccacacccaaatacttacagagtcacttatctgataccttttataccttttgcatcattctcaaattcctagatttcattattcgtcatttatgcctattagctggtaaaggttctgattttcaaattagaaagtaaatgtttttaatgagcaaaattagaatcctgaaagctcaatcatccttacatttttcttgtagtacgaaacaagtcaagggctgcctattcattaccagatgcagggccagatgctgccctctgtgtggacataggcagtggtgagctctgtcaatccccagcccctgccactgcccagatggcagggagagaactaccctctgcccctgtgctacctggctgcaatttttgcacttctctgcttaaaacacacacacacacacacatacacctcttaatttgtcttaggattttatgtacactagcacacatgtgtacatgtttatacacatacacaggccaatcttatggctgctttactcagaaagcctttatatttatcatcatcatcatcatcatcatcatcatcatagtggttaacaagtgcttactacagtaggaaccgttacaagcatgtttcatgcattaattgatttaagcatcctaaacaaccccatagggctttataggattgttatagatgaggtagctggagtacagagaagttaaataacttgctcaaggtcacagactaagtagcagaagtaggatttgaacccatgcagtcctggctctaaaacccacatgcttatcccctatgccatacttcatatctactttggatcaagggaagtgcaggcacaggcaatctcctggggaactctgtatattttgcagtctcttacaagctcaaaacaggaaacctgcaccctagcagatggtcacacctctgtgtatctctgtactcttccatggtgtgtgttcctcagtgcaggccactgctgagccacatcatctagagatactgggaaggaagaagatactaatagccagagccacagagtagagtggaatggggattcttggaactagagtttatattgctgttcccattgggattggcaagtttactcccgtccatcctcctccagctccaacagggatctagactctcaattggcataaggtttggactaggggcttaactctccaaatcaggcagacctgttctcgtttggtaaagtcgtaactgttcagcagagcagggacatttgcttccaagaagaatagaatcgtatttttggttatcaagaagagatttgtcctgcatctctagaatcttccttctgaaaagcagcagtgcaaatgaccaggccagagtaagctaaaaaagctaaaggatggatcctctcacccacaaccacaccaagaaggcaattaaagcaattaccgaatcatacaccatcacccagatccagcatcattactcaacccacatcaccaaggagacacccattaacctaatctctgagacatacattagggaaaaaagatgctgatatgatcaatgaacacaataattcaaagcagaaacacagacactgccaccaaacaatactcaaattcctccaactcagtgttacacaaagtgcagccacctcaatacaataccacaaaacaccaagtaacaaacattaagctagctgccggaatgcgtcaacacaatgcaataatacacggtaatgcacaacacagttcaaactctgtatcccataggcacacccatacccacaggctgaaatcatgtggccacttgagccacatgggcagacacacacagagacagagccaatagcgcagcacccaattctcctgcacacccagcagaaaacgatcacagctgcagtcctcccaagcacgatgcagcctgccagaaagcagcagcaccatgccgtttctccagcaggtggacgtgtccagaccatcacctctaataaggcctctgggctctcattgctagtaagagagtaaactgtcccctgagcctgcttcccgagacaggacaattcagttctatcctggttggggtttaataagacttcgctgttagtgaaaatgacagagctccagggataaagggaaaggtggtggtgggaggggagctcactaagctgggtgcaggaattccccttcctctacccagccctaccttctgtggccattccagagccaaagccctcatgctgggtgttcacggagtatcgattcagtctgcaagcaattttaatatttcttcagggactttccagcaacagcacaagtcattaattcaccctcccaaattgcttattcaatagcaggaacatggctcctgaataaagtcccagaatttatgtgactcgcacgagtcaggaggtcaaacaactgttatggagcgaagttaaaaatccaaataaaatattgacacttttttggggagggggaggtgggaagcaaaggtatttaaaataggtttttgttgcaatgcccccaggataaagaatggaaggagactgaagacaagttggagtttataaaatcaatggaatttattgcacagctacttggcatttaataattctctcatttccacatccccctcccccaccccatcctggccatagacagagagatacacaggtatacaaatgcacatttatgtacgtcaatactggtgcatggaccaatataaaaacacgattgtgatgtgaaaatctcaaacaccccaggaagggaacaatgatggtgtagagtctcgctgtagtttacatatttgacagaaatgggcataacttggcagatactcatgaagcaggttttgataaatatatccactattataaatcttagatcaatgcattggagcagacctgaatataaagataaactaatcatagaaatagatcctcaaaacagaaattgagaaacacatctatatgtagtatcatcctgcaatcatgtacatgatttggaaactagatagatgaaaataatttggaaaatttgccccccaaacctaccagtgcatataaaattcaccgaagcctatagcagcttaatctaaaattgtgatttgttagtaacacagacatgatgcttatcaaatacagctatggcacatgcatgggagaggataagcgtgtttaaaatcacagctacctgtgctctctgttaattgtctacatatataattgctcaattttccaaaatcatggatatgaaaaggctgaaggaaaaatttgttcatgtccaaatagttaataaataaatatatatataaatttcccaaaaagatcaactgattcagcctacagacattgaagtcacaagcctggatccaatgtcgggctcttacccgatgcatatgtataattatatgtcaattgaaaaaaataaacaccaaccaaacaaacaatttctggctccaatgctattaagcatgtgactttgggcaagttgcttggcctttctgttgtttcttaggcaaaatagagaggatggctatttgatagagttatagttgaattcgaatgagaaaacacattcattataatgcctttcatacagtgaatatgaaataaacgatagttattgcttttactattattagattcagctcttctattcaggcctagcctctcatagattctaccatcggttcttgatatgactgactcattctactcaatggttagccgcataagttctagagtgagacactcaggtttaaattctggctctgttacttaacagctgtgtgaccttccgtaagttacctaacctctctgagtctcagcttccacatctgtagattatggacaataatcttcataggtacttgtgagaattaagttaaataatccatataaagtgctttgcacagtgcctggtacatagtaagtgtatattggcccactgtgtcccttaagattatgtcattgttattattggccaggtacagtggctcatgcctgtaatcccagcactttgggaggctgaggtgggaggattacttgaggtcaggagtttgagaccagcctggccaacatggtaaaaccctgtctctactaaaaatacaaaaatgagctgggcgtggtggtgtgcacctataatcctagctactcaggaggctgaggttgcagtgaacctgggaggcagaggttgcagtgagctgagattgtgccattgtactccagcctgggcaacagtgtgagactccatctcaaaaagaataaaataaaataaaataaaataaaataaaataaaataaaataaaaaaataaaaaacaaaaaacaagagtatattattgttattattattaataataatattcatttgttattgaacaaatagctatcaagtacttacattataccagacaccattgctaggtgctggggaaagacagtcgtgagaaaaatagcagacatctgccttctcagagcttggaggggtggactctatgtgaactgagtaagcaagaaaacaaggtttcagctctgtgttagaccctgagaggaagagggaaacagagagaaatagattggaaagctaggatagagccagataagggaagattttgaaggccgggctgaagaattctgaatttatcctataggtgataggaagtgattgtagggtttagccagatcacattctttcaggagacagagaaagactgacggactgtttttgaatgcctgagtaggcgaaaggtaggaaaggctagaggtagggaggccaggcagtcactagcgggccctacatctgctgctgctcatgtgactgcagagggaggtgagcatgcctgtggtgggacagggttgggggatggacaggtgcagagtgggagactttatcccagcaatgaatctatagcagtaccttgttcaccttatatcaagcagtcttcaagcctctggagcttcccaaacaggatcatgggggtggacagctggtagattccagctctagccagaagctctgacagatgagggcagggccagtggtgagaggcgctagtctgtcacgctctgggcttggcatgcaccacagactggtttccaaatggttagttaaacacattgccccttaatttttaaacctatgcatatcttgaagttaaatcaatccatatgcttagcattcatcatataaaccatcactattgcccccttgggccagccccatggcccatctagcctggtaaattgtctctggcctgggctctcaggggcacgtggcggaaagattatcgccctcaatgccagtcttggaaggctaagttgatgcagaatatatgcctggtatctaagtaacccactgggaatttatcatcctggaatgtaccaaaaaccattttgaaattatttcaatttttaacctatggttttgtttccacagagcaactgatagcttattgaattttggtgactatgtcagctggagtcagggttaatagatggagagaaatgtggatcgatagagtatgagaaaggaactttcttaactcactaagacttattcccagctcttccaaggatccccttgagaaaccaaccagaaggatggtttcttcacctcctggcttaagctagtcttctcaaatagagttcagaaactctaattcaggtctaagatgggacccggtgatttgcattttagcaagcaccccaggggattctaatgcaggtagttcaagggcagtagtttgaggaaacccttctgccagctttttggtaggactttcatttcttggagctcagctatgacttctgagagtcaacaagagttgacacatttgggaagaaccctggtaacctggaacctgtgtattccagcaacatcctgccacagccagaatggaaggtcctgcccacagctctgaagaatggcctggcccttatcagtggccatgttcagaaccctgcctgacatatggtcagttatccagactgaaacctgcagggcatatgagtgagcatgggcaaaaaaacctctaaactcagcccaaactgcagccagaggctacaaaaacagtgtgttaagtgattcaggcctgccttaaaggaagccacgtgcaggagagatgctgtttcctttgtgtttctgtggagaggaggaagtaaatttcaatttttcagttcctggggtatacaaagggggagactctagttccttagagttctcaggagtagggaccatttccaggagaggtaaacatttcctgggtgatctatgacatctcactcaaggttctgctgtgaaaagtctcccgctgttagtgttgctgacttgcctcggggccaagccatggatacgtgcctgatataggcagctctcaaagacttgtgttgaagcaataaccacctgcattagctgggcaaaatatcctttgctgaagcaaatatcttcttttttttttttctaagacacagtctcgctctgttgccgaggctggagtgcagtggcgcgatctctgctcactgcaactttcacctcccgcgttcaagcaattctctgcctcagcctccccagtagcagggattacaggcatccgccaccatgcccggctaatttttgtatttttagtagaggcgaggtttcaccatcttggccaggctggtcttgaacttccgacctcatgattcacttgcctcggcctcccaaagtgttgtgattacaggcgtgagccactgtgcccggccacaaatatcctttttaatatcttttttgtgtgtgtgacagagtctcactctgcagcccaggctggagtgcaatggcaccatctcagctcactgcaacctccaccgactccagtcgtgggttccacttcaccactgcaatcgtgggtttgagagattctcccacctcagcctcccgagtagctggaaccacaagcatgtgacaccctgcccggctaatttttgtattttcagtagagatgggttttcaccatgttggccaggctggtctcgaactcctgacctcaagtgatccacctgcctcagcctcccaaagtgctgggattataggcataagccaccatgcctggctgcaaatatcattttgttctctaggatgattgagtttataatgcccaggcagtctgagaccactggcagaggcccccatgaccattcgtctggcttagtgggcaatggggccagctagtctggcacattttctaccctggagtgcctttgatttactgaatcaggaaagaccctccccataccagggattaaatattttctgcaaagactctaaagtggacagtttactccaggacaatttaaactgatttatacatgtatataacacatatatccagatacttgacatcttgctcctaagagcagcctgcctcaagcctggtcatgtcactggtttgttcaagctctgctaggaagtaattttgttcctctagggaataattctaaaattgggaaggaagtctgttctagacagcaggaaaggatttcatggtgacatacttggagatccaatgtacaggggttgtcagcaattgggtccagcaggtgttaatactcccattttctagtgaggacaactgaggttcagggaaacctctcacccttcatttctcagaagggactgaaaatagaagtttcaatttggtgcctttgggtgtctctcccctggaggcagtataatttagcaggtaagggattagtccctgggattagtctatgtgaattcaaatcccagatttactgtttattaaatgggtgactttgagcaagttgtaataagccttatgtgcaaaatgcgttgttgtaaggattgagtgaactatttatttgaagtacatagaacattgcctagcacatagtagatactcagtagacagttttttgtttttgtttttaaactggagcctctcctgaggaagcattgctcctagaaagcctgcccagcctagtccagtaaatgctgccacctcactcctcccaaggtgagctgtctgaggtcacctcaatgctaataggacctcttcttgtctccacctcagggagtttttgcacaccatgtattatcatataatataatgcaatataatatcatacataacataacataatatgatgggtaggttaacttggaaaccctgaggcggacggtggatggatggatagatgaatagatacatttgtactaagtatacatacattatatcattctattgatttgtaaaaagttcccggtctgcctggctgtaatgagatttttgaactttgcgtggcgatcaatgagaggaatattattggcctggagaattgatatacctgctctcagtggcttgttctgctcccaggctgccccggccccccaggtgtatgattccagcagacacttaaccttttttacagtgtcatcaggctaaaaggaatctaatagtgacacaggacttgtgctcagcactctgccactattgctttcctgtcacaaataatttatagccttctatttccacccctgagcctgcaccccagccttgcctcctgcttcccccagctcccaggaatcaataaactcacatagccacggtgggacttcagggtgcaaggagacagacagacagacaaagagaggggaagtggagagaggagcagagaaggagaagaagagagggacagagagtgaaacacagagaaaagaatggggaaggaggaggaagagagagagctgaactagaagatgagtaagaatgcctggtgctctcttaaaaggtggagcgcttctctctttcttcttgagtttaacacagtgttaataggagtttcatgcagggctttcattcttactcacagagcctgagactgtgttgatatccaagttggtgagaggtgggggtcttccgggaatttaaccagtaagggagtggcctccccacctgccctgtcatcctttgctctgaagtcctgccacgaccccctgccatcccttgggtctcctgtggatccttgccagtgaccctagtggggcttggtccagcccccagtctgtctgcttgagagtctgacgcaacctccttttgggtcagatgtcgccgccgccactgctgctgtttcttgtcttctcaatgctcttcccagggtctcagtggcacctgcattgaccagtctggggcatactgggtagggaggtctcctgcctgcatcggcctaaattgaaagcacccgggcctaggggtcacccataggaataataatactggtcatcattgttattataggtagcatttatagaaccaaccatcatagtaatcacattacatggagtgtccctatttagtccttgccacagtcctatgaagtgtatggtagtattatcttattttacagagaagggaataagaaactgccaggggtttcacaggaaacaagtaacaaagccgggattccgactaaggcaggctgagcccagaacccatgtccttcttccttttgctgctctcactcccttggaagtgtgggagactctaagtgcctggaagtccccatgcggggcccaggccaaagccctggaggtccccaggaaagggcgagctctcatcggaaatggtggaggagaaagagcatcttgtgaaggaaagagaagtggggagcaggcaccctggcagggcagtctctcagtggaaatggaaaaatgacacctcccagcttctgagcagagctgtgtcctccagggtcccagctgcaccctccagggatctatatccagaacttgaccttccaggtcaaacctgcctggggccgtggaggtttgatgtgtgtctggctgtcttgtgaggccaagtatgaaaaagaattggagaaagaggaggaggaacatggggaaacggtatcaggccgtcatcatcaacaactgctttacttcattcatcctttagccccgagtgaaattgccatgagttgttgggttgttgtatgggagacaggaggacaatggatgaccatcagatttccatgatcccagttcttaaattctccgagatcagctctagggactggcaagtgcccactgcctgaggtcatggatggacaccaagagcattagtaactcacagcaggcaccctgcccagctcctcccccatgcaccaccaagccgctgtcagggagtagtgattttccatcactcgctgcctcagctaaatttgcgccagtgccctaggggtcagaggctctgggtaacaaagacagaaactcctcaagcccgtccagttctctctctcagccagccccacccctggggttcccttagtcaagagcccatcagccctcaagccagagccacccacaggcccagtgagctcacagaagctgttgctgcagtaaactaggagcagctgctctgagctgctcagcatctttctagacttttcttgtagatgattgtacactgcctctcagctactatccaatcttttccattgtgatcaaactccaaatcttccctccaactcttgggagatgaccttgccttctgctttgctgagagataaaagccgtaaaagctccttttcaaagctttggccacctgaaaatatgccatttctggctaacacctccctggagtctgcactccatttttccttgttctcccttgctctgttaatcatccacagtcccttaggcaacttcagtctcttcctcttcactggttcttcctcctcagtctacaagcttatccaggtctttcctacccaagaaggccttccctccacttagctgcccgttccatcctccaccttccatactttcctctcctttcgttttccaaaaacttctgaggcaatagtctccgtttactgccctgcctccttttactccctatgcattccctaaccttgttctgtctggctcctgctccagtcgctttgctgagactcctcctcaaggtcactaatggctaccagaatcccaaatctgtgcttcttcttgttcctaattcccttcggtccccatgttgctgttggcactgcaggttgtgtttttcttgaaacattcttctccactgacttaggtgaaactgacctatcttggttctgccatttcctctgcaattaattctctgaatcctttgcaaggtcagtttcttttcccagtccctggaaataaatgtcctccagtatccactccttaggcctcttgtcttttaaacactcctttccccggtccctgacagtctcctaaatccatacctctgtgtgcctgctgatgcaggggcattgcccctggacgctcctctttcacctcaaatgctgcacatctaggaccaacatcaccacttccctccaaaaccagtcacctccctatagccttattcctgacctgctgatgtaaactccaccaagcttccagttacacaaatctgagtttgtaaaaccatggttgactccagttggttgccaaactctgaccattctgccttcctcttgtcttgcaaattcttccctttctttcctgagaccagctccctatcgcctcatgcctcatgtatatgtatgttgctttactgggatctgtttgtagagatcccccctagtttagaaatcactcatggcttaaggccctctaaacctggttcctacatgttgggggcaggatgacaaagtaacaaaaagcatagattttagaggctgcattctgagtcttccctaattggtactgtgattttttttttttttttttttttgagacggagtcttactctgtcgcctaggctggagtgcagaggcacaatctcagctcactgcaacctccgcctcctgggttcaagcgattctcctgcctcagcctcctgagtagctgggattacaggtgcataccaccacacctggctaattttgtatttttagtagagttggggtttcaccatgttggtcaggttggtctcaaactcctgacctcgtgatctgcctgcgtcggcctcccaaagtgctgagattacaggcatgagccaccgcatctggccttttttttttttttgagatggagtctcactctattgcccagactggagtacagtggcttgatcttggctcactgcaacctccgcctcccgggttcaagcaattctcctgcctcagctgcctgaatagctaagattacaggtatctgccaccatgcctggctaatttttgtacttttagtagagtcgagatttcaccgtgttggccaggctggtctcaaactcctgacctcaggtggtccacccgccttggcctcccaaagtgctgggattacaggcgtgagccactgcacccagccagtagtgtgatcttgagtgagctacttaaacttgtctcagctttggttttcaatttgcaaaatgaggataatagtctctactttggaggtggttgtgcgaattaacagtaatatatatgtcatataaattgtgtataatattggcacatagtagatgttcagtaagtggaaaatggtgatggttctcatcacatccaagttttcattcttgtttcctcttagtcccttgcctgtctccactcattctggctgaccactctgggcattaacccagaaggcagcaggctcgcgtggcttccgcttccaccagcttgtgatgccctcccctctacttctttgttcatcttaggatcaagttattttttactggggaaagagacagtggagatcctgtagtccaaccccttcatttaaagctgaagaaactgaggcccagagaagttgagaggtgagaccaaggctatgtggcttcttaaatgcaaaatcagaagcaggactcagggcccctgccatgcagcccagtgtcctttccgccatcctctgtgcctctgatttcagccctacttggctttgaagatctacatcaatttccctctgttcagcgacttcttccgcagttccctctcctgcaaggggaatggttcctctcctccaagtttccagcactaactacctgattccctcgggtaactgagcttttttggggattaagtctcccctccccaccttcatatccagcactgtgagctaggggccttatcccaactgcctgcaagtgttcaggaaaagcttttagagctgacttgctcatggcttgtgactcacctggctggttgaggtgagcttggctcacatgcctctctgtggggacaaggaacgctatcagaaaagtggcttccaaaggcccctcatttgaccagtgggtagggggagcattcctccgtcttggccctgggactggtctttggcatcattgagccctcggtttttcagatccctgaaaagcaggctcctggaatgtttgatttggccccttctccccaggatgtacagggagggcaccagacctttcaaccaggctggcaaagacgctgcaatccaagtaagaacctcagaaaaggaggccagcaaaccagccagccatataggaacagggctctgacttgtttgagggcagtaagtgggctcaagaagagattgttcagcctgacatctggcaaagggactgtgtgctgtgttggagtcctggggacaaaagaaagggtcacctgtgacccagcccctccctggctacttctcattctttcaggatatggggaaatctcatcctctcaactctgaaggactgtgacacagtcccaagtaggaaagccagctccaaaatgatctcaaaacccaggaggtcctggtaccaggaagagatgcgtgtgtggttgaggagagaaaggtggacaacaagccactagggcagtcctcaccctgcagaaaaagaaaggatgctgtgctcactgggtctctgccctgatctttgctaccaaaaatcaaacaataatttgggtgatgcacatagcaggacataaggcaggctgcattcacccagagctgcattacgttggatctgcggagccaacagaaggaaaaccctgtgccttgcagcagtcagtgagggcagggacacagggagcagatggatgaggaaatcgctgaggaacttgggagagagcccctttgcagggctgggctggaattggccgggataggagtgggcatttgatgtgtgatgctgttgtgacgctgttgcagaatcatccggaccaaagttcagcagcctttccacccaacgccggatggggctgggacaggagtgaccgcccctggccacaccattggtaagagggctcagggaaggggaggaaaccagatcccacctagagaaaggcaggaaacgcagctccacccctgggaactgcctgcccgcttgaggtccagagcccaacctatttgccaactcctctcacctgagctcctgtccacatagggtcttcctgagagatactggttctctaggactgttctctgcctcccacttgtgtcacctccctctgccctgctttagtcagtccctatcctctcccctcctctcctctctcttaagtgtttttcttctagcatttcttcttctttttcttcttctcctcctcctgcttccctctccctcattctccaacatcttttgtttttatctgattctgtctccctacctgtgccctctttcttttatatcaactttcttattccatctttgtttaacattccatcttgttcttaacattgtcctctgtcttctccccttggctcctcttcttttctccctctgcccttccctctcttctctcttcttcttaggtgtagctctggctctgttctgtcttcctccttcctcatggcctctttcctcttggcctttctctcttgattgctcagcctctgtctcacccactctgtatctctcatcctttctccatcctcctcattctttgagccatgcttagggcctctcaaagacgtgacccaggcctactagaacacctgctaacactcctcctctgtccccaacgcacacagactagcttccctctggcccaaggagaaacttggtgctactgtagccatagatgaggcccggggtttgaggggctgggatgtggttacatttttcctgctgctcctcttggcagttgtctccttctgtcttgaccagcaggtaatagaaatgactagttccagccctccaggagttggcaggagctgttgtttactaggccagtgttacagtgtgtgctgggagggagggttgggccaggctgtacctgagttgatcaccatagagcgaatgggttcactaatcttgccctaagggggaaattaggagtttctcaagtgatttcaagaccaaaagcagctgagagagagaaatgcacactcctggggaacatcaggaccagtcttgtgtctcctggagaatcagagacagatcttagaaagccacagactctaaatcaggattggtaaagactcagcccaggagactgagaacaatgagctggggcttcattagaagggtttgcccagccccagggattggatgagctgtgcaagggggtatccaaggagctgtgctctctagaggaccatggaggtgctgcctagaaggagacaggtttgctgtttcctgggcctgtactccatccgtctttaggagagtgagtttgagaaccccagtgaaatccacaggtctgcagagaaggcctggggttaaactgggcaccacttacctcagggctggacagaagtgaataatagcctgtatatggcaatgcagtcccctcttaaatagaccccagaggaagtagaggaatgagaggaacgtgggctcctcatccctccttatgtcctctgcttctctctgccccccagccttggggctttggcctacgatcacaactgctaaactgctatcctgatgccatttcctccttcctctcatccagttcccagcacggcctcccctcctgtttccagcgcctccaatgacccagtgggatcctactccatcaatgggatcctggggattcctcgctccaatggtgagaagaggaaacgtgatgaaggtagggaggagggaagaggtgtggcttccccttcacatgctttgtccttggactccaagctccggtttcggcctggcctcgcagctgctctgctgtgagatcaattttagtagcaaagcccaggtccccccactgccctgctggctcctggagagagggagggtggctgctagtggggccatcagcttcaccatctgctcagcagccccggctgcctcacctgccactagggctcaccctatcgatccctgtgggatgtcaggaggagaagcaagaaccgtttaccttgggaaggttttggagttgggggaacagctggtctctggcctgaggatgaaaggccaacctaccttgtccttacctgatcccaatctgtctggaggtgaggtagtgatgtcatgtgcagcctagcctggtgtcctttctctttaacacctgcacaccgcccccagttcaaacctcacagggagctggacatgggacccctctctcctcttcttctccatgagtagaaatgccactccaaatcccctggccctctccctcacctccctgaaatgcctcaaggtgcagccaggctgttaggaagggtgtcaaagggaagggggaaggaagaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttcagaggattttaaagacatctcccaggaaagaggcagaatcctcaaacaatgagcataaaggggtgaccatctatcccattagcccagaacagtcccaatttatgcctgttgtctctgcatcttggccagtcagcatctcagcatctcccttttctctcaaaaatgtcgtgtttggacaataaattatgtggtcattccacacatagacaaaccctcggtaggggaagcctaatggagtgaggagcagagaaaagggacaacactgagcttgcctgggcccacagtccaagatcccccagcctaggctgagggaagagagtgggagaggccaggcccccagcggaagggacagcgtggaggggaggcctaggcctgacaagacagtgatgacctggcgctggcctccttccagaagccctaatggcctcgtttcacagggaaacagcttgtctggctctatttctccttcttccaaaatatccaaaccgatttggccgccacggcctttgccattcactaaatttcattgtggttgttttggcggcggcccctgatgggcagggggaggttgtgggaaaggccctaagtcccagttctccctgaggctccctgtgctcaggccttggccaagctccttggcaccccaagtgctttggtagaatctgcctcaaaccctaaaggtctctcccttaaccagcagcccctgtgttttttaggggtgagaggcccagcagcccatgggaggccacagatacccctctgtactctcccttttcagtctgaggctgtggccaagtatgccaacctcgtggccaagtatgccctctgctgcatgggctcctgtggggcaagaaaggctgggggtagggaggcactggcatgaggttgtggtcacccagggctgcgcctggctggcccagaacagggcgctctcctgagtggttgatcgccttcattgtttctaatcaattcagttcagtgaacctttcctggacatcagtttcaagaaaggcttggtactataggatcccaaagcagaacaagatatgattcttgtccttaaggagcttacattctagtggggcatgttaaacatgtgagctcaaagagcagataggcccatcagatatcctgttgcgatggaggtctggtggcgggccacaggaactgggctggggagggagtacatggccaggaagggctgctctttgaggaggggcctgagggatgaagaggagaatgttcagagacaatggtagcctgaaattctatctgatagactgagccttgtgaccagaaggccctttggccagccactgcagggcagctttagcagggatagaaggcacaaagagatgtggtggacagtaaggctgaggagacaggttagggccacaggatagcaggccaggtctagaccatagaaggagtttgggctttttttttttttttttttctgaaagcaggagtagtctgagcaggaagggacaggagcagggctgggtttgggaagctcatgctccagcagtgtgacagtgatgcaccagggccatgttgcaggaagcagtgaaagccttcaaagcaagagattacggtgcccccaagtttcctctgaaacatttacctgctgggcctatccgggtggcaagacatatcagaggcctcactcttttttgagagacggttctcctcctcttaccaactcctcttgaccaaccccaggccaaatggagatgtattttccctggtggaggcctggcctatgagggagaccagttctccctgacctccccctccaatcctgatccaccagcccctggtgggaagggagaggagagagcaaaggtagagctgtggcagcccctcctcccctttcccccactctggatgcttctaaggagccaggcccagtttgcattagggagcagctcagatgattaagaataagggagataattatgtgtcaagatgatgtagcccaactctgcagtcaggccaaggtagcaaagcagctggcaggccagtcacagaaggcagcctcgggcatgggctgcagacacccaggtgtgtccttcagtgactgggccgggactgcagcaaaagagaatactgaccaggggactaaggggtgttgggatgggactgagcacgcacattaaagggctagaccctagagggaatggaggggctcatctccctccaggaggacccttaaagaccctgccagactggccctcctttggccccaagcactgtggcatcttcctaggagtgtcataccccaagggcaagctgtgaatctctttgtcctccaggaagctgctcctcttttgctctgggtacagttcggcctattcttcagctctaacaatgtcacggtgatgggcattagtgaggacaatcactgcagtgagtgctggcattattggagacaatctcagcagtagttattggtgttcacagtgataatgcccagaacattattggcactggcactcggaatatggacagtgttattagtatctgcagcaatcatttccctggggatattaggaaaggactgatcagctgtgactctggggaaaaactggcagtgactgtgagcctgtttgagaccccttcccatgccttggcctttgagagtatggaaaacaccccctgactttcccttgagaaatgtgctggtcaagaggctttgaccctcatcccaagagcccaggagctcccagaatgagacaggtagacagtccagatagatgaggaagttatgttctgaagcacccagaagacaggctgtccatcagtccgagaaggtagaatccccattcatatcattcaaaaatcctcacttcttagctgtaattatgggtgggcatgttagtgctggattccctgggccctttgaagggatgccaattccctgaacactgtgtgagctggtttatgtggctggaggagagagattcttgtatttccctatctacaatcaggctgaaaactggaagtccttcgcctttacccagttgctttcggctggggcccaaaacattgctgttcatcggtgatggtattgaagcgcagggcagttacacaacttgtccaagaatccaaatgaagtcatatggtgagaatctgctggtctgtgtgagggaggtgtgttgggatcatcctttgaggtgtgagattgcagggggccatgattttgcattccattcattaggtgtacaatgaattgtgccattgagtggtgccaagctggtgcagttgtgcgtttgcaggcagggcaggttgcatggctgcagatggccgagtcctgtcactgcctttaatagctcccttctgctttggatgaagccataaatggaagaagcagtttatttccttagttagctaccatcctagaggtccccaagagtgttgctcaggttagacttggagcaaatgaggggattaagccgtggaaatgagaagcacctgcccttgtctacgagcctggcttgaggcagcagaaggttgcaaagactcccaccaggaaggaaggcacagggtaggagtgagcatgccatccctagagcagggcatggatgggcagtggggctcagtgggaatgaatgtggcctctggagtgagcacagcagggtctgaatcctggtgcccctcactagttgggcaagtcacctaaccttcatcagctcaatcttctcctctgtaaaatgaagatggtaatggcacttccttcctgggggctgtggagaggattccatgaggtcgtgaatttagtgttgagctgacttcatcttggagacgcatccttgtgtatctgggaaagaaagcctaattggcaggtttatgtttcatgaggaaatgaagttgtgttagaaagaaatttatttgggcataggcgccctaaccttggtgcagctccttgtaactagggcagcctttagtggatgctgggattagctaacccggatgggaccagcgcagtggaggaaagctgtcgtcctcacacccgggattgggagaacgtttgtccatttctatctgttcatttactctgtggttacccacttgggccacatgtcatctttcagcctccacaggcattttaggtgtgtataaataaataaacataagatcctcttctttttctaacatgtgggcatctctccctctattcatctgtggacattactgctcccacatgcaagtttatttctttaccttggaaaatgtatgtttgttttataaacccaaatgtaattttttacacagtttatgcaagtgtgagtatgcatgtgttctaccgctctgaggtctttgggtataaggggatgggaatgtcatgcactgggaaggtgtgcagttacctgggtagtgtgcgtgcttggagagagtgccgggtgtgactgtgtgagcggggagagctctaagccaggcctcagtgtgttgagcgcccatggtcctgggcacaggcatcaccctaccttctgctgataaagggaggggctgtcctgagcctgcctccaggggtggcctagggcccaagactagggagactaaggcccttacagccaggctgtgagggaattgcagctcagaacccttgtagcccttagaaggggagtctggtctcccgatcttgggatcctgcccccaatcttctgcctgcctgtctttcgggatctctcagtgtttgtctgtctcttatttgctctagttgaggtatacactgatcctgcccacattagaggaggtggaggtttgcatctggtctggactttaagaggtatgagggccagagggaacatggcgtgggggtcaagggaaatagcttgggggtggcggttagagaacattcagagagtgggttcctaagggccagagcatggaaaaggaggagttggctcaggcttccactgggagacctggaggctaacagagtctcagggcctggattacttccgccatgggccactgatggggtttgggagctgaggccccggtggcctggagggtcaggcactcagtggatggggggtcactttttctagcccttggaaaaacaaagagcagatcgggtagtaaaacaaaagcaaaggagacctggaagcacctgacagccctaattcatcacagcccaagttttttcctgtgttcccattatatttgtttgtaaaagtggaaatcaattttgaaggtaattttctggaaagaatggaagggaggtgggagggccggataaggcagagatggtaaaaggaaaaatttaggccaggcacagcccaggggcagctcttggcaaggtgaaagaaaattgcatattcaatctccatccatgaatcttcctcactgctgcccgcctcctgcttgaaaacaatgaaggctttttcccaacgctgggcagggcctcggtatcagcctcactttaacttcagggtcattaattccctgattattgaaggagaagagagggttgcagcatcgtcaattccaaaggcaccccctcatgtgatcgggcactggctggggttgggtggggggcacccagggcaaagtgaggtgttgtttgagaaaggtgtgaggagcgaggaaatgggggagccactggactatgggggaaggaagccaggagggtggaagaaggcagtcattactgcatacctctgttgtgttgttattgcaaattaaaagtagcatgttccactccacagctatctttggggagggaggggcaccgagggaggtgggggatcttatcattgcttcttcagcagaccagccgtggtgtcaccgtgtgaggtgacatttgaatttacaattccgctgagaaaagccattaattcacaaattaacatttctccctctccctctctctttaacactctctccctctctcacatggatgtgcaagcaattgaaaagacaaaggaaatagccttaaggaagagactttactgctagtctgtgctgagattgctccccctgcttccagatagataaaccaattacctgagcagctctgctcctggccgcccgcgatcgcctccttttgtaggctgcctccatggctggattacactcggtgtatctcattaatgtaaaccaggcgtgccctggtcaccaagctctcttcccggctctccttctggaggggcagtgggaggagggctggggtcagtaaaggcaggcaaggaggaccccgaggaagaccagaggctgccactgcctggcttcccaggccctgggcactcgggtgcagcctgccatgttggctgaggctgatgggggaagtcggtgggtgagcgctccttggtgggcttgctctgaactgagtgagggctgggtatggctgggggcagaggaaggagacagggcctgagtctctcagcggcattttggtccagatgcagggggctggcagaaccagagagggatctgagtgctccctgcttgggaagagcttggagaagttttgctgagtacacactattttagtgggatgggattcagcctgaaggagcttggagagaggctgaggagggcccaggagacttggcgaggttgcaccatattgggtaaacaaaaacccagcacttggatacaattatgtctgtttaccacctaattcttgcatgcacacacaccccccccgacacacatacatgcacaccgacacacacacatgcacacccagccatccgactcttttgctagagaagacggggagaaggagtgtgctcccaggtttctaaagtgagcttacatcgtgggtagggaattgcagggcctctctctgcttttgctctcctcccagaccctggttcagcactgtaagaaggcatttatgttggtagggggcagctgagcagagtttttgcttctctctctctcttttttttggatgaagtttcactcttgttgcccaagctggagagcaatggcaagatctcagctcactgcaacctctgcctcccagttcaagcgattctcctgtctcagcctcctgagtagttgaggttacaggcacctgccaccatacctggctgatttttgtattcttagtagagacagggtttcaccatgttggccaggctggtcttgaacttctgacctcaggtgatccacccacctcagcctcccaaagtgctgggattacaggcatgagcgactgtgcccagcctgagtttgtgcttctctaaggagaggtgctctgtggattattggtgggattctatgatttcacacactgtactatctagcacatcacagactctcccctccctaggagacaggccctatgaaagtccagaaaccaaatctatatgatggtaaccatctgtctagacaagtttctgactttaactgcattggctcaacctatgttcattttccaactcatacccaaaacctggctaaggtccacttagtccaagaaagagctgaggttcaaaggtcagcactcaccaaaacacagggggaaaaaaaactcatttatgaacacacattcattgctatgattatatctccctagtaaccaaggaaattaaactgttcatacctgaggggggaggttttctgtcttagttggatcacatattttagccaaactctctgggtagagttggccgtgagcctgttgaatactgactatgtcattatccagaggtaggtgtaggttctgtcgatgttttagaaggacctttatcttgggccctgtgcataggtgatttgtactttttttgtggggaagtacaggggtttagccctggctgtgtggatcaacataggtgcatgcatctgcatataagtccttgcctttatatcagagacagcagccaaatcaccaactacctttgcttcccaactagttaatgctgttgtggatgaagaattccatctggttgtttggggaagtattttgggatttagcacaaaagagtatatattttttcatacaatgccagaaattcagaatagagaggtcaattccaccctaccaggagagaatatacagaattgccctagaggagactgtatgtgtccatccaccgctggaaattggggtgggcgggtgtaggtataccactgtctcagcaaaggctgtctggtactcctgcccagctccatgtttgcaccctcgtggacgagcacccatcttgtcagaatacatcttcaacttcctagtctttcacttggcaactaccttccagccctgcaggtaggcattgttctcctttcccacccagcaagggcaccaagcaggaaatctgctgcctcagctctgcccttcttccccaagcacaggctatggaagcaggaaggaggagatgagcgccgaagctatccccgggccctgctactcctgagttcacctccctgggcgcctcttcctctgcagacaagcaggaagctgagaagcgcaggccactggaaaaagggtttggagaggatgtaggctagggagaccccagatccctgcctgccagcggaatggtcctggcagcctccttgaccattgctgcccgccctggagcccagaaaaggacccctcctgccctgccttcctcagagccatggtggccttagggctgtctgggaccctctccattttgccccattggggtggaaaggcatagagggctgggggagggctgggcctggctcaggggctgcgagacagatcacgagcctcagagccaagttgcagcctcagagccgagttgcagcggagccagtaattcaaaccatcctgacccttcggtgaacctgaacctgctgaccttgacagcactagacaacagaggcctcacaaacctcaacctgcacggaggcctggccttccctccctcccattcttggagccctgtggcccatcctccaggtggctcctaatttggctgcccccatgaaatgtcagcatcccctccctccctgaggctccgcctgcctgcttcaaagcaccctttgtgctcatctctactggagacaagtgtgtgggcatctcctgggggcctttccaggactggggctggggctttatcctgcaggcagagcttttacaccttgcccttctctttctgccccaggcttcacctttttcaggaggactggctagagtgtgtgtgcatgtgtatgtgtgtacatgtgtatgtgtgtgcatgtgtgtaaggttggggtacacacaggggcagcagtagaatgtgatccagacagcagacaaggggagggaagagaagccagaggaaagcagctccaggaacctgcattaaagtaaatgcagtttatgaagtttatgctttcctcctagggagagctggattccatccaacagcctcccagagcctgccaaacagctcctgaagcagaaagtgtgagcaggagagcaagcgagccagtgacagagggagagatgcgcggacacactcacacacccttgctggctcacacagatctccctcggcccaggcagcctgggaagcctgggatggagggatggggacagtaggtttggtaggagtgactccaggagccgttctttcctcctttcttccctcctcacctgccatctccatctctttaggcagagtgcccagcatgagcccttgggcagtgtgggcacctgggtggactggtggtgtggggagccgagggcactgtgggccacctggggcagccagcttgtaggagccgcctgggtgagggacagtgtgggtggtcttgggcagtgggtatgtggtccaggcagcaaaagggaccagaatgctatacaaaggaacctctagggacttgctttttcttcggatgctggggatccatttttctctggcattttggtctgaaccatgtgggtgccttacagccactgaagataattattggagtcttttaaggagaaatagagaccgtattttttttcctggtaattcaaaggaaataagtggttgacaatgttaaagtatgaaagctcacagagggacttaaaagcaagttggaatattggagtatctgttcttctggactcttcttcacgtgcacaagcacatgggttcgtgcgtgtgtgcactaataatgtgtaagtgggccaggacccttgactttagatgaaaggggagtgtgggggagaaaatgcctggagaggaagtccgcagcataggcctttgctctggcctgtgggcttggcaccatcatgttgcttgcccctatggcttctgcgacatacctcagctggggacagacagtgagaagtctatctcccttctctttctgggaactccatgtctgctctattcaaattctaccaggaactgagacagaagaggatgacagaggtagaaccatccagaagcagaggatggggagaagagggcaaaaggatagcgaaggatgctcagaaattgctgactgtggaggacgccttgggaagccaggaggtgctaggcacaggaggcagaaactggccaaggatggcgttggtcctttctcccccctgctctctccctccccctccctcccctcttccctccacacatctttattggttctggtaatagcgttgatttgcatgtcaggcaaagccttgctacacacacaaaaagaaaaccccagccctggcggtgtggcagtgtcagctctcgctgttgttcgacagtgtaaaattaaattaataaagcccccaacacaggaaaacataacaggaaattaatggcctttactgtcgctctgatgcagtcatttgcaaccctgctttccgcaccaaagacttcataaatgcaagcagtttctctaaacaagcatacttagggcggcctggtatgtaatttttcgccttgcttgtgtcctttgagctaacaaagccccctttcctcttggttccagagatttctaactggttctggcccctgctggagccaaacggggacagcaccaggcagagggccccacccgctccctgagagcccagagaaggctgggaaagggctagggtcccaggagctagacgctcagtgagccctccttccccaccagcccctgcagcaggccagcaggactgcataccagtgctcccaggcaggaaagttgatctcctcggggaattcccctaaacccactcaaggctcacccctctccttcctccccgggtctgtcctccctctcccacaacttgtgtgttcccttcctgaggcctctggccttcacctccctccttgtcggtacccactctccaccgttccacttcttaatacatggatcgcacacatctaggctggctgtgacttggcagtggggtgccacgctcttcttctccacaggtaacctgggggctctttttcgggggagctaagttattcaaagtgaggaaagtaaatgtgctggtacaattccccggggttctaggtttcctccatatctccctcttctctaccggttggttaggaaatgccagggccctaaggggcccctcagacaatccctctgtcctcggcagttttcagtgagctaagagtccttgactgctttggtgtgtaaatcggtaggatactgaggaaactgacaccttcctctctggcctctctggggatctttgtatcaatgtgggcccaggtgcccagtgtgttgggaggtatgagaggagcagagaaccgggatgtgactctcaggagcttagagcctgctggggaaggcaaggctgttgcactcagacaattggctgttcattaaatgcccagacacatggctgtgtgttccataggaatctggggaaatggactagaagggcaagcaggaaatggggcttcagcctgggagcctgggagtggctgagattgagagaggccttggctgggctggatggtgacaaggcagagtgtcagattcttaagggtcatcctgtcttatctgccactcaccatagaactctttcctccaacagttctgcctgaaaggccacagccctgcctggacatatgtcagagatggacagtggccattgtttgtttgcagcatcactttataccaagtcatgcgggttgagggaagaccacgggacgtgggatccaaatgtccagatgtgggtccatctccactccctacttgctctgggaactttgactcattacataatatctctgaatctcagtttcctcatctttaaaatagaggtaatggcatttgccacagagaatggtggtggtggtaaagctctccatttgacaccctcccttccctatcctccctccctccctttcatccactccaccttatttactgagctcttggcaaatgctgggctgggtcctgggtggatttcagattctcacatgatatggttcctgcccttggagttccctcaccatcctggttacccatctcagaattcattattgaaggttaaagttcctctgaaatgaacactgaactccagagacagtctaaccaatgccaggcacagtagagccttgccactctcccatctggagactctacatccataatatagcctaagattacatttgattttttagcagccatgtcagactcaagctcatattgagttcgtggtcaactaaaacctcgagatctttttcacatcaattgctatcaagccaggtctaccccattctgcacttgtgtaattgattttttttttagcctaaacatagggcattccatttatccctgctgaatttcaccttgttggtttgggttcttaattctacccgattaaggtcataaggatgtcttctatatcatcatccaactagttttttgcaaaagagttattttccttgaaaacacaggaaagccacatggcccaccaatggggacctcctcctggctgctgtaagtgaatgaatgctttgggaactactgagcccaacagccatcaatcattttacttgttttcatcttgtccattatgctaggaaggagattcttggttaaatgttaacactcactacttccacataatttccttaataaattatttttaaaaatctggtttacatcgatgagcaaattgagtgcctgctatgtacaaagtatggcaggactgatttacaaaggtaaataggacacagtccttgacctcaagaaacttacaatctagcagggaggtagacatacacatcattatataatcagaatgtgatgaatgccgtgatcaaggcatgaagtcatatgatgaacgaaaaaaacaaaggagcagttgcttccactcagggcaactagggaagtgtttatgagggaggtatttgatctaagcgttgatatggagtaaatatgccacaacttatttttgtgagtgcgtgcaagctctgggatatcaccattttcttttctgttgcccataaattaactgtataataatttcatttaaaggatttccagagcctgatcctgaatttatgattttgagtgtcatttgcatatgtgtacctcttcccccttttctgacaggcaggatggccttgggcttgtcactgcctcaccctttctttgtgacatctcagggatcatcaacagcagttttagggtcctgtgtggacctgggaaagttcactgaaatggccagaggttacctgcctggcccctccctgaccagggcactagtgccctcctactgggctcagtttgaagattctttcatttggagaagacaaaagcaagctaaggttgagaagttctgccttctctctcaatattacatcctcttccctaggactgagccaaaacctgcctttcttttctttctttctccaaggcccttttttgttgtctcagcttgttctgagcttttgtcttcctgacaggctcatgccaccctcatatccatccttggttatggtccccgcttccatctgtcatgtatcctgcataagaggaaaaaaagtgacttctatgatcctaagtgcaatacatgctcattgggaaatacctggaagagatagtaaatttttaaaaattcactcacaatgtcgtcaccaggagataaccactgttgaatttggtatattttcccattctctttcttttttgtgtatatataattttttaatcaaaaattgaacaataccatataaacagcttcatgtcttgccattttcacctaacattacttaatataggaccattttcacatatcattaaatattctttgaaaacacgattttttaatggctgcataatcttccactgttcgatgtacatgtccttttaaaatctgggatcatcatattttaaagcttatctgtgtgcaacaacagtgattttcctgaaatgtccttctcttttcacccctcccccactcccactccctttatgctgtcaggttgattatttgagcttatagaagcagaatttcatttttagagcatcccatcctcgtggaattatggtctcttttagaatctcttgccatggaatccctggccatgtctttcccccagcatggagcattttgctttcttcagttcagattctgccctgcacccccttcctgagctactgccaactctagacatgcttgctttctccctgcatccccatcatttccctttcatcagtttttctttcttggtcagaattaagtggcctgcaatagtggaaagggatctgagctaggaacctcagttcccattcttatgacgactagctatgtgacatgggaaaattacctaacttctctgagcctggcttttggtttttgtcttaattttaaatatctaagagggaatccaattaaattctcttcatattttccagctgtagaacatgagtgacactgaattcagagtagcagcctcctttgttgcttctttttccttctaaaaggtaaaatgttgagcataacaagttaagaactgaccaatctttgcttttggaattcttgtcaacaaatcagccaacattcatgatcactttctctacatgaagtttataaagttgaaaactatgggacccctgccttcaaaattcacagttcagaggagaaaacaaacattaaataataactgtgatacgaagagattctaaatttggctctgccacttattggctatcataagttgttctgggtaaattacctaatctctctatccctcagtttccccaggttaggagcttagctgccagaggcatgttgccagggttgagttctggctcctctgccatctgtgaggcgtgtaaccttgggaaagttccttaatctctgcactttcatttccccatctacaaaatggggacaataatgtttaagttcttgtgaaaattaagtgagttaatatatgtaagattatcagaggagtgcctgatatatactaagcacttaataaatgttagttgctgttattgtaaggattacatcagtgcatgcatgttaagcatagtgtctggtatccaagtagaaactggatctgttttagttattattagtactatttctacaatagaggtttggatagatggctgttagaatgcagagaaaggagaaattaatggtgagggaggagctaacagccctcttgtatatgtctgaggaaactcaatccagaaaagctcaggagatttatagcaagtgagcaacaaaactaggatttcaatccaggagatgttacttctggtccagcattgtgttagggtcactagtacagttagtgtccctagaggccggtgggtgtgaatgggtacagcaagcctgaggtcagacaggcccacagccaccccagcctctccctattcatgaactcactgagtgtttagaagctaggcttggtcaagtacagcaggtagtttcccagggctagaaggctgggcagaacctggtcttgccccgagccaaggtttgggccagatttccaaagccttcttcatgtccacctcttttttttttttttttttttttttagacagggtcagggtctcactctgtctcccaggctggagtgcagtggcatgatctcaactcactgcagcctccatccccagggctcaagtgatcctccaatctcagcctcccaagtagcctggaccacagacacatgctaccacacccagctaatttttatatttttggtagagacggggtttcaccatgttggccaggctggtcttgacctcctgagctcaagcaatctgcccacctcggcctcccaaagtgctgggattacaggagtgagccactgcacccggcccactttatgcccacctcttgagcttggcttgggaactgtggccaggccagactcactgaatgtccagtttaaagatgggaggcaatggggcatatcatccatctccctggacaagcagtgtcaccatagctcctttcccagcccggccctctggagccccttccctcctctctcctttttcctatctattcctccctcactcccggaatcccactttcccctcatcctctcttcttccctcccttctcctatctcccttacctctctcttcattcctgaacactccttccttttctatcctcctccactctcccttgtgactcccccacccaatccatcaatcctccctcctctcccagtctggacagcacctgacctctggggagccaccccattcctcagctcccaaacctcactccctgttcccagttggacctccacctccctggtcctgctgtgccgccgtgggggtggggctgggcctgcacaggcaggctgccctgaatgacaagcggggatattgatcgcgttctgaactcagcccagccgatagaaggtaattaatgactccatttgcctcactaccgaggagaacaattgagtttgaaactgcaacaactggcagctgggaagactggggggcagcctgggggtgaacccctcagaggcggaagtaatgtgtggagtagctaggcagagagagcaccttctgagcagaggccaccatcagaacgggcagagcccccatccccagcacagctggcccctgagccccactgctcccccagcccttgaggcccaaggcccatcacccactggtccccccacctccacgcttttctcttttcttcccatatcactttttgaggtcattttctgcctgcggatgaagactcagttttcccaagactgcttcttgccagctgtgcaatcttgcacatattttgaactctccctgagcctgtttcctcgtttgtaaaattgaactaacagtatcacttttgcaagcattctgtgaagactgtggataatgtgtataaagtaccttgagcctgcccagaacacagtaagtgctcagtaaatgatgatgggtccttgacagagaaggcaaacatggtagagtggagagagcttcagagtccgacatccctgagttcacatccaggctctgctgcttcctagctgtgcagtgttgaacaaataattttgcctctctaagactatttccttttctagaaaatgagagtagtaataagtacctcgtaaagtttgaagaggttgatgagtgtaggtgaaagccctaatatcattactttctccatagacagatagatgtttgtatttgagcttagaaaactgaagttagtgtaattctttttttttttttttttttttctgagacagagtctcactctgtcacccaggctggcatgatctcaactcactgcaacctccgcctcctgggttcaagcgattctcctgcctcaggcctcccaagtaactgggattacaggcgcccaccactacacccagctaattttttgtatttttagtagagatggggttttaccatgttggccaggctggtctcgaattcatgaccttgtgattcacctgcctcaagcctcccaaggtgctgggattataggagtgagccaccgcgcccggccaaagttagtgtaattctttgctatacttaaattcttctcaaatacctcatcttgcttcctgggatttgatgggcaaccccgttcatcccaccctgattttgtagactttgatgagccttggtgctttctgcccaagcaaatgacatcatttcattttcattttctttatttttcttttcttttctttcttttttttttttttttttttttttgagacagggtctcactctgttgtccaggctgaatgcagtggcactatcttagctcactgcagccttgacctcccaggcttaagcaatactcccgcctcagcctcctgagtagctgagccacaggtgcatacaactatgcccagctaattttttatttttgtaaagatgagtctcgctatgttgcccaggctggtctcacactcctggacacaagcaatcctccagcctcagcctcccaaagtgttgggattacaggcatgagccactatgcctggcccattatttcattttatctattaccaccacccccaactgtctcttgtcccttgcagtgacccttctgtccctagccctgttcccaagacagggttcagggggtgtctccctccccaagctgctgagaacccactggacaactccattcatgactggccagtgccagggccctgacctggggtgagaggtgtgagatagggcccagctccagggccacccaggaatagatggggagtgagtgcagggctgaatgaatgaggagatgagatattttggttgaggagtaaagacatttttaatagtgattttagaagtagcacatactaattgcacaaagcctggatggtatggaaaaacttagatgaaaagaaaataaaaattgcttgtgattgggaagtaaccactgtcaccatgccggcagctctccttccagtcaagttgatctttggttttggagttctcttcgtttgcctggagactagggtcctgctgtcagtagccccacactctgggctctggctgggcaggcagccactctgtccgtctatttagtccacagctgtcagggcacctgccctgtgccaggatccccagcaaatgtccccttgagccagtcacttgccctcgcttcacctgcacctcatttactctgagcctcagtttcctccccagtaaaaagggattaaaatccctacctaccttggagagtggttgggaagcccatataacctaagatctatgaagaccttttgttaaatgctaagcaaataggaaacagtcagataagaagacaatatgagctttgttatcctcgaaagaataatctatgtcaaagttttgactcagcagtttgtttaatcgaattaatttatttacatactatctgtgttccaaaaagacctgtagtagctcacccccttgagagtgctcatgccacagtggacagagcacctggaatggcccagtcctgggagtcccattccccagttgtgtgaccttggaaaagtcactgcccacccctgctagttatggtaacatgaaaaatttggaccagacatcctctaatcatctgggcacagtctgcactcagccagcacctgtgccacaggctgtagcctccatttggggagggtgccaggcaaagaacgagggatgccgagaggaaggctgtgccctggatggagccaagtggccttcaactgggcccactgtgtttggcacccaggctgcagagtgaaatgatttagagggcaagctctgtactccgacagacctggattcaaatctggctgtcatttactagcttcatggcctttgacaagctacttaacctctctttgcttcagcttccttatctttaaaatggttatcatagtagttccctcacagggttgtcggaaggattaaatgagctctgtaaataacagcaatggcatgtaatgagttcttgatacttgtgagctgctacagaatgggagctgggcagggggcagacggagaatgaggctgaaccctccctctatggggactgactagcacacggtcccttccttgctctgtttggtcttattaaacccacagccaccatattttccagccccaatctaaaaatgtggccagagaatggggaagaatactggaaatcagaattcctcctgaaagcccaggacacatgaccagcagcctccagccctcttggtgcagggagttcaaatgtagatgtgttctccaggccccagtcttaagcagcctctgccacctgctttggatggcagctcagcagccccggggttaagttctgctgctcaccaggaacacagtgttctctgtctattggtagaggcaccagagatgggcaggatggtgttgctgagagtggaaaaggcctgtgcgtcagagctgatgctgttagaggctaacaagcagtggggatagcacatcttttgctagccagggatgtgtggggcttacctgatgagagactgggtgtccttgggtgccaggccagtcagatggccagtcccaaaaccttctgccagaggtatggctttgaatgccacccgggagagtctgagtacctactcggggccattcctgatgctggagctgcagaaatgcattagtcacggtccctgccacaaggtgctctttgactggctgctgggcctgggggcaaaggggctgttggataggggatcttctttgaaatggatggtgtctaatcactcacgcgctctccttccctgctcactagattaagatctgcttttacatcctagaaacctagattaagatcggcttctgcttccacctctgtttcagcccagctctgccagacagcccttcaacagctgggcctaacagtggtctctttcttcctccttgccgtcccgtctgagactttgcccttggaaagtcccatgccgagctcgctccccatcttcccgggagaaccctctaggtggtcagcactgacagctgtcttccttctttcctttttgactcttcctcctttactctcttcttcttttcctcctcctctccttcccctgcaaagccaccctcatccaggccctgggcagagaaggtatcaggacacccagtcttcagcgaaagtagagccagctggttttattcctgcagtaagtgtcctcaccccagccagcacttccagcttctggtgcggaaggcttcttccctttcttcccctccttctttctgcccttccacgcctctgggcttcctccttccctgagcttatcctccttggaccttctgatccagggcttctcccaacctcctttcctcattcccttcctgccctctctccttgccttcattcctcccttccttccctagctgatggaaggatgccaccccctcctctggaaagagcccttgagagcctatggtacgtgtggtgtatttggagggctggctggctgtcccccaccagtaatgccactgccctctcctgggccctgcggctcacctccctgcaccccataagtttctttgtgctccttcgccattcatcatgactgctgccttccttctcctacaggagttcccgcaagcctcctccagcctctctggggggtgggggttctccgcatgctttcatcacaccactttgttttccttctcctctaacgcctcctttctcctccccacttccctctcctctgcttccccgcctcccactgccacctcttccagtagcaggcttccttagcctttgcctcctttccctcccccttcccctcctttgctgcctctgtaacctgtcttaccaccagggcctgagtatacaaaaaaataaataaataaataaaaaggtcagtgagtggagggagcagcaataacccctaaaacagtactatcagtggaacatgattgatcaattgaattccatagcggctgaaaaatgtgggattaagtagtgtattatacgcacaatgagttgaggcatgatgttcatttcaagttcatttcgccggcctctgccaccagatcaggcaatcaataggggcagcagatatcatatatcacctctctgcgggccggggagagagcaccataatctctcgcaaatttagagtgacagatttgtcaagatctgaagggcccctgaataaatgaaggcaaagagactcctccagccagtgacctgaggacaaagcttcagttcagcccctacacacacacacacacacacacacagacacagtgagccaagccacacacagacaggcatatacacaaatctacacagaggcatgaggagagtcctgccacacatgcacacacataatgtgtgaacacacgctcacaaatacaccctctctgcccctacaataaccatatatgaagatatttgatgctttcctcagccctgagagtccggcttccccaaaaggtaggagggctccaggaagggagaatcaaacacaataggacacgcaaatagctacagggagtgaaatgaggatgatggcacatcctgaaaaaagaagtaggcacaggagaaacggggcatgtggcctcacagtcctcatgcaatcacacacagacacacacattctttcaggaagcttctcattctatttccacacacgcagacccttgtttatctggacgtttatatatgtacaagcgcgtagacacgcaatactcacacaaaagggaaaaataaatttaccacacttcaactttcaactcatatgttgatgcatacatcccgtaagactgaaatgattccagagccttatgcagaagaaaccacaaccaccaagttttgtgttcatgggaacaaataccattgaagctgcttctgtctgtcttcttcagatgtggtcctggtcttgatctctgtctctctctccctctctttctctctctccttctctctctctctctctctccttctctctctctctctctctcacatacacacacacacacacacacacacacacacacacacacacacacacacacactttctttgctttcccaccccctccagaatagatatggagggaagatgggaggtcacattaggaaagcaaaccccatgctcggtctgggaggccagcaagggaggatggctgcaggttgagttaatcaatatgtaatattttctatggtctcctgaatgatactgtatggtgttactgtatataatgcaatattgattatatcatatcgtataatcacctataaactgatatatataacattcccagaggaacaccctggggcctccggcatgggctggccccaggcccaaggctcctcagctggtcttgggctgagggaagcctggagtgaccaagctggtatggggtttgggggggaaaccccactttggggggctgcaaggtgtgggttcagagagaggccacagagcaggcacattgcctactgtacaccttgaaaactccaaggaaccgacgctgggaggcaaggataggggagggctgagaacgcctgaggaaaggggacatggagacaggattggcctgtagactcaggggagcaggcaccggtgtgataagactctgctccctctggagacttgcaggaggaaccaggtgaccaagaaactggctcctgtaggaggcttgagcctgggtctaggttggagacagaggccgagaaggcggccagggcatagaggcatccacaggggcccttctgtgggctctgcccaagcgggagctttgctgctctagcgacacctctttcctcccgcttggtttccctctggcctcagtcctggcccaacccaagcagagtgcctcagctctgcctcagagcccctcctccctcagggcgaagttgattacttcacccagtctccaggttacactcggcctcggaaatttgatggttttcaacccttggaattagtggaactgaaattcatctcggagccgagttcaattctccacaggctcagtaatgccagtctgagacacccagcttctttcttccccaggctggccctggcttgggggcagggggtggttcagggagacatgccccagggagctggctcctgggagccccctggctccacctctgcctaatccttcctgaccccacagtgtgaccgctccatctcttaccaggtcctcaggtccttctcttccttgggcttcctcagccagatctctgaggcagggccaccctctggtgtcagccccactggcccaggggctgagagtaaggggtcccataggggtgcagagctcctgggcccggaaccagatgcccacctctttgccctgcactgttcctgtgcctctgctggcctggcgctaacgccccgagtgtccatgtgttctccagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggtgaggagggagctttctgcttgcagaagtagaaaggagccggcagagcaaggcctctcaaaaacttgttcactaaacaccacatgcatagccagcattgtatgtgttacacacgtgtgttctgtgtgtgtgcagtgtgaacaggctcacatgagacagtatggtatcgttaagacaaatcattatggtctgtatatggtaattagaaatgagttctgggtgcaagagtatggccttgggtaaatcatctctgttcagagcctcggtttccccatctatagaatgaagggcttggatgtagggtttgtcaagtcccttctagctccgcttttctgtggttcttgcatggagtactcaggaacatcctcttgctgtgtcccttgcccacaccccctcagggtcctacagaaagtctacgctagactggggagctctccttgcccagtgtcaggagagcctgcctgtgcctgcctcctgctccccaagccagcaattcaatggaaccctaggtaggctggcagcttcccacttacacccaacactttctgcagacactgagcagcccaggacacatagcatggggcacagcatgtaacacaccagcaaaacgcacaacgcagaaaccatctccgaacttttctatgtgctggtgtgcatgtgctcacactccaccatccacctgctcccctcacccacagcccatggtactgtgctcacacaccactgtccacctgctcccccacccacagcccacggtactgtgctcacacaccaccgcccacctgctccctcacccacagcccacggtactgtgctcacacaccaccgcccacctgttccctcacccacagcccacggtactgtgctcacacaccactgtccacctgctcccccgaccacagcccacggtactgtgctcacacaccaccgcccacctgctccctcacccacagcccacggtactcacagctagccccggcagccgcatggagccagtgggtgtgtgctgcccccagatcaccagctcagcatacccctagcatatgcctccacccacatacgctgggtggagcccccagcacacccgctcccacacaggggcacactcccatccctgctacacatgcagcccaggccaggcccacagtcacagcacaagacagcattgctgtgcttgcatgcatgcacacacgcacccacacatgcacgtcagtgcagccccacagcgttgaacgctgtagttccactcttaagactccaacagctcccagccactcgcctttctccccgcccgtccttttatcccataagctgtttgtcttcataaaacaaaaatcaaaagtctttttaaggtgccctgagccataaaccaacaaaggaggagctggccgaggcgggcggctcagtgcaccctccctgagtccccgcctgtattacaatgaataacctttatttactttcattagactattaaacaccagcacagtcatttttccccctgaaactcggagcagggcccataaagcaaatccgaagcctaattgagttcattttaatttctctccgatcacagcgaattactctggtgataaatcagggggcagcttcacccccagtagaaggcctaatttgcagctaattacaaaactgatttctacaggaagatcaatacgagaaggaattggaaatgacgaggcaatcccgtccagccatggaggggagggggtactctaggggggccaggaagcggaagggaaaaaaacagacccgaaagagcaggaaatcagttttaatttaacgtaatattaatcagagcaacttttcctgctttgtgcaggctcccggtctgcccagctctggggtctggcttggccgtggctgcaataaaaaggcaattacccgagtgtttcaggcaggacaccctttcagagtcaatgactggccccctcctacccttctgttagccatgtggactctccccctccccaatttcataccccagtgcacaggcagacagcgaggggcccatggggctgtcattgtttgtttttaaaaaaggggcgcccatacccgatcagccagcagtgccaggctgaaggccccactaggcccttctcccagctactggctctgccagtcatgtcatggttccccctcctccccaaggctcctcgacatcccatgcctctcaacaagggtatccccactactacaccctacccgcaggggtgcttaggcaggagatgctacagaaacataaagggtgctggcattaagtgcccaaaatgtgtaaagggtgctgtgcctccggtttcaccaagtcaggtctactacccgcacaaaacttgccatcatccaccaagcccccgcatctcccctctgccccaccatctctttctaccccatctgggcgggctcccctgttcctcctccccatctgcacaccgagccctttctctgtgcgtgcatcaatagagagctgtcacttttctctctcctcccaggggaacgagtactccctcccagccctgacccctgggcttgatgaagtcaagtcgagtctatctgcatccaccaaccctgagctgggcagcaacgtgtcaggcacacagacatacccagttgtgactggtaagggggcttccaggagggtgggggcactgcgttcagtggagggtgcctcagcccatgccatctgaggcccagtgtgaggagcaggtcccccaccgtgatatttacagagagaacgaggcttctaaaaccagggtgcttcctgaacaggggtgtgcagatgtggggagaaaaaaactggggtcagggcatctgtgggcttcaacctggaaaggctgatgctaggaggggctgttgccagttcttcctcctgtccttcgcctctccctttgtctatttctcttccctctcccaagttgcccagaatcatgagcctcttgttaggatgtctgcagaaagcaaataagccaggctggtgagagtggagcatgggtacccagtgtccagcctccacacttgggtctccaaggctcctgggggacccgcttaccgctccctccaggcagcatgggtgatcatggctttgggcttgagggcatggcacccagctctgtggagtttgagatgagtacaattattccagccttcctcctgcttcccagagaggtcagtgacaccaaggcttgatttcaaggccaggtaggatcaggcttggcccacaatcaaatgcagagctaggggcgccatggccaggagcccctacaaatgaagagcagcagggccagttagtttggaaggggaggtggagtccagggaaggccgcagagctccaggctgtggaatgcacgtgccactgcagaagggtttccaggccaggagactgcccaaatgggagagacacgcattgaggtgttattaaaattcacctaattattctggagacactaaagccaatgtgccgtttgttccttgggagacaggatgattgagaagggtctcggtggggattgggagacactgaggcgttacctgcagagcgaggcaagcggaggtggcctgcggacccagcagcagggctgcagagccagcggcaaaggcagggaacaggcaccgcccactctaggactgggccctggttctgcctgtgagctggtctgagtgcggctgcatttgagcctgagctgggctcagtggccacccagcctccacctgggggcttaggagagccctgtcagttttcccagcctctccctaaggggctgtactggtacaactgtttccagcctagatctttggctagggagtcagaggttgaattctagaagtgttggagacctggactgggctttcgggagtgacgaccttagctgggttagctgggccaggacacagcccatgaccaaatggccctcagcatgagccatccttcgcccagctgggaagctctctgacctgctaggtattctgacccaaggcagagagacggcccaggccaggccacctttctcctgacctgctcagaagtacagtggtcacttcccaaagatggccactccaggcactgttcaaagagaacccgggagacttctctaaccccatctgctgcccagcgctcaggccatagtctagaaggcaagggcttcctagggtggagctatggatcttcagggtagggctcctgccacaggagacccaggggctggtacagagaagtgcctccaccttgagcagcccccacccgcctcccccccatggccctggaacagtcccagctcagcctgggaacatctccggctgatccatctggatccaagtgtgagaaaagttcatttcagacccagcttgacattcccaggtggcaagttagcactaacatctcaatctgtatgcgacatttcaatcaagcgaggagtaacaaaagcagaaccattaacattcggagctgttcaccagtggtaatgacggggaaactcgctcagaaactggaaattaccaaaaagagacaagtgtgtggagaggtgggggagggaagatggggataggggtagggaatgatttttccacacttaggccaagatccactgtttggattaatagtgccattacccaagaaagagctgcagattatgctcattcttaaaatgtttttgctggcaattaaactgctgcagttattgatctttgttgattttatgtcctcctaatttgcataatctattaaagatgaatgatttatgatgtgtttattatggggacaaacagaatttgctagaggtactgtcaaggtgagccatggggcattgctcagagactccatatgccatctcagcagtgggtccagcatgttggccttcaggccaggatattgtgggtagtagtgagcagtgatgcaaggagaacagaaacaggagagtggactttgggtgagttcttctagaaagatactggcatctgtgagaactgggctccaggcagagctggagtgcgggagaggcccttagtgtatttgtggacactgacctcaaagagtctttaaaagcttattttcttggcaaatattaagggctttggtgggagaagagaaaaggaggctcttttaggtgggtaggtgattctggggaggtgtgtgctaaaggtaagggagctgttaggtcacccagtgcccatagcctggcttaggagtgccgaggtgttcaaggagccctctttatcctccacgtctcaggcaccctgctcatcttcttccccaggactgacagctgcggctgcaaaccttaggggatgagggaatgccctagcccaacctgaaaagccagaccttattgagattcctgccacctcctggccctggaggctgatttcaaacttcaccagccacttgatgcagctattccacaaggtcaggactgagaggagagaggaacctagactattgtgtggaggggagagtggggcccagtgggccaggacacagctaatcacattgcaagcaagggtggctgccggaggctagggctcagccccatagcctcccctccccaccttccatcagggaaccgaggagagagactgattttgctgggtagtgtttgcaagttctgccgagattttaatttcactgcatcacaactcagcaagctgccaagtcaagctggttatttaaatttatcacccactttcccttccgccgctgggctgctctagctcagcggcatctcttctctccagcccacggctctaggctgctggtctggaacggagcctcgtctctcctaagtgataaagaaagagggaccagctacatgagagaatgggtcacgggcattctggccccaggctttttcaggttggctggctgtggctggtacctctcatcaccttcttgaccctccaaaggagcccagaggggctgccatccacctctcagtagtcccagggccctccgggtcagggcatctgcagtgaggactcgctccaactgcatgcaggaggcttcattccttaaagtctcccatccctggaagaaaagatagtccctgttctccatagcattctcaccttgaccccccctccccatgtctggccggggctccagtgacaaaggagcatgcagagacactggcagtgatgttgatctgggaggagaagatgagaacttactccaggattcccaaagtcactggggatgtttctgagcattagagagtcccttgacacagtgcaagtccaccccgaaggagagagcccagatgcaaggaacagtgctggagaagtcagagactgtgcagttccatgctctctagaaaagggttggccaatcttttggcttccctgggccactttggaaggagaagaaattacttaagtcacacataaaatacactaacactaagatagctgatgagctaaaaacaaaaacaaaaataaaatacctcataatgtttgatgaaagtttacgaatttgcactggaccacattcaaagctgtcctgagcagcacgtggcctgtgggctgtggattggacaggctcgctctagaagctagggaaagcaccagtccctggagccactgcacccacaggcttcactggcctctagtgggcattgctgccgcgcactggcagagccttgagcaagtgcagctctcaccgcccttgttttagtcacagagaggtaaaggaggaatgagattgatgtctgggacccaggcaggctacctcaccaaaacataactgaataaaatataacaacaaaaatgttaatacgcagcaaatctcactctttggtgccagaaatagaggggaactcaaagccagatcagtattggagaggccgctggcatcacactggagggagatgctgactgggagaggatggggttgtaacacaccagtcagggaatgtgactttgggaatcaggaagccagaactgagtatcatcctgcataaagcaaggaacagaacagggaccacactgtccgtgaaaggcaaacacatacactcgtctgagtagcccagggaaacaaggaagggggcagaatggaaggtcaccatgagacatggagacgccaagcctgatgccagatcagagtccaaatttataccatgagtatgttgcaggaaacccaagccaggaacttacataaaaatttgtacaggatagtaacccattctgaaacctcaccaggagcaatgacaaaccttctttgtagagacattctaaaatccagggcacatgggactcccacagggggaagaaaaaaccccaccactaatgatgagcttactgtaaaaaaaagtacacatctcatgtgaatacaaactttcaaaagggaaagttagtagaagcaataaacagaacagttaacatccccccaagacctgggaacaatagaataatccaaaagtgctataaactcagcatgtttaatattctaaaaaagatcaaaggggccgggcgcggtggctcacgcctgtaatcccagcactttgggaggccgaggcaggcggatcacgaggtcaggagatcaagaccatcctggctaacatggtgaaaccccgtctccactaaaaaaatatacaaaaaattagccgggcgtggtggcaggcgcctgtagtcccagctacttcggaggctgaggcaggaatatcacttgaacccagaaggcagagcttgcagtgagctgagatcgtgccactgcactctagcctgggcgacacagcgagactccatctcaaaaaaaaaaaaaaaaaaaaaaagatcaaaggaagtatcagctgtatctttaccacagatccagatcccccagtcccttcccaccactgctcaccaaattgtcagataatggagatcaaaaagggcaaagaatgaggaccatacctatagattattgctttggggtccaggaggcatggaaagagctgagcctcaggcaactctgaaagtagagcctgttccaggcttgtccaggctcccagactgctaagcctcagcagaaaatcttatattttctttgagaaaatgtctgaacattagagagctagagatgggcacagtacctttctccccagtggggtgggggcaggtgggaagcctccgtagcttccccatcctggttgggggaaggtggttttattcaagagcttgggagaaatgtctcttaattgctgaagactgcagttttgaaggaagctgtaattaagatccaggaagagatgtggatgctgcccaagagggaagtgcccaaggcaggaagagggagcagaagaggctggtctcccagaagctggctgatttgagcagaggtaggggaggccagagaggcaaagttcacagctggacagcagcagggaccagtgtgagcagtgtggatgtagcttctgaaaagggttgccaactcagaagctcggcctcctggcccacatctgagatggtcagcaaagtggccttttagcagatagaggtgtggaccctgggaaacctcctcctcctactcagggcatcctgaggacctccaggaactgcctctttcctgtagttaacaacccccttccaatgcaactgcatttccctccataaaacaaacagcttagcccttggccagcccccgggggaggagagggcaataaagactgagaaatgtttctcaaggaggctgggagtctcctagtcttgtctgtcagctcaaagcccctgattagctagaggaatttagggcacagacatcatagttcctctccttgaaaggagagggctaagacaacttcagacgtgtggcaagtcagagatccctttactgtggaggccaaagcaagccagagggctgttcctcagtgctcacatgccctagacccttcctttaggctgtgagggtcccaagaaaagaggctagcctccttcaaacatccctgagtctgctggccacatccccaaggacctccagcccccaacctcagctctgatttaattatgggggcatttccatagcaatgagacattgacagatatgcggctgctctcggcctgcagcctagggagtcattggatcaggcctctttcccttcctcctttatccagtccactgatagaggtaaaggatatggaaaagaagaggccctaatccactgtcgggatcagagtcaggccatatttgaccagaataaaagctgtgccacctcaatctcaggtcccaatcccatgtccttgtctgtgcctaccggccaccctgtgctgctgggctgcccttcccaggagggtgccatggcagaagtaccctggctgagaatggggctgcagagggaggagcatcgtagggagggtgacaaaggtaggaagggtttggggtgtcttagcaaagacgtagttctggtgttttctacgctgagctcaaatttggcccttaaccttgggcctttcttcttacctcctcccttcatctcttccctctgtccgtgaggcccaaaaacctgaacatgccaaatggagtgcttattcctccaaggatggcctcacttgttcatcagagatcagagagagagagaaaggggccagtctgaatttgaatcaaaatattttctaagaaatcaatgatcttgctatcaagtgcataacaatagccaactcaggccaataaaggattgcccagttgagaatactggccactgctttcatgattcgtcaggttacgggacccttttggtttctgtagatgtcatttagatacttgatgtgtcccacaggggaattctccaaaaaagagatctcccagcactaagctttttagtccgttatttggtactttttaagaagaaaatgttggctaagtaaaagtaaggtcagtcaacccaacattttttgaatgaccggaaatcctaaagactgctgtcccaatgaaacaggtatgtattggtaccaagggctcagaaatgtctcagtggcctcaaagccacctaggcaagacctgaaaacctgtttcccccagagggccggccacctccaaggtgacaggaagaccccccacttttttcccagggtagccagaatcccttccacctccacaattagctgtagcctcaggacaaacaagctagtgcttttgcaaccctgagctttgggagacaagctccgccactattgtcacttctgagagggctttgcatgccttcagcctgaatcctcccctcttctccccagtggtggtggcggctgggctggcaggcagggaaggaggaaatcctgcagggctcggagaacagcctaatgctgcagaggcttaagtggccgttttccttgggattagggtttcacttacacagagcgcctgaaaaacactgcgcttttggaaggattagagctgacaattcagtgctctcagagaacaaaataaagccagagaggaactgggaggcctggagtatcagaagactctgcaaacaggcttaacctctgcccacccagcatgagggtctctcatgctctgagcccatctttgagcctgggcccaacctcttgagtgccagtacctgcccaactccaatcttcatttgtgatttgctcatggagccagagaaggcaacacagggacgttgccttctggaaagaggactgggaagttgccaactgggaagaggactggaaatgtcttcccctctctctgagcctcagtttcctcctccgtaaaacaagggagttggactagaagatatccaagttccttctcagccctttgaaaatgtgattctccccaacattccctggtgttatcctaggatgctgaagctgcatttccatccatggtccagctgaattagaaggaaaccacctcctgtgaggccctgagccaacaggctacacagcccagaggagggcggggtgctgggagaagggatggaaacagcatgactggttgtgtccggccggttggctgtcaaggtgtagacctcactaagcccctgcagatctgggtaacatccctgcctaggacacaccagggattcaaggtggcagtgggagctgagatcaactggaagagcagccaccctgagttggaggcacagccccctctgctggaacctggagcaggcaagcctcaggtggggtatggggctgaggccagagcctggggctgtgggctgtcccatagtcccttctgccctagaggacaactcaaatcctgggaggatttggaagcttgggaaataagaaatgaaaggaaatatgtagatagttattttcctctccttttaaaacatcttgtgtggatttaaagtttgttactttagtgtaatagatatacgttgaattggtcataaggtgctcgtaattgttatagtaaataccaattatgcatttatatatttaggcagcaattacaaatttaataactgtgtatttttgtaagtattataaatgcctatgtcaaatgcaggcatagactgccagccttgaagaaatctaatgtcttcattttcgctaccttatgagaagcagacagaacttgaggatagggcagtaaaacaagagttatgttttctggccttagggtcctccgcagtgtcaagtgggtagcaaaagtgctcattttcagagaaagatgctgaggaaaagcatctctgaactcctcgatagaacttttgctatataaatctatgtctaataagtctcatctgagccatcatgagcagcagtttctgcttctttcgtggcttcctttttatttccttgatcttctgaatgctgacattttccttgacttgagatgcaactccctgctacttcacatgttattttgctgtgctttgtatcatcctgtttattgatacaattcaagtagttgcaaacaaatcagtgtcttatgccaaagaacggggctctttcacttttttataaacagtgcttattaatctttaagccatattttttgagaatatgataaaagtcatgtaccatctacacagaaagatacagatatacaatgtccataacattttatgtatagatttatatagaccccttgaagtgatctatgggttcttgagggatcagttaaccccaatttaaaacccccactgtaaaaaagtggaagaaactgaaacacataagaaacaagaagtgacaagatgttctgttataggaaggattcacttagcatgatcccatattactttcctggaccaaacacctatctattttctgggtctgcactatttgagaacaatatcattccaggatcatttcccaagtatacagcctgttctgtaatccagtttctgccatctactagcagtgaaatctcagacgtaatatttggcccctctgagtttatttctcatctatagaatggggattaaaggccgggcgtcgtggctcaccctgttatcccagcactttgggaggccgaggtgggtggatcacctcaggtcaggagttcgagaccagcctggtcaacatggcaaaaccctgtctctactaaaaaatacaaaagttagctgggtgcagtggcaggcgcttgtaatcccagctactcgtgaggctgaggcaggagaatcacttgaacctgggaggcagaggttgcagtgagtggagattgcaccactgcactccagcctgggagacagagcaagactctgtctcaaaaaaaaaaaaggggggggagtttaaaaacatatcaatggctggtcccagtggctcacgcctgtaatcccagcactttgggaggctaagacaggcagagcacctgaggtcaggagttggagaccagcctggccaacatagtgaaaccccgtctctactaaaaaatataaaaattagccaggcatggtgacaggtgcctgtaatccctgctacttgggaggctgaggcaagataatcacttgaacccaggaagcagaggttgcagtgagccgagatcgtgccactgctctccagcctgggtgacgagagcgagactccgtcttaataaaaataaaaataaaaataaaaacatcaacatcatagggttgatatgaagattaaatgagataatacatcatataaaatgttaaggacaccgcccagcatatagaaggtgctcaatgaatgctaggtagtcctggcccaagtagaaacacagctctgaccttgaatcttagacctgatggtgaaagtagcacaaattacctgatgactacaatttttcaactttcttaataaagtctttcactttgcttttctctgtacttgtaaggggagctgcacttagattctccaaagcagttgatttgatctggcccatttggtaaggaatgtctgacgaaagtgcactgtctgatgcagttgtagtgattgctgtagaaattggctttagaatcttcagggacttctgcagttgaactgagaagacatcctcatcaagtacagtgctttgaacacttctggggactttaagattctccactaccactgtttcttgaagaccctctttgtttttcagaaaactctcacaggagattaatactccaccccatggagttttattatagacttttggcatcgggattttattctctgagtcctttttatccacagccatgacgatatgagactttgtttgtcagatgacttcttttccttttctttggctcttttggggagtatctggcttcgtgttattaaaaggcagtgtggtataaacatggcttcaaattttggctgtatcatttactagctgtgtagtcatgggaaaactgtgatgcatctttgtgccttcattgtctcacccttgaaacaaggaagttacctcatcatctggaaggctattcatctttaaaaactttgtaaccttggccaggcgcggtggcttatgcctgtaatcccagcacttttggaggccaaggcaggcagatcacttgaggtcaggagtttgagaccagcctggccaacatggtgaaaccctgtctctactaaaaatacaaaaattagacgggcatggtggcacacaactatagtcccagctacaggctaaggcatgagaatcacttgaacccaggaggcggaggttgcagtgagccgagatcgcaccactgcattccagcctgggcgatagagcgagacttcatctcaaaaaacgaaaaacaaaaaacaactttgtaaccttggaaagcaagtgtccaacatgaaatgcccatcttcttgtaataatatgtggggttttgtccatttgtaatttctgatgctgtttttatgttactggccattgtcattgagcaacaaaaatcctctactgctttctgttgggtggcacatattttataactgatgtattctgccacataactgttttctcctttttctgtgcttttgcttgtttgtataaaggaggtgctgtgctgttgtacagttttagagtctgtctgcactcatgtttttccatccatctatagtacagcaaggcccagtgctctgtcgattcttgcttgcacagattccattacccattcatattctttcactaaaagaggcttgctcaaagaatgctgctgggcaaatggtatgacagtcttagtaatttgaaaacttcctgcagtatgtgttttccattattgacaatggtgttccagaagaatatatggcaagagtttggtcaattttttctgctctttaagtgtcacctgtgtgctaatgaagcaattgagagtgctttgtatgcagtggccagcacctttgctggctcaggggtcctgaacagggtactcctttgtggagatactggtgttatagactccgcagcagcaggtgcacagctgtatgcagaacacgaggaagcttgcgtgctttttccttgtcttgggactcttctttcacgttttaaaaatttctacatggcactgcccaacttcagttttctaaatagaatttggcaatgtgcctttcaatcagctgttcagtgggtgactttcagcatgcaaaagttcctacctgagggaagttgccattttgcaagacagaaaggcagtagaaataaaactttccaataggactgcatccaggttagctggaaacatctttctagttatccagcctgtcttccttcctcctgaagtgaggtaggagattccgtgacaaaaccttagattataaggaattcatggtgacagattgtgggaatcataaaactgaaaaccagaattcagatgcatttaaattcctgtttattaagaaagaggcacaccccttttcctgctgctttgcagactttatgatgacagggaaggaggaattaggtttctatatctgttcagcttcaaaacttctgcgtcttccctaactcgatcctgtcctgggcctttctcttttttttgaccaataaatgccatattattaatctctctaggaattgattttgatattgctgtcattgtctacttcaggtccactccactgagagacagtcaggaggagtgtagctttcaatgacaacagaagtcaataaaagaaaacccacatcaaagcaaacacaaatcctttattctgtctctctaggagtcaaaagtgatctcttgtttggcagttctactctgcttgttctcgagttttaggaaatgaaagatattggctatattagacaggtatagaggaaagtcattctattgcataataaagtcacaatatatgagtccctcactgtaaacctcttatcagcctataaaaaatcataatctattgtttaaattgttttttaaagaaaaagcatattctaatatttacattttatccaagcctttacttctttaatgagaccaatatacatgaaacaataaaaaaaatgataacccatcaggaattggctgttaagtgcaatagattgatggacgattaatcaacaagtgtttattgagcatctaccacgttctcaactatgcaggataaagcagaagacagggtcctgccctcaggttgcttatgatctgtttgaagaagcaagctatgatatgaaacatcagggctcatatattatgaaatataatggcatggtaaaccatgcagcacagatgctgtagaagtttggaagagagaaacttccctgatgggtagaatggtagggattttaaggcttcagtggggaaggagaggaaaaccgtaaggaagaagaaaaggtcatggcaaaagcatagggggttcacatcacacaagccatgaaaacagtcaaactaaaccaggagaggtgataatcttaagttggatggagagagtaccttagcagctttaaaagccacagagtttcatttcaaactatagactacagggaatcagtaatagtttttacaagggaagtggtgtgatgaaagcaaagtttcatgaggactagccaagcagccacatttaggacagacaggaggggaagaatgtggagtcagggaatgcaagcaaaaatattctgtggcaaaaagaaggtgcttagaagctgagctaggaaggtagtggaagaaatggaaattgagcagatgtaacagacattgccaaggagaattgacaatacttggtgactgacttcatctagaatgggaggaagaaggctatgtcaagaaggactccaaagtttttggtcttatgatattcaagatcataagaaccgacagagggaagatgaatctgtttttattccagttaggtttgaggtaacagagggacagccaaggaaaatgttcagcagggtactagaaatgcaaaaacctgagctgtagctctgtatagctagggaaggataaatcactcagacgtgtcaaggtagggatgaggaaactcatacagctctggaatgcagggaggtgaggccatcttcaaagggagagtagcaaagagagagagagatgctttggaatagccattgggagaataatgactatggcccagctgatgaaaagaaagtgaacgggcccaggtatgcatagttctgttactttctccagccatgccttgccttcccaaggatagacagaggcattagagtaatagagtggcattggctagtgaggagaataaggggaatctggaggggttaagggggttccaggaggtccaggagaggataaagagattatggcagaggggagaaagcaaattattattagagatcagagcatgctaaattgcaaagggaggtggtggccccttcatagccatggaggatgcaggcaaggtagggagcccagtcatgtgcagctgtgtcccagaggacatgtcggtggaccaggggtagcaccctcatcttgactcgctttgtctcccaccctccaggctttagctgatagagccctccagggacagaagtccagcagctggtgggggagcagattttgctcattggaactttatctggtccacttgcacttttggctcaaagctcctgattcacttcagggtggttttctatcatgtaaatgccataaacactaacagcaaaatagcccactggctgcccccctgctctccacacctgccaggaccaggacctgcagctccacttggagaggacaaggaatagccatcagtccctgtaggggtgatggtggggtgtcctccaagcctgaaggaaagatggggtgttagggagaggaaagataagcaagatgatagaggtccatttggctgctggagagaccacagctgaatatcttgctgagaaggaggagtaaaaccaggtcatctccctcccatctccatctgggtttggaatgcacagagacacaggcaaaggcagatacacacacacacacacacacacacacacacacacacacacacaaatacacagagacacaaagagctacacaaaacagagatgcgtacacacagctgatcatagacatttagcttagacacatgcaaaggcacactcagatggcgcattcaggtgcacagtggcacacatacccctgcacgtctgcacagagctctttcctctccaagagtttcctctccgtgcagtaccctggtgtgagtagaggcaggcccctttcttccaggcctcaccccttcccctttgtgtttttccaggtcgtgacatggcgagcaccactctgcctggttacccccctcacgtgccccccactggccagggaagctaccccacctccaccctggcaggaatggtgcctggtaggtgacaatgctgcagctgcctaatctaggtggggggaactaaattgtgggtgagctgctgaatggtctgtagtctgaggctggggtggggggagacacaacgtcccctccctgcaaaccactgctattctgtccctctctctccttagaggctgcagttggtccctcatcctccctcatgagcaagccggggaggaagcttgcagaagtgcccccttgtgtgcaacccactgtatgtcatggcccctccacagcgcccacccacccaagtctgtgcccgaggagcactcagcctcagctccaccctcagtgcccagcccaccccagccagctgacactgcttggaagagcctgccctggtttccatggaaacttggagccaagaaccatttccaggggcatgtcagtcactcagacaaagccaccctggtccacaccaagacacaagggaagaccaatgttgagaaccaaccccaaccccaacccagagacagtagggagctagtccctaagaggaatggaggtcaggctgcggcgggaagcagggagagtcgctgcagtgagacaggctagaacacccctatacctcttcagaggcacccagccttccattgcttccctggggctctgacccatccctaatcagaggagttgggtttgggttgtttgaatcagagagacagaggctgtatttaaggtctggtgactgcagctggaggttgtactatacctaacccctaaccccagattgggagcagggtcttgaagccaaagagagttgaagttcctatgtgcacaaacaccaaaacactcttgtcttaaggagggttagactcactcagccagcaactcactccctctggccgccctctatgtggcctttccctgaagttcaactctcattggtatggggaatggggaggatagaagagagtggttggccccatccatccagggacatttaggtataaccctgggtaagcagagcttggggtaggggcagcggcaaagagggagattgctgctgggtcttatggactaggggctgaagggagttagaggtgtgggtaaagggattcctgcccagatttaggggaaggaaagtagaagccttgttgggaggcaaggagattttagggagaaactcccagcagtgagcaggtgggggctggaggaggttttaaagaggtggggtgagggaagagtggggaggtgggggcagggagtctgcagggaggtggggaagaggggagccgcagagagctcgtggtgtcgaggggggagtcgttaaacagaatctagtgctgatgaggaaattacacttgtttcattagcgatggggaaggagatagctcagttcctcttggtcacagttgagctcagaagctcattatcctgctgcacgcatgctttccctcctcgtcaataaacaggctttccagtggctgcatcccccacccccaccccagctccctctcagagaggggccccttctcctctacttaacccgcggttagggatcactgtaaacagtctggggtcatcacacaggagaaagggcgagggggaaacctggaggcctggcctttctcccgcagagggagggaggtagcttccgacgacggctcccaacccacgggccctccgctcaccgctagcggaccagcgggcagtccacctgcgccgcctccatcccctgccgcgtagcccacgcatccaacctcttgagggaaaggcgggagggcggtgtctcccaaaagagctcccacctcttgtgttggcactgcacattgatgccattcttaggactttctgggagaaaaatgtcccgaaggcctttcttcgccaccgccccccactcccatttccacccattaggggccatgcctcctagaaccggagtggcatctataaaggccctggcccccagcgcgacagggtggacgcgccccaatacaaacccttcgtgggtggccgcgagcgcctccgctgggaagccctgggcgggcaccggcccacaggtcccgcccgtgggtgtgcgagcgcgtcggtgcctcccgcctccccgggctctctccacgcggacgcggtgatcgccccacctccgcccggcccgcccgccacggccattaccctgcccgcgacacctgcgcctgagacccggcgggaggagcgggcggagaagccaccggccggactcgtggggtccgccctggcttgcaggcgtctgatccccactccccgaccctcccgcagggagcgagttctccggcaacccgtacagccacccccagtacacggcctacaacgaggcttggagattcagcaaccccgccttactaagtgagtacgccacctggctggccggcggctcagcgcggccgcgcggcttctgggcacggtcccactcccggcgacccgacctctggggacccggccgggccagggggacaggcttgttagtgcagcactgaggcccggggacccctcgaggacgcccgcacctcctgccctcccgtgccctccctggtcgctcgaaggctctgcgccgccctcgccctcggatcccctggagggtgcgcagccgggcgtcaccagatcgggtccctctcatgccccgtgaacgcaactattctccggggcaactggctccactgcccagccaaggtctcccagtccggatcccgctggaccccagccaggggaggtcttttctgtgcttttctttccttttttgttctcctgtttgtcctctcacccagcccattcttctcctgtgttaacttccaggttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 140007 - DNA, 26636 bp, Homo sapiens; identical to SEQ ID NO: 34806

SEQ ID NO: 140008 - DNA, 20529 bp, Homo sapiens
gacaggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtaaaccccttttcgcgcccctgactctctcctccctcttccgccctcccagtggcgctccaaaccctccccgacatgcgcgcctcgggcgcatggtgcgcttcggcgtctgggcagggagggtccccggtcccctaggaggaaggaggcgggaggagggaaagcgcttcgggcacggcggaggatgcgcgctgacaccgcgctgtgcccggccggctgcaggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctgtgagtccaatccgagggacctgggcatgcggccagacctgatgagcctgacggcgcctggaaattgtgaagaggcggagttagagttccctggggttggaagcttcttacgtagggcggataccaaagcccctctcccgtgccatcgcaaccctgagctcttgtacagattagagtcggtccacggaaaagccgtgctgtgcacccagcacctgcgttctctctggcaacagggcagggccacaccctcccatcaaagaaacgccaaaacagggttgtaccaactgtggtgttcagactcttgggcaggatgaggttctgaagtcagcgtaccaggcaaacatcttatacaaacaaaattatcccttaaaactccctgaaacaccttgtaagctcaaaagcgaggagttagcctctttggctttttacagtgacattttctgcagaggattgggggacatgccttatttctacttgtaaaggtggaataaggagggatatcaaagttgtgttttaggtcgacaaatgctactatgggatgtgattcttctgctttttagttgttagcatttaacaagttagcacctttatttacccccaaactgtaatgcctaatcgttatattttccaggatataatgactggaattaaaaaccctattaattcacggtgcttcacaggctgtatggtctgctatggggcaggtgcctacaagtgcacgatcgcaaaaggctttttattactccagtgactctctgactgtatgttattatttggaggcgatggcaaaattctaaatctgagatattttgtaaatatgaagcccacaccaatgagttgaaagaagacaagattcttccctcaaacagatctgagttgctggtgatggggtgttcacatgcccccttttaccgctaggaattgtccccaggcctcccagccccactccctgcaaggacacctcaaaatccctgaacccaaattatctggacttcaactttttggtgcaatctttgactaggaggaaaggtgctttttcatcctattgtcaaactattgtcaaaagatgatcactattttatcccaaatattctgatgctaatattctctggctatttcttggcatgattctcagtgtttgtttgattttatggttcctgaagttgcagctggagtatttctgcatctccttcttttcttttcagtgtgctctaaatgtattcctgcttctctcacagggaaggggaagactggcagcgggtccggagtgcctttcaaaagaaactaatgaaaccaggggaagtgatgaagctggacaacaaaatcaatgaggtctgcaggctggggccagctttcctggggctcgtggggacatagggatattggtggagcttcaagtcacagctacaaagaacaaaggaaaaaagaatgcaattcgggtgattcaaagtgggggtcttctctttctctccattccttcctacagcctcctccccaccaaacccttatttctccctcctccaccctcttttaaagtcatatcacaatgagggagcaatggagagtgtggactttggtattctacagccctggatttgaaccccagctttccactccctggctatgagacctggctatataccacttaccttccctaagcctcagtttccccatctacaaaatgggagtaacagttcccaccccacgggtttgctgtgagaattaaatgagataacattgtaaagttcttaagtagtgatatttgagctgggttttgcaggaggagtctgaaagcagagaaagtgggggaaggcattaaggcagacagagtagccttctgaaaacagggaggcatgaaatgacgtggtgtgttcagagaatcggtcatttagtgtagctgatgtgaggctttctctgaaatgatactggataggtcttaacaatatttttgtattatactaaggtatttggacattatcccttagccagcacggagtcaaagggagttttaagcataaagtaatctctttttacttctgttcactttggatgtttattttgaactggatgcgtccccagatgggatcatataggtgaaggattgcaaactcagaagcttccagggctcacatgactaatataaaataataaggcagacccagtaaaaatttcaggaaacgtgatagtgcatgcccctcccaggagggacagcagccccagttccagcaaacgaatgccatgtcagaatgcagacctcatgtcaccaagtctcataattattatttacatttttaaactagtagtggtaaatccatatgttcatatgaaacctcttgttttttttaatggtaacaaattcaaagaacttttaaatgcgctatgcgggcaaattaaacttgcaaactaaatccacacatgtgggctgtatggccacaccagctcacggcagggtccaggatggcaacttatcagctctgtgtgcataagtgagtgacttggcctctttaagcctcagctttctcatctactacatgggaaatgagtagagacggtacctactactacttggttgtcagaggatcaaccaatacacttcgtacagtgtttggtaccatatggacctcattaaatgtgaggcattagttattgaaaactctggtttatgaaactggcatccaaaggtcttatgtgactatcccaaggtcatagactacttagggaaggagctgtgtccagaattggtagatcttctggttccaagttcaacatgcttaacataaccaccaaccaataaagagacgtttgcttgcccagatgtggaagggcacacctcaggatagctgctgcaacacaatccttgagatgctgggccaacagggacagttagctgattcctttgtggttttattcccccattctgattagaaaaaaaaaatgttttccttttcttaaattgccagaattatttttagatcaaaagctgaaacttaagcttcagggtggcttcaggaaaagctcaggaaataacccaggacgaggtcattaggggataaggtgggttcccagggagaatatataattagtgtgacttcaggatgaataacattatggccagtgaatatgcgatgtagcaagacctgaagttagctcagtgagctttaaagttttgttttccttcaacggctttaaaatgtgtcttttgcggttgttttctttgaaggtcttggccgattttatgggcagaatagatgagctctgtgatgaaagaggccacgttgaagacttgtacagcgaactgaacaaatggtcgtttgaaagtaagttgtcgtcacagacttgctcactgattttgcaggtgattttgcggataaaacatggctcttttgacaactcttttgtaaacaggcattattgctgcctagggaaaggccagagcagcccttttaatgcttcttttaggtgcttaagttatgccttgaactatggattgttaatgagtcatacaacaaacatttgttgaatacttgctgtgtgtctggcactgtgctaggtactagggatatgacaatgaatgaaacgcataacccctgtacccttggggagcttatatgctagacaaggtgacagtcaacaagtaaacacattttaaaatatactcttccaaggagtaaaggaaaagagaaagggagttaagaaagaacatgaaaggcaggcatggtggcacatgcctataatcccaggactttgggaggctgaggtgggcagatcgcttgaggccagcccaggaatctgagaacagcttgggcaacacagcaaaaccttgtctctacaaaaaatacaaaaattagtcagggttggtggcacatgcctgtagtcccatctacttgggaggctgaggtgggaggattgcttgaccccgggacgctgaagctaaagtgagccgtgattgtaccactgcattgcagtctgggtgacagtgtgagaccccgtctcaagaaagagagagagacagagaaaggaaggaaggaaggaaggaaggaaggaaggaaggaaggaaggaagaagggagggagggagggaaggaaggaaggagggagggagggagggagggaaggcagaagggagggagggaaggaaggaaggagggagagaaggaaggaaggaaggagggaaggaaaagaaaaagagaaaggaaagaaaaaagaaaagaaataaagaagaaaagagagagagagaaagaaataacatgaaagaatgaaagaggggcaagtcttttttagtaagaagacatttgaggtaagtcctaaaggaagggaaggagcaaatcatgagggtacctgtggaggattgttccaggcagcagagaagaaagtgcaaatgccaggaggtggaagcatgagcgccgagtttgaggaacttcaagctgctggtgtgagtggatcacgatgaacaagctgggaggaaggggagcctgtgaaaggagatgaggtcaaaaagaaggcaggtgtccaacagggcacagctcataggtcctggcaagactttacctctcatctgactcagatggggcaagtaagggagggaggacatgaccgctttcttcaaagattactctggaaataaagggcagagctcactgcccatgggggtgcaagaggagagcaggcagctgtgatcaggtgggacagcgcctggctgaggacattcagggctgtgggagaatctgagagggccacctaagccggacatggccaggggtcgcttcacagagatggtgcccctcagctaagtcctgatggttgagtaggagttcaccaggtgaaaagggaggaaggagagtgtccctgcagaagaagtgcggaatgacaagcatatcctgtaacagaggctggcagagggccagcagccagctcatggagggctgtatgagcgggagtttgaattttagcctgtaagtaaccgggagctgcgggaatgtattcagcagcagtgtgatatatgggcagatttactgggaggatcactgtggctgctgatgggagggatagaaggaaaacctataacacttccataaattcaaggtcagaaatattgccataaatagataaatataagtaactttttttaattacttatttgagacagactctcactctgccccaggctggagtgcagcggcgtgatctcggctcactgcaacctccacctcctgggttcaagcgattctcctgcctcagcatcctgagcagctgggactacaggtgcacaccaccatgcctggctgatttttgtgttttttagtacagatggggtttcaccatgttgcccaggctggtctcgaactgctgacctcaggtgatccacttacctcagcctcccaaagtgctggtattgcaggcgtgcgataccacgcctgactaacttttgtgttttttaagtagagatggggttttgccaccggttggtctcaaactcctgacctcagatgatgctcccacctccacctctgagagtgctgggattacaagcatgagccattgtgcccagcagagtaactaattatttttaaagttcatgtaccatccagagctatctcacatattcccagtggtgtacctgccaaccactgtggaacacaaatacggggaaaccttgaaaggctgggaagaaataagtagagtttggaaaacatggaggtagttggaaaagctgtgggtgggtgctgactaagctaattgactctcactcctcaggtttatgattttaggccatttgtttacctttttaatgctagtctcctactttataagtcaagagccaattatccaccactaaaaagttggttgcagtaatcctgtataattttttttttccagactgtgtcactcaggctagggtgcagtggccagtggtatgatctcggcccactgcaacctcggcctcctgggcccaagagatcttcccacctcagcctccagagtagctggaactacaggcacatgtagccatgcctgaataatttttttatttttatttttttgtagagacagcgttttgccatgttgcccaggctattctcgaactcctgggctcaagcagtctgcctgcccgagcctcctgaagtgttgggattacaggtgtgaaccaccacgctcggccctgtgtcctttttttaaaaaaaaaaggttacaagagataatttttaggacaatggggaacattttaaaatgggacacagtagattttttatggaatggtcgctaaggttcttagggatgttaatgacattgtggttatgttggagaatgctttattcttaggacattactgctaaagtatttaacggtgaagtgacctgagagctcaaaattattttcagatgcttcagcacacacaaccacgtatacacttgtatgcatacatacacacaaagagaaagaaatggcagcaagatgttgatgagttcgggggattcaggtattcattttaccattccttcaacttttctctaggtaaaaagttttgaaatgaagagttgagaattttatttgtaaaaaggttccttctaaataaaatgatgaaatggaaggaaaaaaaaccctatatgaagtgctagcccagtacctggcgtgtaatgggtgtttagaacataattattcccttcccttctcttcctctggtgaatggcttccaattcattatgtcaggagatagaatccaataagtgactctaaaaacacagctgggttagaggcagagtgcagacccgaccctgcagcacctttgctagggcccctggatctcctgtgtgacttgatcaggacagtggatctctgatcatgacactctgaggtgatgagtcattggacctggagataatttctagaaaaagaaagtgatggtgtcccctttctctcagactctgcttttcctcaatattcttggactgttgccttttctcagaaaatcccacacttttaagaggcatagaattgagtctttaataaccagctaaacatagactccaactccagcattgctgtttgtgtaaagtgatgattattttaaatgacaggtatctgcctcgtgttgtatgagaagagatttgggcttctccagaagaatgcaggggatgaagctgtgaacttcatcatggccatcaaaacagtaagcagcctctttaagaaagcagttttcttgattgatgttttacagatcgatttttacagaacttcacagtgattcccaaaaaatggcatacacacatattttatttcaatagttaagtgttcattttaatgtgcattatatattttagtatatttatgtgcatatatgcggctgtctccaacctttttggcaccagggaccagtttcgtggaagacaatttttccatggacagggcagggtggtggggcaggggagggaggatcatttaagtgcattacgtttactgtgcactttatttctgttattattatatactcaccataatgtagaatcagtgggagccctgagcttgttttcgtgcaacacgaaagtcccatctgggggtgatgggagacagtgacagatcatcaggcattagattctcataaggagtgtggaacatagattcctcgcataggcaattcacaatagggttcacactcctgtaagaatctaatgcagccattgatctgagaggaggcagagctcaggtggtaacacctgctggcccgctgatcacctcctgctgcgcggccccgttcctaacaggccactgaccagtactggttcacggcctgggggttggggacccctggatatatgcacgtaacataaagaagcacattaaatccattatttctttgtttaggcaaggttaaaatagctattttaattaaagatcagttgattaaaaatactttttaaaaagagcccaaaatttttcagattttatctttttgaatagtttgggtggcgtgtagataggataaacgctgtgaaattggtttggaaatcactgaagtttggaaattattagaaattgaagtgaatatgaaagttatcgtttttcctctttttttttttttttttacaattaggtcataagattacaatttttatcaaacacatccagtggaaaatcatcccccacattaccttcaatattgaaaggaggtggaggtggggtacgggcattgctcccaggaccggtgcagagagagccgggggtgtccttgtaattccagccttttaaaaagtgcagggtgctgcggtttagaatgttcctcttccagaacgaacattgtctttgagagaaggagaattcagaataaaaaggcatttgcatttctctcagatgatgagcacgtttgggaggatgatggtcactccagtcgagctgcacaagagcctcaacaccaaggtctggcaggaccacactctggcctgggacaccattttcaaatcaggtaaagggccgcccttcacaaccagccagaaccagcccagcacccccgtgtctggagcttcagagaggaggtctggagtgatctcctgagcctcatcaccacatttaggttttgcaaacacaggtgttttggggattgccccagcatacacaaattctaagtaacaagctttctgtagtcttctttgggaattaagagtggttaaaagtaaaatctggccaggtgcagtggctcacccctgtaatcccagcactttgggtggcccaggcgagcagatcacttgaggccaggagtttgagatcagcccggtcaacacggtgaaacccagtctctactacaaatacaaaaattagctgggcgtggtggtgggcacctgtaatcccagctactcaggaggctgaggcaggagaattgcttgaacctgggaggcggaggttgcagtgagccaagactgagccactgcactccatcttgggaggcagagtgagactccatctcaaaataaaaaagtaaaatttatagagtcagggactcctgagttcaagttcagctctgtcactggttgtggtggcttggccaaatgtgcaatcaccttttcatcctcagttgccttgtctctaaaatggactaataattaataataataataagagaacctacctcaatgtaactgtttctgggtctactacagattacagttaacataaaaacctggcatatcacagtatctccgtggactagatctatttctgccacatgacgaaggggaatatttgatgctaggcattgttcacttacacatttagttaatcctcacaacacacctataaggtaggtccttttattagccctgagaggggtacctgagacacatagaagttagccaacgttcccaagattgcatgctaggtgatggcaaagccaaggtttgaagccagacaaggagcttccaggactcgaactctaactgctgtgccatatgtgatcagcatgattattaccatataatgagcctggtggttgtttgcttaatagtgagggaggtacacgcctagattttatgttataaatattagaaatttttaccattattgtcaacatggatggacactctacttgtgcgtatgtatgtggggtatgtgtgcttagtaatatctgggtccaagttggattctgaaagtgaacccaaatcctaccttcttttacacttttttctcccaagatctaaactcttactactcaaaactatgacctgcagcccagtggcatcagcatcacctagaagcttattaggaatgcagagttccaggcctacccaagccctgattcagattctgcattttgagaagatgcctaggtgactcctatccacattaaagtttgagaagccttgctcatgtcggtattgaaaaatccttgccgacttgacaagaaggcaataatataattagtgtgtgtagcaaattgtcagtgttcctgaaaagactatttagatattgcaagaaggagtttggactgaggttttcttctgtgattttcctcatcccaattttcagctgacttcctctctttcttctctgctctaatagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacggtaagggtgggctggatttgagtttgctaaatgaacggtctgtaccatttttagatgacagattttaaatagtaattcatctcattcatttcactgggattcactagcatcaactccacaaaaatgaaaagtctcatactagatgccacggtgcctccgcgcacagcatctatgccacggtgcctcagcgcacggcctcataccagacgccacggtgcctccatgcacgggcttctgtgcttaaactctgggtaggaggagacttcatgtgccccagtgacaaaaagccagagtaggatgtgatgagtgccatgatgtccatgcaaactgctacgggagttcaggagcagtaaagttctctgccctggcaagatacagaatccagatttttcaaaattggaagtattttgttcagttgcacatgttaccccaaagtgcctaactgtggctgttacttactgtaaaaaaaaaaaaaaaaaaaaaaaaaaaaaaaaaaggcatactctctttcaagccaataatatttttatctgcttagaattgtaaacaaagtcccaaagagtctgggacaagtggattttaactgaagcaaaacagctcattgtaaagaccaaaattctgtctctgatgtggccgatactccctaggagatagcagatactaagtgagaccaaccccaaacaaatcctgccataggcattcaggtaggtttaattgacttggatactagttcgagctgtgatgggagtggcgcacgctaacctcctcctaagtccaacatttcatgcaccttaaagtctctaagcaaaatgtaaagcagttgtttattttccatgtgcttccccttctgtgctgtttcttgcctgaagtaaaggtagggttttctctatcaggagatagcgaggttctcatttctcctcctgctccacaaggcggttgaaagtgggaatccatcctcgctcactttcctgttgaactgcttaccctgggtggctccttccagtgatcaaagtacagtgtcacccattattcttttattttttcaactggaacgtgacctctctgagggcaatggcttagagttgtccactgctgtgtttccaggacatagaacagtacttggcatctagtagcggctgatagatacttgttgaataaatgaaggaattcaggaactattgagtgcctactgtatgcctgggactgttccaggttcttgagagaccaccatgaaccagagacaagggttcccactctcatggaacttgtatgcaagtggggaagacagacagtagccatgtaaacaaacaaatgtggtcactttagatagtggtgtggattgtggaggacgccatcaggatggtgtaatatagagagatggagatgattaaagggaagccctctctgagaaagcagtactggagctgactctggaataatgagaagagccagccacagaaagacctcgtggaagagcgctgcaggtagaggaaacggcccatgcaaaggccctggggcagaaagagggatggagctacagaactagtaaatgtggtcagagctgagactggagaattggatgggccatgttagccagagccttgtgagcccagcctgggtaaggcattagatttgattgcacctgtgatgggaagctcttgcagcattttaagcaagggaatcacctgatcatttatgtttttaaaagtgggctctggctggtggatggagaatagacttagccaagagagtgggtacagcaggccagtcaatgagcttggtctgttccatggaggtcaatcaaggatagtttgtgcccctgaggttttccaggccacttcccctcaaatcagctgctgcagcttagcccctgcagttttccctacaggctcagactgccttacgtggctttggtaaaagctacagtcatctgccctttggaaactctatttggtacttgcggtgagggactcactgatatggttaaatctgtttcttttttggtcctggctattctgaaagtcacatttggaaaatcagaaccatttgaaagtgtatctaatttgatggctacaccctcttcctgttttgtaaattagactcttataataatggcatctacagtttatttgcagccgaggctgccagtcctctgacatgaagaagactgccttggaggcatcttcttccaaaaataataaaataaccatcatctctgaatggtcttgcacttggtgctcatttgtgtgagtggcacatggcacttagcaacagcgtcttcatgtctgcggaggtggacacaatgatcattttcaggaaatatttggcttaaattagcaaagtacggcctaaaaaataaatacatatgactactagtggtgaatattatgtagcttaaagctacattggctgtttccaccaatattttttctctagtcattgcctgtgcagaggaaataaaagatgccacttaaaagggtgtgggcctttgtcagaaactgtagctggagtactcagctcaatgtttgaatttcttatttttggtgttggcaccctcgtatgagggctgtttacatgtggttgtaaccctcagtgtaggtagtgcctgtttatttttgtggtgactttttagggtgtggccaaaggaacttttaaatttcagaaatgccatttattgtccatttccactataacattctcttaaagcctctcattagcaacaccctgaggatcaccatccctctctgtttactccatttttatatgaatgttttttatatcaagcaacttttaattaaatgtttattttgagatcattgtagattcacattcagttctaagaaaaaatagaaagggatcccttgcatccgttacccagttttccactaatagtaatgtcctgtctaacgagaaaacgttgtcacaatctgaaaattggcattgatttaacccactaatattctcatttcaccaattttacatgtactcatttgtgttcgaacaattattgcgtcaaactgtattttaggtcaggcacagttggctcatgcctgtaatcccagcacttttggaggcaggcagatcacctgaggtcaagagtctaagaccagcctagccaacatggtgaaaccccatctctactaaaaatacaaaaattagccaggcatggtggtggatgcctgtagtcccagctactcaggaggctgaggcaggagaatcgcttgaacccaggaggtggaggttgcagtgagccgagatagtgccactgcactccagtctgggtgacagagtgagactccatctcaaaaaaaaaaaaaaactgtatttaaatgttctaaagcagctgattaaaggattatactttgattccctcagtaaataatttaaaatatatccttaattgatatgttttatgaaataagtctgcttttttatatattggatttgtctaaaggcgtagctataaggacgcgtgaaagagcttcactgatacatttgcagaataaggtggtgggcatcacctttttttcagctaatagtggtttaatgcagttatttacaaaaactcaagtttatgtccatttggcttgcagacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggtaagagcctatctctgagccaatataaatgtgttagaacactgttctcgtaaacacaaaacaagtggtcccctactcatgggcggcttcccctagctaattagaaacaattatcacactgcaaaaaaatctttggagccatatttcttttctggcactcatttcctaaatcatttgggcaaattctattaaatcttggaaagccagtgccctcccctttaattcaataatcttgctactctaatgaacgctgtaagcactaattaagataggggcatgattgaaggttatgagatggaggctcacaaaagagctatattattatataataggacacagagaaagctttgcttttgagcctctggtataaaacattttttggaaattctttttacatccttttgggaaaacaaaactcacaacattttaggattagaaggatactgtcaactttgtgaagagtagattggagaaacatagaacaaacatcacgcttcaagggctagcacggaaacatacacattttagtctggaatgaagggggaaaaccaacgttaacagtttactaaacagccttgcactggggttttaactaactcaagaagatgagaggaacaagagatacaattattgagaagaaaaaaacaacttctttaggaagatctgtgatcatgctgcctctttgagtatgcacttgggcagcatttatttaatccaatctgcattcccattgacacttcagagagaacttagactgtgctcacctttacatctttgattttatcttttcaggcttacgccgagtgtaccatttacaactcggactcttgacaaggcaacagttctgggtgaatatgctttacccaaaggagtaagtagaatttgtatattctataccttacaaaaccttggaagatacactttgcaaatattcaccagatctccctagactttgtactggaaaatattcattttgggaatgcagagatggtagagaatagttgacatgttgcatagtatagaattagaattcacggctatggagacagagacctgcattcagtttcatcttttatctgtgttgtcttgagtgagttacataatctctgtgagcctcaacttcgtctgtaaaaggggtttaataacagaatctgctgcgcagggtggttgtgagtatggtgcacaattctaaagccctttacctatttattacctggcacattttaagcactcagcgcatgttggcaaccatcattattataaatttgtggatttggcttttgatttgtaaggtgacaacttgtgtcaattttgccattcaaaggtctcttctggttattttaaatactatgtgtctctgcatgtgtttagacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttgggtaaaacctttaccggtttctgcaattatgttctgtgctgtttcacaaggcagaagaagagaggggtaattctgtttttgtgtgcgtgtgcattacagattgtccgcaaatacgacatccaggccacagacaatgagcctgttgagatgctacactcaggcaccctggtgcccagccgggaactccccatcgcgttttgccagcgataatacgcctcaggtgagcatctaggcggttcattatcctctgcaaggtagtgagaatgacgagggatgagctatgctgggaagtcagccagactggggtttgaatcccagctcacctctaacttgctgggtgaccttgagcagttccctaaactctctacttcctttttttttttcatttgtaaaatgatgacccaaagagagtgtatcacaaaaatttaatatgaataccaagtagttattcctgagcctggcatcaattaagtgttcagtaaatgctagcagctgttcatggtttttgcatgtgaatagtaagggttggcaaactttttccgtaaagggccagttggcaaatattttaggttttatggaccatacagtctttgtcacatcctcttaatactaccttggaacatgaaagcagccacaggcaatttgtaaactaatgagtgagctgatgtcctagctttctattgctgccaccgcaaattactaaaacttagtgagttacacgacacacatctattatcttacagttctataggtcagaagtctgatgaggctcttccaggctaaaattatcgtgttgtcggggctctttctggaggttctagaggaggatctattctcttgctagtttggttgttggcagaatttagttcttcatggttacaggactgaagtctttatttttttgctgctgtcagctgaaggcgatcctcaactttgagagatttcccatattccttggctcatgaaaccttccccaactgaaagccagtaacaatggttggttgagtccctctcacactttgaatctctctttcttcttacattgcttctgtctgacaagatattatccaggatcatgtctcccatctccaagttcataaatttaatttcatctggaaagccctttttttcatataaggtagtatattcacgtgttccagggattagggcattcacattttaggagatctgttattctgcctacaaaggctgtgttctgataaattttataaaaaacaagcggtggactgtatttagccctagggtctaggtttgtgttatgcaaccacatgtaatataaatgtatatatttatcagcctgtattgaacacaatagaatattttttctgcagtatgccattcaatactttttctgacaatagaggagttctcatgttccctccacaacttttgccatgtccatataccaaccaggtgctatttatttcaatactactgagttatttcctttaaataacataagccaaatagcatatgttggcctcgtcctgagtaataatttccttaatgaaattaagagttagtaagtctagttatgttctcctaatagacattacaatgaattcaaaactattgaagtgatcaaaagttagcctaagaaggccctaatttttttttttttttttttttttgagacagtgtctcacactgtcacctgggctggagtgcaatggtgcaatctcagctcactgcaacctccgcctcctgggttcatgcgattcttctgcctcagcctcccgagtagctgggattacaggcaggtgcacaccaccacacccagctaattttttgtatttttagtagagatggggtttcattatgttggccagactggtcttgaactcctgacctcgtgatccacccgcctcggcctcccaaagtgctgggattgcaagtgtgagccaccacccctggtggtggaaataagacatttgtaacatatggctttataggctgacatgtcggtgtttaaacccggattctatcattgtgttcttttagcagcaccttctaggattttcctagaaaaaaatgctgtttgccaatggcaagttaaggagcatttgcttattggtagattatttagagaaacatgcaattacagatgaaatttctgaacaaggcccaaatgaatacattattattcctccaccaagtgtctgatgctattatgaaatttgtcaaattctgagcatcccaaccaacagaactgaatcaagtagggtaaggaaagtattctagctgcattgtgacaccccagccttcagcaaagagcatgcatgtttatcacagtaagccacaccttttaagttttagcattttttctttggctaataatttgtcttgtttaaatacacttctttgatatacaattagggtataccttttttttttttttttttttttttttttttttttttttttttttaccaagaccaaaacagccatttcaacttttctgcaagaatggtgcttatggcttctacgttaccggaaagcaaacttcaaacaccacaccatacaacagcttataaagaatatttaggcccaggtgttgatactttttcttctgcaaaattgttccagaagctgtactgtctttctagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatt

SEQ ID NO: 140009 - RNA, 85634 nt, Homo sapiens; identical to SEQ ID NO: 61564

SEQ ID NO: 140010 - RNA, 82839 nt, Homo sapiens; identical to SEQ ID NO: 61565

SEQ ID NO: 140011 - RNA, 85634 nt, Homo sapiens; identical to SEQ ID NO: 61564

SEQ ID NO: 140012 - RNA, 85634 nt, Homo sapiens; identical to SEQ ID NO: 61564

SEQ ID NO: 140013 - RNA, 85634 nt, Homo sapiens; identical to SEQ ID NO: 61564

SEQ ID NO: 140014 - RNA, 94233 nt, Homo sapiens
auggaagagcgcgcggguccggcagguaagagcggcagagacccguccgcgccgcaggcgaggacuaggggagagggaugggggcggccauggccggggcgggcuccucuccucuuucaucccugugcucaguacccggcgggcgacgugaaggcuggggacugaggcucugcggacucuggggccuccugggccgucccucccgguguccucuaaaccuucugaaaacuuuccacucagaaaaugugaguucuacaacuucgcuugcagaacuuggcuuuuuccuuucuguuguguguugaggacuuucucguucuacuuugggcuacagauauuuugcacaacuuccuccaaguugggagcauugggaaggccuucgcuuccaguaagcagggagugugagcugggccagcgccuaugccaguggguggggaaacucuguguguaccuguguguagggucuuauguauucgauuaugaacacuaauguagaugagccuaaccucuguagggagaaggcuguguccccccaaccccaaaucaagggcagcauggggacagguggcaggccccaggggacccaguggggagaggaaucugaaaauguuuacccaaagggcuaagggaguagaguguugcucucuuuuucuuccuuccuucgcuugucccccaggcugccaacucagcucuggacugcccuuuaggugcccugguguuguacagcggugggaagccaggcacccaaguuuaguuuuggacuucgggggagggagaggguuggaacagguuuccagaguuuuccaaauaauuccacagaggucaaggccuaauuugaggccuuuuuugccucacuccucaccuuucccaaaucucauuccuugcuccccccucccccagcucagguuccaguuguuucagcugauaacccaggucccacccccagcccuacccuugaucuagcuucucgacccaaucccugggcuguacccaauuccccuccuagggccuuguccccacugggaaaccugaacccccgggagugucaacuguggccaccugagcuuuuagggcucugggcagacccucugcaccagagguuuaaguagggagaucaauagcaaacaguuguaaugaucuaauuaauuauggcaaaauuaaaagcgaguacaaaaucaaucucugaugguguugaagauggaauucaauugagagcccaucugugcacccccucgaccguauaaauauucagcccaaggacagaccuaacgucugggacuuccugagaaccucucuccccuuucuuccucucugcacagggcuucucucucccaaacucuuucugaaucuauuuugccccuugauaccuccuguccccugcccuccuucuuucccuuucccauuugcucaagcuccugagacuccaacuuuuccauuuucccuccgggcaggcgcucugccugcauugcaggccugagguuugugaaccagguucucagucccagcaagucucccagcaaggcaucuaggcccccuccccaggaccucgggaaagagaaggcagugugauggggagcauccuugagugccugucaggguccuuauuccaaauuuucuggcccucaggauacuacagaagagaccagggcacucuccacuuacccaggggcgccugcaccuacuugggccugacggguuagggcggccgcuuacccggcgcgcguggcacagcggccagcggcccgacuccgcaccgcacuuccuuucccuucccucuuuucccgccuuugcgggugcgggucucguguuccaggcagcagcagcuccgggaaaggcgggggggagcugcggagcugggcaggagacagggcuguguuugggaaaaggaaaccgcacuucgaggcggcuccgcagagcagagcugcagagucuuccgcccucccagccgccuucucccuuugccucuuucucuuuucaccgcccccucccucaucucuucgguagccacguuuggccggggcacaacucccuggaggcccugccccccuagacggccccgagcccuuuuggaccucauccggcuaguuuaaaaugacaaugacagaggcgcgugaccgaacgugccugccggacguccuggcgcaacugccgcagccggguuugcgaaggaugcggguuuuacuuagucucgcugagccuguuccggagcagcgaaaaccaucaggaaagggcgagagaaggaggaaggggauugaaucagcaacuagggcaauuguggucuucagcuaucgcugccuauacccccagaacuuacaaaaauaagccguuuauucgaugcccucccuuuuucugcacugcucugucccagcuggcucucuggcucccugacgcugguccccugccucugccuucuggggcccugagcucccucccuggccugcacugaguucccagguuucuuucuaccuugggagacuucuccucucccucuccccauucgggcgccaggcuuucagagccugggggagacacagccugaugccucgccgcccucuuuugccaggccuccucaccccguuauuaacugcuguguugaccugcaggauugauuggcggccccgcuggaagaggcugcggaggccuuggccucggagcagccucugcuuagggcaaagggagagagggagggggaggugcuggauauggguccccagcucccaucucagccccgccuggaacacagcugucugccuauacuaccuucgccacccccuggcacuuuuuacacacccucacaacacucaagcacacuccuacgauccccucauccagacgcucagcccccaaagagacacaucagaaauucuccuuaauugauucagaaauugaaaggggcuuccucccuccaucaguuucuucaauguauucguuauccgcgggucuagaccucccagcccgucuagaccuagcggagcgaacuccuggaaccugagggauuuuuuucuuuccaacauuuaccuugcagcuuuucuuuuuuaggaacaguuacacaaaguuaagaaauaauucuggauguaggugacgcuugagaugcaagucucaaaccaaagcauuuuuuccagaaagagacccuguccuggcuccugagggauucaguucagcccuuuuguuucaaguucggggaacggauggcucuggaccuuggagggcagaggcuggcagucgccuggggcaggggucucacccuacagagagggcccuccuucccccuuuccccgagggccuaauccgucgcgcgcgcgcacgcggacacacacacacacacacacacacacacacacacacggcccccauagccaccgcaacucucagcagcagcccuagccccgacccgaggccccaagacggcgggccaggaaccccugggacguccuggcuccaggcuggacguaggcggagguggcaggaguggacaaacccaggcgggucccacgacgccccuuuccucgggucucuccuuguuucagccagccgcucucgccccugguccccucuccccugcguucggguccuuugucuccagccaccucgcagccuguccccgccucggcggcccugcccuuugggccucccagucucucuggcgggucccccugccuuaccagcucccggcuguggcgcgcucuccgccugcuccucacauccacacagcugcugggagaggaggaaggaaaggcgggcgcgccgcggauggauccgagacgguagauuuggugccggcucgcaacucugggaaacucagcgcggguccucccgccccucuccaacucugcccagcgcggcccggucgcgcgcgcucacccgcggggacccuuccuuucccuguauuucggcuguggcuguuucgcucccucuggucucccagccucuggagugugcuucccuggcccugcucuccguucccuuucggccgcccccggcugucgccugcccccacccuccgcaggucccacggucgcggcggcgaugacuguggagguaacgccggggacguccugggucagccugcaccgucucccucgaccacagcccgaugaggccgcgggcuccgggccggcugcuaagagaguuaaucauuacuucgccagcgacacucagccucccuccgacucucucgcccggccuaggggaggaggggaggggacagcuggccagguggggacuucggcuucgcacaaaccagccucuucaggccucccagagacaggugguggcuucucaguucccucggcaacucucuaagguccucuuucuuccccuccugucucucccuccuucgagccuccucccagccaggccucuccccaccgucuccuguccgcucuggcuuugacugauuaacugcagguccugggagaaccaacuuucuuuguuuggaaccggaccggacgggauuuccuucccuaggucuccgccaaugggccagcuccucccgacgguuuuggcggacuggcugaagaggaccgcgccugaggccacaauuaacccggcuguuggugguggugguuggggggugggcagugaggaauuuaaccgauccucuagcagcugcgcuggugcaguugggaggggggugcaggaagugggaauggaggaguggcaggagguauagacagagggaagaacgauaaaccuggacagguguggcauagccaauagaaggggaaacaaaauaaaacaggaaggcggcgcggggaggaauccccaguaaccuuuauaggauugaaguuggguggaaaacgccaccuccugcccuaccuuagcacucagaucccuccuuuaccucuuugugaaaggguaagaguucagaaagcuggccauuuacuccauaaucuacuagagaaaugucuggguuugcaaaaugccuauugauuagcuccauggaguagacaagacaggcguaauuauccccauuuuacaggugagaaaacugagucucaaagaagcaaagggacuguguauguaguggcugucacuuuuuccuguaggcuguggggugaguggccccuuuaggagguccauggguaucuagggaggcgguacaggcuguguccaggucugagccagaaguaccagggccucacggggcuccuagcccuuuuagcuuguucucuguuggacaggaccuucacucuuacucucuagaccugcuggcuggguuucucccagcuucgcuauuuuuucaguucccuaguagaguggcccaugggcgguagccaccuggcuggcccgugccacuaagaggcagcuuugguggccaaguggcuugcauuguuguugcuccucaaagggccugugaagggcugggcaggucgcaaagaccucuugugaggggaagcuagauuaaagggggagggauccuggaggauaaaggcccagcacgugcgccuggacuccacaggaccaacagaccgagcgggcggggccagcugggagucaggccccccgggcuucacgcagggagcccaaauauugggaacaaaagcaggaaaagaagagugagagcaggagggagggagggagcgaggaagcagaaauuagggggucuuagaugaaaaaaaaaagaaaguagcuuuagggggaaugugcuguggagugugaaauugcagcccauggugcuccauauuguaccagaagcucuuccaaaaaaaaaaaaaaaaaaaaaccauccuccaacgugaccagagggccaggcagggggaagggcggggagagaauggggaggaggagggggaaaggccgggcaggagccggucaggccuuucugcggaaggggcugggguguaaguuucggcucccugggaucugacagccgaggguaugcgcccuggggugcgccgggacccagagggcgagugagccucgguuggucggcucuggaguucgguugucagaagaacuuuuauuuuucuuuuugguggugacuucuaaaagugggaauaauccagaaaugaagcucagcugcggagcugcagcucuguucucccucucuccccucccuuucugcuucucuucccuucggacuacuuuucuccccuugguucuaaacagcuuuuuccccucugaacuuuaaugcauuuaauuugguccgcgcuguggggagcauuuccuggggagaugcauuuaauuucggaauuucuaauccccucccucagaccccgguccuagcuccccuagccgcuccccgggaaguggaaggaggaaggcaggucccggccacgggggaggggcgcggcugggaugcucccgcggcccccuccgucucaccaaggcucagccgccuucccaagcuacuggaggccgggcgccugggccccgggucagggcccugcaggaggaggagaggcaaccacgcuucugccuuuucucgccugggcagaaaacgcugggccagggaacuggaaaccggaaaacaggagaaaggguuucuggaaggcagcgggagcggguggcagcggggcagcgggcaguggacuaggucuacaccggcacuucacuuuugcacaacaugcccagaaacgcauuugagagcccuggagucgcgcuuggcuuggcuuggggcgccggugcguggguacacucgaggugcggggugccuauccgccaccccgacaccuacacccagacagagcaggcgcggcccagccagaaaaccaggccggcaguagcucggccuggagggcggaggcaagguugggggccgccaggcgccugggcaagccuggcagggaagggagccgagaaggcaaaggagccgagauccacaaggaagauuuauugggcagaucagaugcacagaggcggcuaaugaagcaaaucccgagauggguaucagagcaacuccccaaaaguuuauuugccuuuaaauuuccgcagggaggcgggcuccuuguuugaaguguaaaugccccuagguugggggguggaagggccgcuuugaaaacaccagagagaaaagguucauuuagaggcggacgggaaaagcaaccaacccugacaggucggagcccggguaguguuugggguuggguuguuuucuuucuuucucuuucuuuuccccuuuccucuucuuucuuccuuuuuuuuuuuuuuuuuuuuuuuuuuuuuuuuuuuuuuugcuuucuugcuuccccccaccccucuacuagacuguauagaagaaagagaacagaaaagggggagucagaggagcggccagugacuggaugaaggccagcccuucauccuggagccccaggagaaggcagagcuuuggagaaaagggguuccuaaucuccagggagcauuacucuuugacucucuagacccaggaaugggcuggagcuaauggggaagcggccaggagccggccuggcggaagagugaguguccagcuagugcagugcuggggagacgaucccaggagcaggggggacucucaggggcuaccugggaaugggacuaucagaagggucuuuacuccucagaaggugcaugugaaggacaggugugugaggacaacuuccagcacacuuggcgcauuaaguccccuucucuacaaaauggaaaauccuucucgcccaacaugugaaaaugcuuguugugggcacccacauuucaugguacuuguaacauagggacaugucuagcugguucuagaaaaaucugugucuguguggaaggggggggguuuacucacagcuuucuuccuucaauaguucacacaccccgagacaaauuccuggaugaccaacuuggagagaccuggggcaaagguuacuuuaguucugagcuccucuaaauaaggacccuuucucaacguuccuuucaccccaguucuggguuaauuacuucccagaggggaaagccaaggcugugcuagcuaauaccaccugagaucccuugcacucuggccugggagcuguuacuuuucggcugcccgaacuguuuuccuucuucggucccuacacgaaguuagugcguguucgugggguugugaggccaaagcaaacccgggagcgccaucugcaggccucaagaggaagagacugaccuuagaggcuaggcccugcgucuucaaccucuagcccaagggaaccaaccugccuagccacccaagggaagugggauaggggcugggaggggcaggcggugaggaguguuuuccucccagacuuuaccccgcagguggauuaagcuuauugggcucuggaggauacaggagggagggcaaaugccaggaucccagcggacccaggccccacaggagugagaggcucagaaccucgucccgcugagccuggccugagcuccuccugaggaauaagggcaucccaaaaacccggguacaagacgcccaguaguaguaguuaggcugagucaggcaggugcaucucuccccaugguaucugccgcccaggcuccggccagagggaggggagcgcgaguccgccgcgcuuccgcggggcgcccggagcugcagacgggggcuggaggaaucucggauucgggcugcaagagcgcugcgcaagcuucgccgagccgcccuuucgcagacccagggaagcggggggagggagcgaaggagggagagagaguuaaaacaucagcugaagugccaagaugauuuaugagacgagggaaaauauuucaugaagaucucccggauauucuguacuuaaccaguuaggagacaaagggcuucuucugccuggugcgugcgagcggaccccagcgagcaagggagcuagugccagagagagcugcggaggcuccggcaggaguggggacguccccgugguugcgccuccugcgcucgccccggauccaccgagcuagcagcgggcggcgcucagccgcguccgcagccuccucuucuccccagccggggagagccagccucgucucccacauccucugccgccagcgaccugcagcuccgcacuguuucccuccccuguacccccuucccagucacccgaggguucagaaaccaagucccccggcucucccgccauccgcugggucccaccgaggcagguggguacucgccggaggucuucagcucgauucugaaccaagcguucuggacugcccagacccggugggcaaggggacuggggaggcccugcgcacagucgcguggaacgggaggggacaagacaaacugcuggacacuuuuccguggaaugagaaguggggggugcgugggugggaagguaccuccggagggaaaggccaaagggaaggaccagaaagagaggaaggaagagccgggaaggaacggaagggaacucagagccgaggguggugggguuggggcuagggaugcgcacugggcccggggccgcgcggcccaggcgggcacuggccaguggauggcagggcugggcgaguuagaacugagagcccggcuucacagcgcagcgcgcuccgaggcccucugucguuaccugaauauucauuagacugaccgcucuuuauccuuaucuagcguuuaucuuaucggcgaguuucguuucucaguguaguuuuaaucccgggcucccauucccccucccccgguccgcuccccucccucccucuuccuucgccggcugcucccucccucccucccucccauuucucccuccccugcccuccccuagccggcaccggagugacaggcucggggcccuccucgccgaagcucggggcuccagcgcuggcgaaucacagagugguggaaucuauugccuuugucugacaagucauccaucucccggcgcggggagggggaggaggucuggagggggcuuugcagcuuuuagagagacacacaccgggagccgaggcuccagucuccggccgagucuucucgcagccgcaacccaccuggggccagcccagagcugccagcgccgcucggcucccucccucccucccggcccuucggccgcggcggcgugcgccugccuuuuccgggggcgggggccuggcccgcgcgcuccccucccgcaggcgccaccucggacauccccgggauugcuacuucucugccaacuucgccaacucgccagcacuuggagaggcccggcuccccucccggcgcccucugaccgcccccgccccgcgcgcucuccgaccaccgccucucggaugaccagguuccaggggagcugagcgagucgccucccccgcccagcuucagcccuggcugcagcugcagcgcgagccaugcgcccccagugcaccccggcccggcccaccgccccggggccauucugcugaccgcccagccccgagccccgacaguggcaaguugcggcuacugcaguugcaagcuccggccaacccggaggagccccagcggggagcgcagugcugcgccccccgcccccgcgcgccccgcagcagccgggcguucacucauccucccucccccaccgucccucccuuuucuccucaaguccugaaguugaguuugagaggcgacacggcggcggcggccgcgcugcucccgcuccucugccuccccauggauaugcacugcaaagcagaccccuucuccgcgaugcaccgugaguaccggcgcccggcuccugucccggcucggggcucuccgucccaacccuguccagucccagcguggccccggccccucgcgcucaggucccaucuuggaggccucccuggcuucuggucccucuuuucguucuuucucucccucgcccgguguuucuaaugccuccaguuucucuccugccuucugucacccauucuuaccucucugucugccugccuuccuaccuucccugaucccuaucaccugccuuugcucuuucuauccgcuccuucuuaggucaugggauccacggccucggagcccugguuccagccacccucucccuagucagccucuugcccugggcuggggggcaaauuagcaggcaguuuucaggguguuguuuuguuguuuucucugucuuuucucucuuucucucuuccucuguuugccucccucuccugucuccccacaucuuuaucuuucucaaacuuaagagucgugggguccaggagacuccaagaguauucagccucagugucaggacaauugggcagaagaguguggggguggggugcccccuucugacccucaucucucagcaucuccaggcccuuccagcccagcauaggcuucuuguggguugguuugaaauauuuucuuccucuuccuuucuuucccaccccccuucccuugccuucccuucccuucacauugggaaucccagguugucaagacacgauggucaucuuucccugccucugccugggggaugcucuaaaaacaaagaggggcuccgagaagaaaucgaagucagggagagagccagcagcgcagccuuccaggugggcccccggcagagugcagcucugcucucagcucuggaggcuccuugccuagacugccgacuccccauugaggaucacgcagccagcaaccuggccagggggucagcaaagagcaaaaaaugagggggaaagaacaaaaggaaagcaaaugccaaagcugaggagaaaggaaaagagaaauccaaacacgggaaaggaaauuaaagaaagaaaguugacaugauguuacagaagaaaagggagaagggagaaaaaaauagagaaaagagggaauuauuuuaauaaaauuugaauuuaugccaugucuuuagcuugaaaaacuauucugagauuuuuuuugcaggcuuuuuuuuuuaaaagcuaaaauucuaaauagaaaacuccucccuaucugcagauuaauaauuaaggauaauuuguaacuuuucacaaggaaacuuuagacccggcuuggaccuguguuuaggacaagagagccgaggagggagagcuguguuuuucgcuaaucauauauuuagcguugcggggguuggggggggcguuuaaaaauacuucugggauaaaauauauuuuucuaaguaauuuccaagcgcaggaaagccgcgccgagggcaucaggccuccgcgggucucggcgagcgggccggaaagccucgguccuuuucgggaggaguggaaccggguccacacgccguuuucgcccagccagccugccucgcggcccgcugccacagcucucguucuccuuuuuugcggauuccgccggggguccgccgaguccuggcugcccgcgggcagccacuuugaaacccaaagguuucugcacggccaagcagaggucggagggagagagccgcagcgcgggcccgcgggccgguggacuggugggugagacaccgcagcccgagucggugcuggcggccguggcgcauuccaggcccgacucagcgccgacucgcugcagucccccagcccuggacucccgccguguccccuucccauccccaccccuuagacuggggcugaggggccgggcccugagcccggggaggcugaauuauucaucuuuaaucugcccgcagcugccgccuuuucauaccgguaacgcgaguucucccggggccuaaauuauugauggucgggguuuggagggaggggagggugagaaguggggcuagagauagggagauuaacggggugggcaaggggguaaaagaaggggcuucagucucucccagcaacgcgaucagaggucuuuccccaggguuucaccgagcuugcucuagguaccccccgagaaagggaggggagagaaaugaggggggcacagauguccccgcuuucuccgaaacucgcgugaggcuagcggggcaggggcugcagcuugccaguccgggccgacccgacucggccgcuagaagucucugcgcuuggauugcucaguaccugcggcuacggguugaucgcucugggugcaggauuucuagacugcuguaggccagggagaauggggcacaggaagcacccucaggccuggcacccaguggccgccucgguuccgagaucgggagcccgcgcuggagccggguuggaaaccccgugcccuucucuuggccgaaagagcaaaagcccgagccgcucgguuuccugggggggcugccgaggucugaggggucaaagggacucgagucggguuugggucggcuacacagggcgccccgagaguuauuaacucgccagcgaggccuaugccgugccaccugggcgagacggugggccccaaccaggcucugcgaggcgcggcaggcaggcgagcccaagcagccggcauucucugccugcugccuggagccgcucugccucccugucucugagcgcagcagaccccgggccccugccucauccgccuuccuugcucuacuucagauacuaaggaggugaaagagagauacggucccccuacagauaaauaacauuagaaaaacuucccaucaaaaacaaacaacacaggaaagagguagaaaaauuccgauuacaauuuaauacuuuuuaaagaagaggcagagagcaaaggggggugugugugucaggcacuuauccccugucugugcuaggagcucggauaaacagucagccgagccucgacgcccccaaaucguccgccuccaagccccgcacgcgcggacagcucccggguugccugcggcgcaggcgggaugcugcuucgcacuaguccaguccucugccaggcccuuccucuccucgcuuucuuacgcccuuuccgcuggcaugaauuccccuuuggcauuuucuccccucuccccucuuuucugucaucugguuucucuccaguccccccuuugcuuucuaccuugcgucgcaaggccugagucgcccucucgcccagcccccagucuucagcccagcgucugugcuuccaguccccacuccuccgcguggucguggagguccaccaccuuucuucucaagcucgggaacaugcccuuccgcccugccugcuuccuucgcccgucccgggccgcggacccugacuaauggccggucccugcugugugugggguguuguguuuuuuucuugucucuccccagcagggcacgggggugugaaccagcucggggggguguuugugaacggccggccccuacccgacguggugaggcagcgcaucguggagcuggcccaccagggugugcggcccugugacaucucccggcagcugcgggucagccacggcugugucagcaaaauccugggcaggugagggcuucgcagcugucccgggagacgccuugccuacuuccccggccagcccugggucuccagcuggaggacguggcuaaaaguccagcgugccaagccagagagggagauccccaaaggggucuggagaggugcuccuuuuggagagaguguucagaugguggcugaagacccaggagcgaggguggcgcagugucacccagugcuugcccugccccuggucccuggugagaaggcagcccguuucuggcuucagaaagggaaggaugacuuuccuaauggaguuaaggcagauacggggugggagacauuagaggaauggggggggagugaaaauggguccccgagaggagaagcagcagcauuugggaggcagaaggaggguccugguucccacagaugcucugugcccaguaggaaagggcucgagguggugccucaacccuggccucccagagaccuugcagcgcuguucguuuugcucuucccaagugaaaggcugggcuuucacucccacgggugccuauuugggcuggugcgaacccagccccugguguggccgucucccuggagggaugguaccccuuguccuccuacuccgcggcgcuccuccuagccaggcacccucaggaagucagcucagccacacugggccuuuucccuccacuccgcugccucggccgggcaggagaguggcucagcagcucuggaaccugcagccccccugccccgccacaguccgcuucuggcugaccccgccggcuuucccggcgcagguacuacgagaccggcagcaucaagccgggugugaucgguggcuccaagcccaaaguggcgacgcccaaagugguggacaagauugcugaauacaaacgacagaacccgacuauguucgccugggagauucgagaccggcuccuggccgagggcaucugugacaaugacacagugcccagcgucucuuccaucaacaggugagcaagccacccggguuuucagggcuggacuccagcuccuggcuccugccugcaggggugucccacgcccagucucugcucuuuguccagccucugcccuuucucccugcuuccagccccaaauccuucugucagagaaagggaaccugugaggcagagaguuagacagacagacagggcugucugcaguucagggcuggguauucccugccaggcuucucccgccggcguccuggaaaugaauccaaguguuugugguaauuaagacuccaagauuacgagcauccagccuugggaucuugagacaaucacagccugcagccggagccuuuaaaaugaccagugucuauucaucccuccaaacagacuggccuuucuaaaggcugcuccuuccccaggggccgccgcuuguccuggcucccucacccucccugccaacucccacaaagcucaccucccaggagucuggucuugcuagccagcuccacacaaauuucuggccuguaggcacugggauccgggcuugcagaacaaaugccaaccaccagccagcaacuggcagggaguagaggagcuggacaaggagggagugccaagcagggagggagaacuccagacuuugagacugaaccuugggugauacccucaaccaccuaaggugccugucuccaggcugaagucuuugcacugaugacaggcucacacacgugaggacagcacagggcugagucagcuugacguguaggauauuuaggucuccuggucuccaaaccccuccagugugcucucggggagaacacaugugcacacuccaugcauguccacccuagccagugugccaauaugccuaucugugguagcuacagaacauacaagcagcacugggcucaggaacccaggcugguuucaagaucacagaacuguacaaacugacaguuguucacagagucccugcacaagucacacaccagccuuggccccccauuuugagacaccccaaaaugaaaagagggcuaagcaguucauaccuuuguuauuuuuugcauucuucauaagcucauuaucagggcaacuaauaauucacauggugccuuauucugaaauuggcaucacauauaaaggauuuuuuaaauauuuugcaaaugauauggaauuaucccaaaucauccugaaaacagcagguaaaauuagcugguagaauguaccuuggcuaaagaagauucccucugccacacucgugcuguaauguacugcgaggcgaccccagaaauuaucccagugugugccaucuguauuaaaaugguuauucaguuaugaacaggguaacauaauacugaucagcuaauuauacacccuccgaaaacccuccagcucccucggccuggcucagccagguauugaaagcauagcgauuugacauucagauaccuuccaaaggagcuggagaaagacgcugggugguuugggagaggaauaagcccuuugcuuuaaaagccaggagaggaggcuggggcagcuuugggcugaggcaagaguggcacuucgggaggggaaggggacaaagcauuguuuuaugagccauguagagacucagucucuuggcugauugcugguccugggcaugaguuggaacugagaucucaagagaagaacagccaagggccaagaguggcccugcugugugcaguguugcugggacuggguaguggucuucugcagaacauuuaagagaaaugcuuguugucaguaacagaauuuucaagccuuuggagaaacccaagucauguaggauuuagguaauuuguuucucuugaaugggguagaggaguggcgcaacaagucaggugugguggccccguccaacacccccugccccuccccucaacaacaugcacuccucauuggcugagaugauuuuggaagcuggcuuaggcauaaguuuggaaauacuucuauccugaaaagccauggagaacaagggccaggugacccuaggaucaagcuccagaggucuugaggugcacccaccagaauuaggacaaaguagacaagugagccacaagugagaugaggguggggaaagaguagccucagcuugacagcugugacagcugcagaaccugcccagcacagagcccuaucaccugaggggcacacaggcuuccuuuggguguggagaaauagccaucugugggcagauguugcuggagauggagagggaguaggaggagaggaacagguaagccaccaacaacacgggcagccuacccuggguccguaguuaggcuucauggcuggcuuugucuacaaggagcaggaaaacuauucccaauuuugcuuuuguccagaauccucucaugguucauauuuuggaaagaauucugggggcuucccugugugcugcugaguuggggcuggagaaauccaccuggggaaccacgcucucaucuucaucccuguaggugcuuuuugcucugaagagggaagguuuaucugagauguauuguuucacccaaaagccugauaaaaacaggauguuucugcuagugcugguuauaucagaaacuuugccuuuuaucaguucugggaauucucacucacuguaggaagagcccggagauuuuccugugugcacaaaguguggugcaccggggaacgggugguucuugaguuuagagcuuuguugguagugaccugcccacuuguguuggguacuuuauaacaguuaugaguaagguugugcaugagcuggugguuggcaagaaaagaaguccacacaugcucacccaccugagcuagugguuuuucaucuucuccuucccaaaacagaugcugucgccacacuugaaauaugcuguuaugguuauaaacuaaauugcuuuuuucacucuuuaaaaaugguuuuggcauucucugauucuguugugauaaaggccuggccauccagccuguauucuccacuagcaaauccucagaaaugccucucugaaccagaggacugggucaggaaggccuccccacugccacaaaccacguucaaaaaucccaaggcuugacugggcuccuuagcauguggaauuuaucugaaucuuucuaaacauuggguuaccaauggcugagcauggaguugccagcuuuuugguuuguacaccgcugcuguaaagggcagguguuuauaaacaggggacuuuagauugaaaccuggugugggacauggccuggagaggggagagguggagggagauccaugcuacugaaaaaggaaaaagucgucuaguuacauagcugagcaauugucuaagcaggagggauuuuccugauuauaugccaaaaucuucugguuuggcuguuacucugggcagagaauacaccuccuuugaaagaacaggcacagaccccaaauagagucugggguuacugacaaucccccgagggugcucuuuugggaagagcugacaauaagggugucaccuucuaacuuuuuuagcuugccuaacacucuuuggagucagggcacucucugccccuagaucuuuggaguggacccuggcagaaucaacuucucacggaucucccacuauccacacucucucuuagccuguuaggcucuaggugaguacauucauucuccuagcaguggcaacccagggcuguguuaaggaauuccauccuguaucauuugggugucccucuucugucauucucaggucuuugagucauucucaggucauuguuccccuugggucaggcaguggggugacaauggucuacuaguuguucguucaaagaccuuuccaaauaagcugggagcuauuaauccuagccccgugaauguugaagauauguuccgggcuagggucuguuucucccucucugaaacucagguuccagaacauugccuauucuacucuuggaccuggcuuggcaugaagcuuggccagaggggugguacugccuaccacaucuccauaucuuuguagcuguuugguggucagggcuguuggucucauggcaaagagacagggcaaguuggagaguucagaaaaagacuucuauccacagaggaauggcagaaacaaggacagggaacucaccuucuguggccugagccuagcagauugggcccacaaauagcagaccaacaugccaauuucugucagagaagccucgcucaccuguccuuucccagagacaguccccuacugugagguuacccaucauuggaauaacauuugaaacaggcaugaugguugaaauucucauuccuuaaaaugagcuggaguuguccuccugaaaagccucuuuuuguuuuuguaguuguuuuagccugggcuuccuggcccacaguccuguuggucugacugucucccuguuggcugguucuguggguguucaggcuacaaaagggguuucuggugagagcaauugcugcuugcccugccuuccuaccucagcuggcaacucucgagaagaggcagacaggaggcacugggccugacaacagcuccaggugcauuucagaaggugacgcaaagaagaaaagagagggaaaacccaaaaugaauaaauaaauagugucccaacuguucugagaacucaauaaaacaaucacaucaaauaugaagaggcauaaaucuugugucugcacagguaaccuacucaauugcuuuuauuaucgcucaggcugccuccauuuauuaccguucauggccugggcaaaggaggcugcguggaggguggucuccagugcaauccuacacccugagaggcaacaaucagcccauacagccagagauuucgaugggagcccaggaagggcccaucugucugcaugaaaaccaaucaauaacucuguaaccagagcccuugucacagggaaauggacaacacaacaguucaauagaggggccacagggggaauuagccaaguggagauggggccaaacaggagcagccccuagagaagggaaacaggggugccuggaguaggggagauuagggaagggguggagauguggcaggggagagcaauagcuucauaugcauguugguauuagauggggaguauugugcaaaauagacccagggaaugacaggcaauguuggaaguugaggugguagggaacauguguuuuggacagcauuugggaaaugggcuuguucuggugcacaugggagagugugacuaugcaugauggcaugugcuugcggacuagaauguuacagcuucuacagaaagaggaacaauaguaguaacugguguggaagauuaaucacacuccauacccccuaaaaccccucugaaaaggggguuccuaugagcccacaugggauagggguccugcuucccagucuucuuagcaggacugaugaaagagccccauuguccgcucccagcuucuuagguguccaacaauagcuacucugcagguugccucuuaauacucaagucuaucuucacccccuccuugugucuaccuggaauuggaguuuuuauauuaagaagagaacaaugguguaaaagugacaagcauccaguagaaaucauacuucaaguacccaaacaaccauucuguuucucacuuucaauacaguauucaauaaauugcaugagauauccaacacuuugguauaaaauagucuuuguguuagaugacuuuggccaacuguaaauguuuugagcauguuuaagguaggcuaggcugaccuaugauguuccauagauuagcuguauucaaugcauuuucagcuuacaauauuuucaacuuaucgagccauuacccuguugugaguuaaggagcaucuguacacugaaaauaauuuauuuuucacuuccuguccuuuaaaagaaugcucauccgaccugccaguucucugcaucccugcuguuucuucucacacuucccccgccccuccaagccagguguccagagcucagauucuugcaggggaagcagcuucaggugcagcuauccccagugcagcuccccagccaugcaguugaguccagagaaggggaaagggcuccugaaacugagaugugggaaauagagucucacaaccaaugcccaaauagcaagugaaauauuagacagcugaaacauuaaaucacguuugguuuuucuaucuaccacugaacuacuagguugagaugguuuucucuuguggaacaggcuauuuguuuuggggcuagcaaggcauggcuugaauauauucaugaugguuugcaguguagaaguugauaucuucugugcguguggauuuguguguguuuguggguaccuaccuaugucugcuuuuaggugaaaaggcccugaggccaagaggagaaaagggaggaaggcucacaggacaugaccugcagucacaggcaaggcuggacaccuuguacuugggccaucagaucaauuggcaaguagucauugggccacugggcgaaguggcagcagcaauaaggcuaggcugaagauuccucauuucacagucuaggcaaauuggagccacauuuuccuucaguuauuugcauuguaacacucuauaguccaguuaacccuggauaagaggggcuuugcuacaaugaugccacaagagcugugcgaccagcuguccauccuuacuuugauacuuggguccaagcccuguuggcaggauuaguuagggaccaauugcauaagcagccaagaaggcgcucuucccaacacaauccuuccuccaaagcuguggucccgcagugggaggcaugguagcagcccugggacacaacggugggcagagcucaccccagggccagccugcaagucuuuccucaaucauccaggugugaggggcauagggaagaggcuuacuguuugugagaaaugcagagcuggccacugcagaaggcuugggguguagaugaggcgugauggcagaggcagccucaggucuccugaggaaggcugggcacaggggagcuguugaggguaugggaagcuaaagaagaauggucuggcgcuguaggagagggagcagccucuuguaggcugggaacucucagguaagagaggaagugugcaggaaagagguagacaggcgaggccguagagccaggguccccucauggcacauccgcaaucaaccaugggagaaaugaggcccuuucuuuuguuuucugagagauaauguaaugagaacagauuuuguguuuuccaagggagaaggaaagagauagaaagagagcagggcagggggagcgagucaggugccauucuuuuuuuuuuuuuuugagacggagucuugcucuguugcccaggcuggagugcaauggcacgaucucagcucacugcaagcuccgccucccggguucacgccauucuccugccucaaccucccgaguagcugggacuauaggcgcccaccaccacgcccggcuaauuuuuuguauuuuuaguagagaugggguuucaccauguuagccgggauggucucgaucuccugaccucgugauccgcccgccucggccucccagauugcugggauuacaggcgugagccaccgcgcccggccgucaggugccauucuauucuagaaacguucagguuuguuguagggauguugggggaaggaaagcagugcccagaaguccagacugggguuugccaaaagcaaugauggagaugcgcuguggcugcaggagucaugagcacaaaagacucccaggccccagcaggaagaggcuccagaauaugagaugaaaaguggugagaacuggacaaacagccggagcacaugggcccugccugcaggcagugaugcaggaagaccggauuuuaaaaaacucucugcugaccgaauaaaacucaacuuugggccugauuccauccauuggccagcauucagcagccuuugguugaccugacuggauggacuuaucucucugccuuagaccagggcaguaacauccacgcaaguggaaggggaugggacauuuccugggucccuugguccagaagcuccuggggaaggcaguggaggagagauuaugacucccuauagccggaggaggagaggugggguguggguagggagaggcagaaagugaggaugaggacugggagagugaggcaggaagcgaugaagcugagagguggaaggaagggcgcugccuugggcuggacaggguuguucgggauuggagcacauggcugagcaggaaauggcacggcagagcccgcaaggggagcuuggauuugcucauccgagcuggggccuucaguggcccugcaaggucuuggggguggugggaggaaaccugagcuccaggcaucugguaguacaggcugaugggcccugaggaggggcccagaggugaugaaggagaaaggggaagaggaagguaagcagguuucugagaagaguauggagcgaaggaaauggcaugggaggaauagcggccuggcuggagcuaugcagcccuuucugagaggaaaccucaugagugugccgcaauggucuggcuguggccccucucggcaggcugugaggcaggccagcaguggcuccagccuagucccuggcaggcuggagagggagaguaggagagcagccaaaagggagggaggcaggccccugccugcuggggguugcagauucgagagccaucuccacccagagccuuugaccagguugcuguggacuuccuccucugccugcccucaguccugccugaaccacagauuucucucugcugccaccugggaacagaacaagccagggacaggaccgguggcuccuggcagggcugaggcagggcagcaggcugggaggagaacuguguucacccugcaggcacaguagaaucaagaaaucagagaggaaggauuggagaggacugggagagaggggagcaggcagaaagggagaacaaaaguggccccugagcaugagcaaaugggagugagcacugggggcugcucucccuggucuuggugcucccucuuggccugggggucuuugcugggcccaacugcccagcccauaccuggcaggcagaugauagaagcugaagggcaugaggagucugcaggcagcuucuggccugcaggacauggaggcggucaggaaggagacacucauucagccucuuaguccagaagcuuugauccugauuuuggagggcaagcaguggugccugccuuagugcguuuucccaagagaaguuggugauguguugggagccucugugcauggcucugcuuuggaaagacuaugugugcuggugguaucuagcuaggccuggcuucuaugcccugggaagcugucuaaauggcccuggcucccagggaacucucgaaaggagucagucuugucaaacugggaguuggugguuugcuauucagaaggcuuccggcuaaagggauuguuuggucccagaaugaaagucccuguuaucacuuugauggccugccuguuugggauguuaguuaauguucccuggagagcacgugguugaauggacaguagacauccugaugggucaaugaacggggguucugaaagguacacacagggucccgacacaucuagucugugugcaugcacaaguuuggggaugugaacgcuuaugaguagugugcauuugcucugcuggaugagugaaccaagccaugugugauggccaggguggaggguguguguaguaucgcacuaggagaacuggaagcaguuguuucuugugugucugcugacguccucaaagggagcauguauuuagguagagacaaaggucaagauagucaccuccuuuuaucauuugcaaaguggauaccacuaucccuucccccagucccuuacuuuucuuccucuuucuccuccuccuccucguuccucagguuagcugguuuggguuagggggccaaucucagaagacucuaauuaaagagugaggagaaucugauaagauaaggaaggccauccuuccucuagggaccaauggagguuucauguuccucacuccccgcugcuucucugaggagcugacacuagggcaggcagccugccgacugugacugucuggagucugggagagccagagagaaggaggugugacugggguugggacucggguuccuacccauuugcaaugguccuggaagggaaaaccuagcagacuccagaugagagcgaggggaggguagaagagagagugcagaagucaggaagagagaagugggagccagaugugaucaacacagauaugccucgcuaaguccuaguuuuuggccacagaaauggacuguacgggguggggugugguaccuuuuuuuuuuuaauuagggaaggggcuaugaagccauuuaacccaucuuuggggcugagcacuuagcuccugcagagaguacagcccugguuaggguucagcuccuccuagaaacaaugcucaccugcgcucucgacccuccgcccucccaccuagcacauacacuuuucuuuuuccccacccucguuuccucugaacuuggcucuguggaucaggucacuccuggccccauggagacagccaggaaggccaugcagacucccuuaggagaugaccucccaggguggguacaaaaaaaguugagagaaauucauuucauggccaguggcugcuuagaaaaggcgauuccagcauccgaaugugauaaaugcuaacugagcauuaaucgcauuaaagagggcccuauaaacuuuucacuucuaauuaaauuuguccaguggugcugcccaagcgaguacucugggccuuuguuuauguggaaaauuaaaaugcaaauacaaugagauuuauuuccaggaguggagugaugggcuggccccucuggcuacuggucuccaggccugucaggucaggugacugcuucuuuggaggugcuaucccccuugugacagauucuugugugaagggagaggccagaguucaaggucaaauagaguuaguaaauggggagaagauguagaaagaauugaagagaaggagaaaaaggcaauagauuaccaggaauauagggagacauuauucugguuucccacccuccuuccccaccaacucacaucucuagggguauagacccccaaaaucuuacuuguuaauaucaccacaagccuccucugaagcuaugagaugaaggaguacaugggagagagaauuuggaggaagcagcccugccaggcucggcauggcggcucacaccuguaauccuagcacuuugggaggcugaagcaggaggaucacuugagaccaggaguuugagaccagacuaggcaacagagugaggcccaucucuauuaaaaaaaaaaaaacaaaacuaaguggccaucaggaagggucaagggccuggauuucucuccagcaguuugagggucaucugcuguccacaccgggguuucacugggcucuuccugccaguuccaaguggcauugacauggggcagugaagcauagaggcacaaaccaaggaggacauugugcaugcacgccugcacgcacgcagccuucuugcacauaaggagagccgguuucucauaagaauaaacaaaugucccuugcaaggagucauuuagugccgugaucccuugauaaaagugguaauccuaaaugcuacugaauggaacaaucuaaauuuccuauuuacugagaacauaaauuaagucgaggggagagaaaaccugcauaagaaaaauuaguaggguauaucaguuagagacacugaaagauagcuaugcugcucucuggauaaggaaguuguaaauagcauuaaaaagucaagcaggaaaggaaauggagguaggagaaaugauaaaagacagagcacuaaaucacaaauagggguacauguacgaagucacaaaccggcuuuaugccaagcuuugcagaauccacagcuuggacugacaauacauagagaugcuaaacacacaggcaugcagacuuccagagagugucaguaugcagaggguggauuggucgcaccaugggcaagcuguugucugugcuggacucugggauugauccaucaguuccuccuugcagggaucugauuggguacaguucgguaggcagucgaggauacagcuguaugagguuuuuaaaggucuuuaaacacaugagucucuugugagcuggauccaccuucuaauggaucuccaagguagcaacccauucccagaacacugccugcuugacugguuuugucaaauagcugcuaccccuguccuccuuuuucuguuuuauucugggcuacucuuuuccuuuuuaguguucacuuaugccucuuggaaauucaugagcacuugcugacaaacagguuaaugacuguggcaacucccaaacaucuggauggaaaccaaaacuucagucaaucaucuauaaagguugucgauaugaugccaaagaucuggcgauuuagaaauguccacauaauugauugaauuucucaguuuuuuauccaggcucagaaucaacacauugggaaacaccuauuuucagagaaaaauauuccaggaaacaaaguguucucauuagaaagcaucuuugauguguucgagucugauuucuggcuugaaaggaggcugggcugggcucuaagucagauggagaucuggugguuagaguaguuaguauuggaacgagcacagcuggugagagguuuccuucccccgaaaguuggccaggaggguagaucacuuuguccaaauaagcuuaggcugccuguuaggccugguuucucuaagggaguccauuuugccauuuuaagggagacugucagguucuuaagacauguggcuuuuucuucauuuaucuuuucauucauccauucagaagcaaguaggugcuugcuaagcaccuacuaugugcuaggcaauucacauaaagcuauguggcauaguguuagaaagcaggcucuggggagaaacugccagaguuugaagcuggcuucccuacucacuggcuagaggguacuggguccaccuuauauccucugugggccccaguuucuucacucauaaaaugugggggauaauuguguaggucucucauaaguuuucaugaggguuaaaugagugaguccacauaaaccagcuuagaauugcaccuggcagguauuaagugcucaauaaaugcuaguuauuauuauugcaguaguaauaaucaagucuguauuucuuguuaugcgucuauuucaguguguaugcauucugcuuuguguaugcacaaacauugaauuuuuuuuuuuuuuuuuuuuuuuuugagaaagagucucgcucugucgcccaggcuggagugcaguggcaccaucucggcucacugcaaccuccgccucccggguucaugccauucuucugccucagccuccugaguaccugggaccacaggcgcccgccaccacgccuggcuaauuuuuuguauuuuuaguagagacaggguuucaccuguuagccaggauggucucgaucuccugaccuugugauccacccaccuuggccucccaaagugcugggauuacaggcgucagccaccguggccggccugaaauauuuuuaaauaaaaaaguuugaagagccaaaaggauauucugugaacagaauuguguaucaugaaugccagugagaaucauggucccucgugagcccagauggauuuaggaaggggacccacucaguguauuuccagaaaaaaagacccucuaugauucaguaaucugaccauugagcagaauuagucagauaauugccccuuugucaacuuugagagcccagaccuuguggcuguguguguguguguguguacuuuguauaacugcacauuccuucucuuggaagccugcuauugcuugaggaauucaagguuggcauuuucuaggcuucauggcauuuucguagguuguggugcuuugcauuuuguaguuuuuuuaaaagauaaaaugaaaugguaguggggaaaaaguccuuauuugaugcauuugaaggguuccacugauucuuaaaugucauacaggggagaggaaagggagguaaacaggaagaggaggggaagagaggagagaaaauggagauaagacaaaggaagaagaaagaggaaagggagaagugagcaaauacuuaacaaauucaaaugaaaucugucuauucuugucuggcaugucuggauauucuaaggaaguaugggaguuugacaaucauugcaguuauuuccauugcuaaggaguaaaaguuuuuaagaaaaaaauuucaggaaaaaauuacuuugggcuuaaucuauuugaugaauggcuccaacuaacuggacaacugcaaauucuauuuauucuuugccugacaagagcaaauaugaaacccaguuucccaaacucaugacaauguguuucucaucuuuaugggaacuuccauggaacaagacugaggugcaaucccauucuugccucaaguucucccugccccuuuggcuuaguuaggugaccaaguucagcucaauggauggcuguaagacccacacccaaauacuuacagagucacuuaucugauaccuuuuauaccuuuugcaucauucucaaauuccuagauuucauuauucgucauuuaugccuauuagcugguaaagguucugauuuucaaauuagaaaguaaauguuuuuaaugagcaaaauuagaauccugaaagcucaaucauccuuacauuuuucuuguaguacgaaacaagucaagggcugccuauucauuaccagaugcagggccagaugcugcccucuguguggacauaggcaguggugagcucugucaauccccagccccugccacugcccagauggcagggagagaacuacccucugccccugugcuaccuggcugcaauuuuugcacuucucugcuuaaaacacacacacacacacacauacaccucuuaauuugucuuaggauuuuauguacacuagcacacauguguacauguuuauacacauacacaggccaaucuuauggcugcuuuacucagaaagccuuuauauuuaucaucaucaucaucaucaucaucaucaucauagugguuaacaagugcuuacuacaguaggaaccguuacaagcauguuucaugcauuaauugauuuaagcauccuaaacaaccccauagggcuuuauaggauuguuauagaugagguagcuggaguacagagaaguuaaauaacuugcucaaggucacagacuaaguagcagaaguaggauuugaacccaugcaguccuggcucuaaaacccacaugcuuauccccuaugccauacuucauaucuacuuuggaucaagggaagugcaggcacaggcaaucuccuggggaacucuguauauuuugcagucucuuacaagcucaaaacaggaaaccugcacccuagcagauggucacaccucuguguaucucuguacucuuccaugguguguguuccucagugcaggccacugcugagccacaucaucuagagauacugggaaggaagaagauacuaauagccagagccacagaguagaguggaauggggauucuuggaacuagaguuuauauugcuguucccauugggauuggcaaguuuacucccguccauccuccuccagcuccaacagggaucuagacucucaauuggcauaagguuuggacuaggggcuuaacucuccaaaucaggcagaccuguucucguuugguaaagucguaacuguucagcagagcagggacauuugcuuccaagaagaauagaaucguauuuuugguuaucaagaagagauuuguccugcaucucuagaaucuuccuucugaaaagcagcagugcaaaugaccaggccagaguaagcuaaaaaagcuaaaggauggauccucucacccacaaccacaccaagaaggcaauuaaagcaauuaccgaaucauacaccaucacccagauccagcaucauuacucaacccacaucaccaaggagacacccauuaaccuaaucucugagacauacauuagggaaaaaagaugcugauaugaucaaugaacacaauaauucaaagcagaaacacagacacugccaccaaacaauacucaaauuccuccaacucaguguuacacaaagugcagccaccucaauacaauaccacaaaacaccaaguaacaaacauuaagcuagcugccggaaugcgucaacacaaugcaauaauacacgguaaugcacaacacaguucaaacucuguaucccauaggcacacccauacccacaggcugaaaucauguggccacuugagccacaugggcagacacacacagagacagagccaauagcgcagcacccaauucuccugcacacccagcagaaaacgaucacagcugcaguccucccaagcacgaugcagccugccagaaagcagcagcaccaugccguuucuccagcagguggacguguccagaccaucaccucuaauaaggccucugggcucucauugcuaguaagagaguaaacuguccccugagccugcuucccgagacaggacaauucaguucuauccugguugggguuuaauaagacuucgcuguuagugaaaaugacagagcuccagggauaaagggaaaggugguggugggaggggagcucacuaagcugggugcaggaauuccccuuccucuacccagcccuaccuucuguggccauuccagagccaaagcccucaugcuggguguucacggaguaucgauucagucugcaagcaauuuuaauauuucuucagggacuuuccagcaacagcacaagucauuaauucacccucccaaauugcuuauucaauagcaggaacauggcuccugaauaaagucccagaauuuaugugacucgcacgagucaggaggucaaacaacuguuauggagcgaaguuaaaaauccaaauaaaauauugacacuuuuuuggggagggggaggugggaagcaaagguauuuaaaauagguuuuuguugcaaugcccccaggauaaagaauggaaggagacugaagacaaguuggaguuuauaaaaucaauggaauuuauugcacagcuacuuggcauuuaauaauucucucauuuccacaucccccucccccaccccauccuggccauagacagagagauacacagguauacaaaugcacauuuauguacgucaauacuggugcauggaccaauauaaaaacacgauugugaugugaaaaucucaaacaccccaggaagggaacaaugaugguguagagucucgcuguaguuuacauauuugacagaaaugggcauaacuuggcagauacucaugaagcagguuuugauaaauauauccacuauuauaaaucuuagaucaaugcauuggagcagaccugaauauaaagauaaacuaaucauagaaauagauccucaaaacagaaauugagaaacacaucuauauguaguaucauccugcaaucauguacaugauuuggaaacuagauagaugaaaauaauuuggaaaauuugccccccaaaccuaccagugcauauaaaauucaccgaagccuauagcagcuuaaucuaaaauugugauuuguuaguaacacagacaugaugcuuaucaaauacagcuauggcacaugcaugggagaggauaagcguguuuaaaaucacagcuaccugugcucucuguuaauugucuacauauauaauugcucaauuuuccaaaaucauggauaugaaaaggcugaaggaaaaauuuguucauguccaaauaguuaauaaauaaauauauauauaaauuucccaaaaagaucaacugauucagccuacagacauugaagucacaagccuggauccaaugucgggcucuuacccgaugcauauguauaauuauaugucaauugaaaaaaauaaacaccaaccaaacaaacaauuucuggcuccaaugcuauuaagcaugugacuuugggcaaguugcuuggccuuucuguuguuucuuaggcaaaauagagaggauggcuauuugauagaguuauaguugaauucgaaugagaaaacacauucauuauaaugccuuucauacagugaauaugaaauaaacgauaguuauugcuuuuacuauuauuagauucagcucuucuauucaggccuagccucucauagauucuaccaucgguucuugauaugacugacucauucuacucaaugguuagccgcauaaguucuagagugagacacucagguuuaaauucuggcucuguuacuuaacagcugugugaccuuccguaaguuaccuaaccucucugagucucagcuuccacaucuguagauuauggacaauaaucuucauagguacuugugagaauuaaguuaaauaauccauauaaagugcuuugcacagugccugguacauaguaaguguauauuggcccacugugucccuuaagauuaugucauuguuauuauuggccagguacaguggcucaugccuguaaucccagcacuuugggaggcugaggugggaggauuacuugaggucaggaguuugagaccagccuggccaacaugguaaaacccugucucuacuaaaaauacaaaaaugagcugggcgugguggugugcaccuauaauccuagcuacucaggaggcugagguugcagugaaccugggaggcagagguugcagugagcugagauugugccauuguacuccagccugggcaacagugugagacuccaucucaaaaagaauaaaauaaaauaaaauaaaauaaaauaaaauaaaauaaaauaaaaaaauaaaaaacaaaaaacaagaguauauuauuguuauuauuauuaauaauaauauucauuuguuauugaacaaauagcuaucaaguacuuacauuauaccagacaccauugcuaggugcuggggaaagacagucgugagaaaaauagcagacaucugccuucucagagcuuggagggguggacucuaugugaacugaguaagcaagaaaacaagguuucagcucuguguuagacccugagaggaagagggaaacagagagaaauagauuggaaagcuaggauagagccagauaagggaagauuuugaaggccgggcugaagaauucugaauuuauccuauaggugauaggaagugauuguaggguuuagccagaucacauucuuucaggagacagagaaagacugacggacuguuuuugaaugccugaguaggcgaaagguaggaaaggcuagagguagggaggccaggcagucacuagcgggcccuacaucugcugcugcucaugugacugcagagggaggugagcaugccuguggugggacaggguugggggauggacaggugcagagugggagacuuuaucccagcaaugaaucuauagcaguaccuuguucaccuuauaucaagcagucuucaagccucuggagcuucccaaacaggaucauggggguggacagcugguagauuccagcucuagccagaagcucugacagaugagggcagggccaguggugagaggcgcuagucugucacgcucugggcuuggcaugcaccacagacugguuuccaaaugguuaguuaaacacauugccccuuaauuuuuaaaccuaugcauaucuugaaguuaaaucaauccauaugcuuagcauucaucauauaaaccaucacuauugcccccuugggccagccccauggcccaucuagccugguaaauugucucuggccugggcucucaggggcacguggcggaaagauuaucgcccucaaugccagucuuggaaggcuaaguugaugcagaauauaugccugguaucuaaguaacccacugggaauuuaucauccuggaauguaccaaaaaccauuuugaaauuauuucaauuuuuaaccuaugguuuuguuuccacagagcaacugauagcuuauugaauuuuggugacuaugucagcuggagucaggguuaauagauggagagaaauguggaucgauagaguaugagaaaggaacuuucuuaacucacuaagacuuauucccagcucuuccaaggauccccuugagaaaccaaccagaaggaugguuucuucaccuccuggcuuaagcuagucuucucaaauagaguucagaaacucuaauucaggucuaagaugggacccggugauuugcauuuuagcaagcaccccaggggauucuaaugcagguaguucaagggcaguaguuugaggaaacccuucugccagcuuuuugguaggacuuucauuucuuggagcucagcuaugacuucugagagucaacaagaguugacacauuugggaagaacccugguaaccuggaaccuguguauuccagcaacauccugccacagccagaauggaagguccugcccacagcucugaagaauggccuggcccuuaucaguggccauguucagaacccugccugacauauggucaguuauccagacugaaaccugcagggcauaugagugagcaugggcaaaaaaaccucuaaacucagcccaaacugcagccagaggcuacaaaaacaguguguuaagugauucaggccugccuuaaaggaagccacgugcaggagagaugcuguuuccuuuguguuucuguggagaggaggaaguaaauuucaauuuuucaguuccugggguauacaaagggggagacucuaguuccuuagaguucucaggaguagggaccauuuccaggagagguaaacauuuccugggugaucuaugacaucucacucaagguucugcugugaaaagucucccgcuguuaguguugcugacuugccucggggccaagccauggauacgugccugauauaggcagcucucaaagacuuguguugaagcaauaaccaccugcauuagcugggcaaaauauccuuugcugaagcaaauaucuucuuuuuuuuuuuucuaagacacagucucgcucuguugccgaggcuggagugcaguggcgcgaucucugcucacugcaacuuucaccucccgcguucaagcaauucucugccucagccuccccaguagcagggauuacaggcauccgccaccaugcccggcuaauuuuuguauuuuuaguagaggcgagguuucaccaucuuggccaggcuggucuugaacuuccgaccucaugauucacuugccucggccucccaaaguguugugauuacaggcgugagccacugugcccggccacaaauauccuuuuuaauaucuuuuuugugugugugacagagucucacucugcagcccaggcuggagugcaauggcaccaucucagcucacugcaaccuccaccgacuccagucguggguuccacuucaccacugcaaucguggguuugagagauucucccaccucagccucccgaguagcuggaaccacaagcaugugacacccugcccggcuaauuuuuguauuuucaguagagauggguuuucaccauguuggccaggcuggucucgaacuccugaccucaagugauccaccugccucagccucccaaagugcugggauuauaggcauaagccaccaugccuggcugcaaauaucauuuuguucucuaggaugauugaguuuauaaugcccaggcagucugagaccacuggcagaggcccccaugaccauucgucuggcuuagugggcaauggggccagcuagucuggcacauuuucuacccuggagugccuuugauuuacugaaucaggaaagacccuccccauaccagggauuaaauauuuucugcaaagacucuaaaguggacaguuuacuccaggacaauuuaaacugauuuauacauguauauaacacauauauccagauacuugacaucuugcuccuaagagcagccugccucaagccuggucaugucacugguuuguucaagcucugcuaggaaguaauuuuguuccucuagggaauaauucuaaaauugggaaggaagucuguucuagacagcaggaaaggauuucauggugacauacuuggagauccaauguacagggguugucagcaauuggguccagcagguguuaauacucccauuuucuagugaggacaacugagguucagggaaaccucucacccuucauuucucagaagggacugaaaauagaaguuucaauuuggugccuuugggugucucuccccuggaggcaguauaauuuagcagguaagggauuagucccugggauuagucuaugugaauucaaaucccagauuuacuguuuauuaaaugggugacuuugagcaaguuguaauaagccuuaugugcaaaaugcguuguuguaaggauugagugaacuauuuauuugaaguacauagaacauugccuagcacauaguagauacucaguagacaguuuuuuguuuuuguuuuuaaacuggagccucuccugaggaagcauugcuccuagaaagccugcccagccuaguccaguaaaugcugccaccucacuccucccaaggugagcugucugaggucaccucaaugcuaauaggaccucuucuugucuccaccucagggaguuuuugcacaccauguauuaucauauaauauaaugcaauauaauaucauacauaacauaacauaauaugauggguagguuaacuuggaaacccugaggcggacgguggauggauggauagaugaauagauacauuuguacuaaguauacauacauuauaucauucuauugauuuguaaaaaguucccggucugccuggcuguaaugagauuuuugaacuuugcguggcgaucaaugagaggaauauuauuggccuggagaauugauauaccugcucucaguggcuuguucugcucccaggcugccccggccccccagguguaugauuccagcagacacuuaaccuuuuuuacagugucaucaggcuaaaaggaaucuaauagugacacaggacuugugcucagcacucugccacuauugcuuuccugucacaaauaauuuauagccuucuauuuccaccccugagccugcaccccagccuugccuccugcuucccccagcucccaggaaucaauaaacucacauagccacggugggacuucagggugcaaggagacagacagacagacaaagagaggggaaguggagagaggagcagagaaggagaagaagagagggacagagagugaaacacagagaaaagaauggggaaggaggaggaagagagagagcugaacuagaagaugaguaagaaugccuggugcucucuuaaaagguggagcgcuucucucuuucuucuugaguuuaacacaguguuaauaggaguuucaugcagggcuuucauucuuacucacagagccugagacuguguugauauccaaguuggugagaggugggggucuuccgggaauuuaaccaguaagggaguggccuccccaccugcccugucauccuuugcucugaaguccugccacgacccccugccaucccuugggucuccuguggauccuugccagugacccuaguggggcuugguccagcccccagucugucugcuugagagucugacgcaaccuccuuuugggucagaugucgccgccgccacugcugcuguuucuugucuucucaaugcucuucccagggucucaguggcaccugcauugaccagucuggggcauacuggguagggaggucuccugccugcaucggccuaaauugaaagcacccgggccuaggggucacccauaggaauaauaauacuggucaucauuguuauuauagguagcauuuauagaaccaaccaucauaguaaucacauuacauggagugucccuauuuaguccuugccacaguccuaugaaguguaugguaguauuaucuuauuuuacagagaagggaauaagaaacugccagggguuucacaggaaacaaguaacaaagccgggauuccgacuaaggcaggcugagcccagaacccauguccuucuuccuuuugcugcucucacucccuuggaagugugggagacucuaagugccuggaaguccccaugcggggcccaggccaaagcccuggagguccccaggaaagggcgagcucucaucggaaaugguggaggagaaagagcaucuugugaaggaaagagaaguggggagcaggcacccuggcagggcagucucucaguggaaauggaaaaaugacaccucccagcuucugagcagagcuguguccuccagggucccagcugcacccuccagggaucuauauccagaacuugaccuuccaggucaaaccugccuggggccguggagguuugaugugugucuggcugucuugugaggccaaguaugaaaaagaauuggagaaagaggaggaggaacauggggaaacgguaucaggccgucaucaucaacaacugcuuuacuucauucauccuuuagccccgagugaaauugccaugaguuguuggguuguuguaugggagacaggaggacaauggaugaccaucagauuuccaugaucccaguucuuaaauucuccgagaucagcucuagggacuggcaagugcccacugccugaggucauggauggacaccaagagcauuaguaacucacagcaggcacccugcccagcuccucccccaugcaccaccaagccgcugucagggaguagugauuuuccaucacucgcugccucagcuaaauuugcgccagugcccuaggggucagaggcucuggguaacaaagacagaaacuccucaagcccguccaguucucucucucagccagccccaccccugggguucccuuagucaagagcccaucagcccucaagccagagccacccacaggcccagugagcucacagaagcuguugcugcaguaaacuaggagcagcugcucugagcugcucagcaucuuucuagacuuuucuuguagaugauuguacacugccucucagcuacuauccaaucuuuuccauugugaucaaacuccaaaucuucccuccaacucuugggagaugaccuugccuucugcuuugcugagagauaaaagccguaaaagcuccuuuucaaagcuuuggccaccugaaaauaugccauuucuggcuaacaccucccuggagucugcacuccauuuuuccuuguucucccuugcucuguuaaucauccacagucccuuaggcaacuucagucucuuccucuucacugguucuuccuccucagucuacaagcuuauccaggucuuuccuacccaagaaggccuucccuccacuuagcugcccguuccauccuccaccuuccauacuuuccucuccuuucguuuuccaaaaacuucugaggcaauagucuccguuuacugcccugccuccuuuuacucccuaugcauucccuaaccuuguucugucuggcuccugcuccagucgcuuugcugagacuccuccucaaggucacuaauggcuaccagaaucccaaaucugugcuucuucuuguuccuaauucccuucgguccccauguugcuguuggcacugcagguuguguuuuucuugaaacauucuucuccacugacuuaggugaaacugaccuaucuugguucugccauuuccucugcaauuaauucucugaauccuuugcaaggucaguuucuuuucccagucccuggaaauaaauguccuccaguauccacuccuuaggccucuugucuuuuaaacacuccuuuccccggucccugacagucuccuaaauccauaccucugugugccugcugaugcaggggcauugccccuggacgcuccucuuucaccucaaaugcugcacaucuaggaccaacaucaccacuucccuccaaaaccagucaccucccuauagccuuauuccugaccugcugauguaaacuccaccaagcuuccaguuacacaaaucugaguuuguaaaaccaugguugacuccaguugguugccaaacucugaccauucugccuuccucuugucuugcaaauucuucccuuucuuuccugagaccagcucccuaucgccucaugccucauguauauguauguugcuuuacugggaucuguuuguagagauccccccuaguuuagaaaucacucauggcuuaaggcccucuaaaccugguuccuacauguugggggcaggaugacaaaguaacaaaaagcauagauuuuagaggcugcauucugagucuucccuaauugguacugugauuuuuuuuuuuuuuuuuuuuuugagacggagucuuacucugucgccuaggcuggagugcagaggcacaaucucagcucacugcaaccuccgccuccuggguucaagcgauucuccugccucagccuccugaguagcugggauuacaggugcauaccaccacaccuggcuaauuuuguauuuuuaguagaguugggguuucaccauguuggucagguuggucucaaacuccugaccucgugaucugccugcgucggccucccaaagugcugagauuacaggcaugagccaccgcaucuggccuuuuuuuuuuuuuugagauggagucucacucuauugcccagacuggaguacaguggcuugaucuuggcucacugcaaccuccgccucccggguucaagcaauucuccugccucagcugccugaauagcuaagauuacagguaucugccaccaugccuggcuaauuuuuguacuuuuaguagagucgagauuucaccguguuggccaggcuggucucaaacuccugaccucaggugguccacccgccuuggccucccaaagugcugggauuacaggcgugagccacugcacccagccaguagugugaucuugagugagcuacuuaaacuugucucagcuuugguuuucaauuugcaaaaugaggauaauagucucuacuuuggaggugguugugcgaauuaacaguaauauauaugucauauaaauuguguauaauauuggcacauaguagauguucaguaaguggaaaauggugaugguucucaucacauccaaguuuucauucuuguuuccucuuagucccuugccugucuccacucauucuggcugaccacucugggcauuaacccagaaggcagcaggcucgcguggcuuccgcuuccaccagcuugugaugcccuccccucuacuucuuuguucaucuuaggaucaaguuauuuuuuacuggggaaagagacaguggagauccuguaguccaaccccuucauuuaaagcugaagaaacugaggcccagagaaguugagaggugagaccaaggcuauguggcuucuuaaaugcaaaaucagaagcaggacucagggccccugccaugcagcccaguguccuuuccgccauccucugugccucugauuucagcccuacuuggcuuugaagaucuacaucaauuucccucuguucagcgacuucuuccgcaguucccucuccugcaaggggaaugguuccucuccuccaaguuuccagcacuaacuaccugauucccucggguaacugagcuuuuuuggggauuaagucuccccuccccaccuucauauccagcacugugagcuaggggccuuaucccaacugccugcaaguguucaggaaaagcuuuuagagcugacuugcucauggcuugugacucaccuggcugguugaggugagcuuggcucacaugccucucuguggggacaaggaacgcuaucagaaaaguggcuuccaaaggccccucauuugaccaguggguagggggagcauuccuccgucuuggcccugggacuggucuuuggcaucauugagcccucgguuuuucagaucccugaaaagcaggcuccuggaauguuugauuuggccccuucuccccaggauguacagggagggcaccagaccuuucaaccaggcuggcaaagacgcugcaauccaaguaagaaccucagaaaaggaggccagcaaaccagccagccauauaggaacagggcucugacuuguuugagggcaguaagugggcucaagaagagauuguucagccugacaucuggcaaagggacugugugcuguguuggaguccuggggacaaaagaaagggucaccugugacccagccccucccuggcuacuucucauucuuucaggauauggggaaaucucauccucucaacucugaaggacugugacacagucccaaguaggaaagccagcuccaaaaugaucucaaaacccaggagguccugguaccaggaagagaugcgugugugguugaggagagaaagguggacaacaagccacuagggcaguccucacccugcagaaaaagaaaggaugcugugcucacugggucucugcccugaucuuugcuaccaaaaaucaaacaauaauuugggugaugcacauagcaggacauaaggcaggcugcauucacccagagcugcauuacguuggaucugcggagccaacagaaggaaaacccugugccuugcagcagucagugagggcagggacacagggagcagauggaugaggaaaucgcugaggaacuugggagagagccccuuugcagggcugggcuggaauuggccgggauaggagugggcauuugaugugugaugcuguugugacgcuguugcagaaucauccggaccaaaguucagcagccuuuccacccaacgccggauggggcugggacaggagugaccgccccuggccacaccauugguaagagggcucagggaaggggaggaaaccagaucccaccuagagaaaggcaggaaacgcagcuccaccccugggaacugccugcccgcuugagguccagagcccaaccuauuugccaacuccucucaccugagcuccuguccacauagggucuuccugagagauacugguucucuaggacuguucucugccucccacuugugucaccucccucugcccugcuuuagucagucccuauccucuccccuccucuccucucucuuaaguguuuuucuucuagcauuucuucuucuuuuucuucuucuccuccuccugcuucccucucccucauucuccaacaucuuuuguuuuuaucugauucugucucccuaccugugcccucuuucuuuuauaucaacuuucuuauuccaucuuuguuuaacauuccaucuuguucuuaacauuguccucugucuucuccccuuggcuccucuucuuuucucccucugcccuucccucucuucucucuucuucuuagguguagcucuggcucuguucugucuuccuccuuccucauggccucuuuccucuuggccuuucucucuugauugcucagccucugucucacccacucuguaucucucauccuuucuccauccuccucauucuuugagccaugcuuagggccucucaaagacgugacccaggccuacuagaacaccugcuaacacuccuccucuguccccaacgcacacagacuagcuucccucuggcccaaggagaaacuuggugcuacuguagccauagaugaggcccgggguuugaggggcugggaugugguuacauuuuuccugcugcuccucuuggcaguugucuccuucugucuugaccagcagguaauagaaaugacuaguuccagcccuccaggaguuggcaggagcuguuguuuacuaggccaguguuacagugugugcugggagggaggguugggccaggcuguaccugaguugaucaccauagagcgaauggguucacuaaucuugcccuaagggggaaauuaggaguuucucaagugauuucaagaccaaaagcagcugagagagagaaaugcacacuccuggggaacaucaggaccagucuugugucuccuggagaaucagagacagaucuuagaaagccacagacucuaaaucaggauugguaaagacucagcccaggagacugagaacaaugagcuggggcuucauuagaaggguuugcccagccccagggauuggaugagcugugcaaggggguauccaaggagcugugcucucuagaggaccauggaggugcugccuagaaggagacagguuugcuguuuccugggccuguacuccauccgucuuuaggagagugaguuugagaaccccagugaaauccacaggucugcagagaaggccugggguuaaacugggcaccacuuaccucagggcuggacagaagugaauaauagccuguauauggcaaugcaguccccucuuaaauagaccccagaggaaguagaggaaugagaggaacgugggcuccucaucccuccuuauguccucugcuucucucugccccccagccuuggggcuuuggccuacgaucacaacugcuaaacugcuauccugaugccauuuccuccuuccucucauccaguucccagcacggccuccccuccuguuuccagcgccuccaaugacccagugggauccuacuccaucaaugggauccuggggauuccucgcuccaauggugagaagaggaaacgugaugaagguagggaggagggaagagguguggcuuccccuucacaugcuuuguccuuggacuccaagcuccgguuucggccuggccucgcagcugcucugcugugagaucaauuuuaguagcaaagcccagguccccccacugcccugcuggcuccuggagagagggaggguggcugcuaguggggccaucagcuucaccaucugcucagcagccccggcugccucaccugccacuagggcucacccuaucgaucccugugggaugucaggaggagaagcaagaaccguuuaccuugggaagguuuuggaguugggggaacagcuggucucuggccugaggaugaaaggccaaccuaccuuguccuuaccugaucccaaucugucuggaggugagguagugaugucaugugcagccuagccugguguccuuucucuuuaacaccugcacaccgcccccaguucaaaccucacagggagcuggacaugggaccccucucuccucuucuucuccaugaguagaaaugccacuccaaauccccuggcccucucccucaccucccugaaaugccucaaggugcagccaggcuguuaggaagggugucaaagggaagggggaaggaagaggaggaggagagaagaaaagaaauaagggggagagugguagggaugauccugggacaaaguguuuuucaaaugucgugacauugggggucccuuggugaccaucugguucucuucugaugcgugaagcuggggcacagggcuggcagacccugaacaacagagacaccagugucuccggccugcguccugcccccauuuucucaugguucccgcuggagaagugguaaccuccuggccuucagaggauuuuaaagacaucucccaggaaagaggcagaauccucaaacaaugagcauaaaggggugaccaucuaucccauuagcccagaacagucccaauuuaugccuguugucucugcaucuuggccagucagcaucucagcaucucccuuuucucucaaaaaugucguguuuggacaauaaauuauguggucauuccacacauagacaaacccucgguaggggaagccuaauggagugaggagcagagaaaagggacaacacugagcuugccugggcccacaguccaagaucccccagccuaggcugagggaagagagugggagaggccaggcccccagcggaagggacagcguggaggggaggccuaggccugacaagacagugaugaccuggcgcuggccuccuuccagaagcccuaauggccucguuucacagggaaacagcuugucuggcucuauuucuccuucuuccaaaauauccaaaccgauuuggccgccacggccuuugccauucacuaaauuucauugugguuguuuuggcggcggccccugaugggcagggggagguugugggaaaggcccuaagucccaguucucccugaggcucccugugcucaggccuuggccaagcuccuuggcaccccaagugcuuugguagaaucugccucaaacccuaaaggucucucccuuaaccagcagccccuguguuuuuuaggggugagaggcccagcagcccaugggaggccacagauaccccucuguacucucccuuuucagucugaggcuguggccaaguaugccaaccucguggccaaguaugcccucugcugcaugggcuccuguggggcaagaaaggcuggggguagggaggcacuggcaugagguuguggucacccagggcugcgccuggcuggcccagaacagggcgcucuccugagugguugaucgccuucauuguuucuaaucaauucaguucagugaaccuuuccuggacaucaguuucaagaaaggcuugguacuauaggaucccaaagcagaacaagauaugauucuuguccuuaaggagcuuacauucuaguggggcauguuaaacaugugagcucaaagagcagauaggcccaucagauauccuguugcgauggaggucugguggcgggccacaggaacugggcuggggagggaguacauggccaggaagggcugcucuuugaggaggggccugagggaugaagaggagaauguucagagacaaugguagccugaaauucuaucugauagacugagccuugugaccagaaggcccuuuggccagccacugcagggcagcuuuagcagggauagaaggcacaaagagaugugguggacaguaaggcugaggagacagguuagggccacaggauagcaggccaggucuagaccauagaaggaguuugggcuuuuuuuuuuuuuuuuuuucugaaagcaggaguagucugagcaggaagggacaggagcagggcuggguuugggaagcucaugcuccagcagugugacagugaugcaccagggccauguugcaggaagcagugaaagccuucaaagcaagagauuacggugcccccaaguuuccucugaaacauuuaccugcugggccuauccggguggcaagacauaucagaggccucacucuuuuuugagagacgguucuccuccucuuaccaacuccucuugaccaaccccaggccaaauggagauguauuuucccugguggaggccuggccuaugagggagaccaguucucccugaccucccccuccaauccugauccaccagccccuggugggaagggagaggagagagcaaagguagagcuguggcagccccuccuccccuuucccccacucuggaugcuucuaaggagccaggcccaguuugcauuagggagcagcucagaugauuaagaauaagggagauaauuaugugucaagaugauguagcccaacucugcagucaggccaagguagcaaagcagcuggcaggccagucacagaaggcagccucgggcaugggcugcagacacccagguguguccuucagugacugggccgggacugcagcaaaagagaauacugaccaggggacuaagggguguugggaugggacugagcacgcacauuaaagggcuagacccuagagggaauggaggggcucaucucccuccaggaggacccuuaaagacccugccagacuggcccuccuuuggccccaagcacuguggcaucuuccuaggagugucauaccccaagggcaagcugugaaucucuuuguccuccaggaagcugcuccucuuuugcucuggguacaguucggccuauucuucagcucuaacaaugucacggugaugggcauuagugaggacaaucacugcagugagugcuggcauuauuggagacaaucucagcaguaguuauugguguucacagugauaaugcccagaacauuauuggcacuggcacucggaauauggacaguguuauuaguaucugcagcaaucauuucccuggggauauuaggaaaggacugaucagcugugacucuggggaaaaacuggcagugacugugagccuguuugagaccccuucccaugccuuggccuuugagaguauggaaaacacccccugacuuucccuugagaaaugugcuggucaagaggcuuugacccucaucccaagagcccaggagcucccagaaugagacagguagacaguccagauagaugaggaaguuauguucugaagcacccagaagacaggcuguccaucaguccgagaagguagaauccccauucauaucauucaaaaauccucacuucuuagcuguaauuaugggugggcauguuagugcuggauucccugggcccuuugaagggaugccaauucccugaacacugugugagcugguuuauguggcuggaggagagagauucuuguauuucccuaucuacaaucaggcugaaaacuggaaguccuucgccuuuacccaguugcuuucggcuggggcccaaaacauugcuguucaucggugaugguauugaagcgcagggcaguuacacaacuuguccaagaauccaaaugaagucauauggugagaaucugcuggucugugugagggagguguguugggaucauccuuugaggugugagauugcagggggccaugauuuugcauuccauucauuagguguacaaugaauugugccauugaguggugccaagcuggugcaguugugcguuugcaggcagggcagguugcauggcugcagauggccgaguccugucacugccuuuaauagcucccuucugcuuuggaugaagccauaaauggaagaagcaguuuauuuccuuaguuagcuaccauccuagagguccccaagaguguugcucagguuagacuuggagcaaaugaggggauuaagccguggaaaugagaagcaccugcccuugucuacgagccuggcuugaggcagcagaagguugcaaagacucccaccaggaaggaaggcacaggguaggagugagcaugccaucccuagagcagggcauggaugggcaguggggcucagugggaaugaauguggccucuggagugagcacagcagggucugaauccuggugccccucacuaguugggcaagucaccuaaccuucaucagcucaaucuucuccucuguaaaaugaagaugguaauggcacuuccuuccugggggcuguggagaggauuccaugaggucgugaauuuaguguugagcugacuucaucuuggagacgcauccuuguguaucugggaaagaaagccuaauuggcagguuuauguuucaugaggaaaugaaguuguguuagaaagaaauuuauuugggcauaggcgcccuaaccuuggugcagcuccuuguaacuagggcagccuuuaguggaugcugggauuagcuaacccggaugggaccagcgcaguggaggaaagcugucguccucacacccgggauugggagaacguuuguccauuucuaucuguucauuuacucugugguuacccacuugggccacaugucaucuuucagccuccacaggcauuuuagguguguauaaauaaauaaacauaagauccucuucuuuuucuaacaugugggcaucucucccucuauucaucuguggacauuacugcucccacaugcaaguuuauuucuuuaccuuggaaaauguauguuuguuuuauaaacccaaauguaauuuuuuacacaguuuaugcaagugugaguaugcauguguucuaccgcucugaggucuuuggguauaaggggaugggaaugucaugcacugggaaggugugcaguuaccuggguagugugcgugcuuggagagagugccgggugugacugugugagcggggagagcucuaagccaggccucaguguguugagcgcccaugguccugggcacaggcaucacccuaccuucugcugauaaagggaggggcuguccugagccugccuccagggguggccuagggcccaagacuagggagacuaaggcccuuacagccaggcugugagggaauugcagcucagaacccuuguagcccuuagaaggggagucuggucucccgaucuugggauccugcccccaaucuucugccugccugucuuucgggaucucucaguguuugucugucucuuauuugcucuaguugagguauacacugauccugcccacauuagaggagguggagguuugcaucuggucuggacuuuaagagguaugagggccagagggaacauggcgugggggucaagggaaauagcuuggggguggcgguuagagaacauucagagaguggguuccuaagggccagagcauggaaaaggaggaguuggcucaggcuuccacugggagaccuggaggcuaacagagucucagggccuggauuacuuccgccaugggccacugaugggguuugggagcugaggccccgguggccuggagggucaggcacucaguggauggggggucacuuuuucuagcccuuggaaaaacaaagagcagaucggguaguaaaacaaaagcaaaggagaccuggaagcaccugacagcccuaauucaucacagcccaaguuuuuuccuguguucccauuauauuuguuuguaaaaguggaaaucaauuuugaagguaauuuucuggaaagaauggaagggaggugggagggccggauaaggcagagaugguaaaaggaaaaauuuaggccaggcacagcccaggggcagcucuuggcaaggugaaagaaaauugcauauucaaucuccauccaugaaucuuccucacugcugcccgccuccugcuugaaaacaaugaaggcuuuuucccaacgcugggcagggccucgguaucagccucacuuuaacuucagggucauuaauucccugauuauugaaggagaagagaggguugcagcaucgucaauuccaaaggcacccccucaugugaucgggcacuggcugggguuggguggggggcacccagggcaaagugagguguuguuugagaaaggugugaggagcgaggaaaugggggagccacuggacuaugggggaaggaagccaggaggguggaagaaggcagucauuacugcauaccucuguuguguuguuauugcaaauuaaaaguagcauguuccacuccacagcuaucuuuggggagggaggggcaccgagggaggugggggaucuuaucauugcuucuucagcagaccagccguggugucaccgugugaggugacauuugaauuuacaauuccgcugagaaaagccauuaauucacaaauuaacauuucucccucucccucucucuuuaacacucucucccucucucacauggaugugcaagcaauugaaaagacaaaggaaauagccuuaaggaagagacuuuacugcuagucugugcugagauugcucccccugcuuccagauagauaaaccaauuaccugagcagcucugcuccuggccgcccgcgaucgccuccuuuuguaggcugccuccauggcuggauuacacucgguguaucucauuaauguaaaccaggcgugcccuggucaccaagcucucuucccggcucuccuucuggaggggcagugggaggagggcuggggucaguaaaggcaggcaaggaggaccccgaggaagaccagaggcugccacugccuggcuucccaggcccugggcacucgggugcagccugccauguuggcugaggcugaugggggaagucggugggugagcgcuccuuggugggcuugcucugaacugagugagggcuggguauggcugggggcagaggaaggagacagggccugagucucucagcggcauuuugguccagaugcagggggcuggcagaaccagagagggaucugagugcucccugcuugggaagagcuuggagaaguuuugcugaguacacacuauuuuagugggaugggauucagccugaaggagcuuggagagaggcugaggagggcccaggagacuuggcgagguugcaccauauuggguaaacaaaaacccagcacuuggauacaauuaugucuguuuaccaccuaauucuugcaugcacacacaccccccccgacacacauacaugcacaccgacacacacacaugcacacccagccauccgacucuuuugcuagagaagacggggagaaggagugugcucccagguuucuaaagugagcuuacaucguggguagggaauugcagggccucucucugcuuuugcucuccucccagacccugguucagcacuguaagaaggcauuuauguugguagggggcagcugagcagaguuuuugcuucucucucucucuuuuuuuuggaugaaguuucacucuuguugcccaagcuggagagcaauggcaagaucucagcucacugcaaccucugccucccaguucaagcgauucuccugucucagccuccugaguaguugagguuacaggcaccugccaccauaccuggcugauuuuuguauucuuaguagagacaggguuucaccauguuggccaggcuggucuugaacuucugaccucaggugauccacccaccucagccucccaaagugcugggauuacaggcaugagcgacugugcccagccugaguuugugcuucucuaaggagaggugcucuguggauuauuggugggauucuaugauuucacacacuguacuaucuagcacaucacagacucuccccucccuaggagacaggcccuaugaaaguccagaaaccaaaucuauaugaugguaaccaucugucuagacaaguuucugacuuuaacugcauuggcucaaccuauguucauuuuccaacucauacccaaaaccuggcuaagguccacuuaguccaagaaagagcugagguucaaaggucagcacucaccaaaacacagggggaaaaaaaacucauuuaugaacacacauucauugcuaugauuauaucucccuaguaaccaaggaaauuaaacuguucauaccugaggggggagguuuucugucuuaguuggaucacauauuuuagccaaacucucuggguagaguuggccgugagccuguugaauacugacuaugucauuauccagagguagguguagguucugucgauguuuuagaaggaccuuuaucuugggcccugugcauaggugauuuguacuuuuuuuguggggaaguacagggguuuagcccuggcuguguggaucaacauaggugcaugcaucugcauauaaguccuugccuuuauaucagagacagcagccaaaucaccaacuaccuuugcuucccaacuaguuaaugcuguuguggaugaagaauuccaucugguuguuuggggaaguauuuugggauuuagcacaaaagaguauauauuuuuucauacaaugccagaaauucagaauagagaggucaauuccacccuaccaggagagaauauacagaauugcccuagaggagacuguauguguccauccaccgcuggaaauuggggugggcggguguagguauaccacugucucagcaaaggcugucugguacuccugcccagcuccauguuugcacccucguggacgagcacccaucuugucagaauacaucuucaacuuccuagucuuucacuuggcaacuaccuuccagcccugcagguaggcauuguucuccuuucccacccagcaagggcaccaagcaggaaaucugcugccucagcucugcccuucuuccccaagcacaggcuauggaagcaggaaggaggagaugagcgccgaagcuauccccgggcccugcuacuccugaguucaccucccugggcgccucuuccucugcagacaagcaggaagcugagaagcgcaggccacuggaaaaaggguuuggagaggauguaggcuagggagaccccagaucccugccugccagcggaaugguccuggcagccuccuugaccauugcugcccgcccuggagcccagaaaaggaccccuccugcccugccuuccucagagccaugguggccuuagggcugucugggacccucuccauuuugccccauugggguggaaaggcauagagggcugggggagggcugggccuggcucaggggcugcgagacagaucacgagccucagagccaaguugcagccucagagccgaguugcagcggagccaguaauucaaaccauccugacccuucggugaaccugaaccugcugaccuugacagcacuagacaacagaggccucacaaaccucaaccugcacggaggccuggccuucccucccucccauucuuggagcccuguggcccauccuccagguggcuccuaauuuggcugcccccaugaaaugucagcauccccucccucccugaggcuccgccugccugcuucaaagcacccuuugugcucaucucuacuggagacaagugugugggcaucuccugggggccuuuccaggacuggggcuggggcuuuauccugcaggcagagcuuuuacaccuugcccuucucuuucugccccaggcuucaccuuuuucaggaggacuggcuagagugugugugcauguguauguguguacauguguaugugugugcauguguguaagguugggguacacacaggggcagcaguagaaugugauccagacagcagacaaggggagggaagagaagccagaggaaagcagcuccaggaaccugcauuaaaguaaaugcaguuuaugaaguuuaugcuuuccuccuagggagagcuggauuccauccaacagccucccagagccugccaaacagcuccugaagcagaaagugugagcaggagagcaagcgagccagugacagagggagagaugcgcggacacacucacacacccuugcuggcucacacagaucucccucggcccaggcagccugggaagccugggauggagggauggggacaguagguuugguaggagugacuccaggagccguucuuuccuccuuucuucccuccucaccugccaucuccaucucuuuaggcagagugcccagcaugagcccuugggcagugugggcaccuggguggacuggugguguggggagccgagggcacugugggccaccuggggcagccagcuuguaggagccgccugggugagggacaguguggguggucuugggcaguggguaugugguccaggcagcaaaagggaccagaaugcuauacaaaggaaccucuagggacuugcuuuuucuucggaugcuggggauccauuuuucucuggcauuuuggucugaaccaugugggugccuuacagccacugaagauaauuauuggagucuuuuaaggagaaauagagaccguauuuuuuuuccugguaauucaaaggaaauaagugguugacaauguuaaaguaugaaagcucacagagggacuuaaaagcaaguuggaauauuggaguaucuguucuucuggacucuucuucacgugcacaagcacauggguucgugcgugugugcacuaauaauguguaagugggccaggacccuugacuuuagaugaaaggggagugugggggagaaaaugccuggagaggaaguccgcagcauaggccuuugcucuggccugugggcuuggcaccaucauguugcuugccccuauggcuucugcgacauaccucagcuggggacagacagugagaagucuaucucccuucucuuucugggaacuccaugucugcucuauucaaauucuaccaggaacugagacagaagaggaugacagagguagaaccauccagaagcagaggauggggagaagagggcaaaaggauagcgaaggaugcucagaaauugcugacuguggaggacgccuugggaagccaggaggugcuaggcacaggaggcagaaacuggccaaggauggcguugguccuuucuccccccugcucucucccucccccucccuccccucuucccuccacacaucuuuauugguucugguaauagcguugauuugcaugucaggcaaagccuugcuacacacacaaaaagaaaaccccagcccuggcgguguggcagugucagcucucgcuguuguucgacaguguaaaauuaaauuaauaaagcccccaacacaggaaaacauaacaggaaauuaauggccuuuacugucgcucugaugcagucauuugcaacccugcuuuccgcaccaaagacuucauaaaugcaagcaguuucucuaaacaagcauacuuagggcggccugguauguaauuuuucgccuugcuuguguccuuugagcuaacaaagcccccuuuccucuugguuccagagauuucuaacugguucuggccccugcuggagccaaacggggacagcaccaggcagagggccccacccgcucccugagagcccagagaaggcugggaaagggcuagggucccaggagcuagacgcucagugagcccuccuuccccaccagccccugcagcaggccagcaggacugcauaccagugcucccaggcaggaaaguugaucuccucggggaauuccccuaaacccacucaaggcucaccccucuccuuccuccccgggucuguccucccucucccacaacuuguguguucccuuccugaggccucuggccuucaccucccuccuugucgguacccacucuccaccguuccacuucuuaauacauggaucgcacacaucuaggcuggcugugacuuggcaguggggugccacgcucuucuucuccacagguaaccugggggcucuuuuucgggggagcuaaguuauucaaagugaggaaaguaaaugugcugguacaauuccccgggguucuagguuuccuccauaucucccucuucucuaccgguugguuaggaaaugccagggcccuaaggggccccucagacaaucccucuguccucggcaguuuucagugagcuaagaguccuugacugcuuugguguguaaaucgguaggauacugaggaaacugacaccuuccucucuggccucucuggggaucuuuguaucaaugugggcccaggugcccaguguguugggagguaugagaggagcagagaaccgggaugugacucucaggagcuuagagccugcuggggaaggcaaggcuguugcacucagacaauuggcuguucauuaaaugcccagacacauggcuguguguuccauaggaaucuggggaaauggacuagaagggcaagcaggaaauggggcuucagccugggagccugggaguggcugagauugagagaggccuuggcugggcuggauggugacaaggcagagugucagauucuuaagggucauccugucuuaucugccacucaccauagaacucuuuccuccaacaguucugccugaaaggccacagcccugccuggacauaugucagagauggacaguggccauuguuuguuugcagcaucacuuuauaccaagucaugcggguugagggaagaccacgggacgugggauccaaauguccagauguggguccaucuccacucccuacuugcucugggaacuuugacucauuacauaauaucucugaaucucaguuuccucaucuuuaaaauagagguaauggcauuugccacagagaauggugguggugguaaagcucuccauuugacacccucccuucccuauccucccucccucccuuucauccacuccaccuuauuuacugagcucuuggcaaaugcugggcuggguccuggguggauuucagauucucacaugauaugguuccugcccuuggaguucccucaccauccugguuacccaucucagaauucauuauugaagguuaaaguuccucugaaaugaacacugaacuccagagacagucuaaccaaugccaggcacaguagagccuugccacucucccaucuggagacucuacauccauaauauagccuaagauuacauuugauuuuuuagcagccaugucagacucaagcucauauugaguucguggucaacuaaaaccucgagaucuuuuucacaucaauugcuaucaagccaggucuaccccauucugcacuuguguaauugauuuuuuuuuuagccuaaacauagggcauuccauuuaucccugcugaauuucaccuuguugguuuggguucuuaauucuacccgauuaaggucauaaggaugucuucuauaucaucauccaacuaguuuuuugcaaaagaguuauuuuccuugaaaacacaggaaagccacauggcccaccaauggggaccuccuccuggcugcuguaagugaaugaaugcuuugggaacuacugagcccaacagccaucaaucauuuuacuuguuuucaucuuguccauuaugcuaggaaggagauucuugguuaaauguuaacacucacuacuuccacauaauuuccuuaauaaauuauuuuuaaaaaucugguuuacaucgaugagcaaauugagugccugcuauguacaaaguauggcaggacugauuuacaaagguaaauaggacacaguccuugaccucaagaaacuuacaaucuagcagggagguagacauacacaucauuauauaaucagaaugugaugaaugccgugaucaaggcaugaagucauaugaugaacgaaaaaaacaaaggagcaguugcuuccacucagggcaacuagggaaguguuuaugagggagguauuugaucuaagcguugauauggaguaaauaugccacaacuuauuuuugugagugcgugcaagcucugggauaucaccauuuucuuuucuguugcccauaaauuaacuguauaauaauuucauuuaaaggauuuccagagccugauccugaauuuaugauuuugagugucauuugcauauguguaccucuucccccuuuucugacaggcaggauggccuugggcuugucacugccucacccuuucuuugugacaucucagggaucaucaacagcaguuuuaggguccuguguggaccugggaaaguucacugaaauggccagagguuaccugccuggccccucccugaccagggcacuagugcccuccuacugggcucaguuugaagauucuuucauuuggagaagacaaaagcaagcuaagguugagaaguucugccuucucucucaauauuacauccucuucccuaggacugagccaaaaccugccuuucuuuucuuucuuucuccaaggcccuuuuuuguugucucagcuuguucugagcuuuugucuuccugacaggcucaugccacccucauauccauccuugguuaugguccccgcuuccaucugucauguauccugcauaagaggaaaaaaagugacuucuaugauccuaagugcaauacaugcucauugggaaauaccuggaagagauaguaaauuuuuaaaaauucacucacaaugucgucaccaggagauaaccacuguugaauuugguauauuuucccauucucuuucuuuuuuguguauauauaauuuuuuaaucaaaaauugaacaauaccauauaaacagcuucaugucuugccauuuucaccuaacauuacuuaauauaggaccauuuucacauaucauuaaauauucuuugaaaacacgauuuuuuaauggcugcauaaucuuccacuguucgauguacauguccuuuuaaaaucugggaucaucauauuuuaaagcuuaucugugugcaacaacagugauuuuccugaaauguccuucucuuuucaccccucccccacucccacucccuuuaugcugucagguugauuauuugagcuuauagaagcagaauuucauuuuuagagcaucccauccucguggaauuauggucucuuuuagaaucucuugccauggaaucccuggccaugucuuucccccagcauggagcauuuugcuuucuucaguucagauucugcccugcacccccuuccugagcuacugccaacucuagacaugcuugcuuucucccugcauccccaucauuucccuuucaucaguuuuucuuucuuggucagaauuaaguggccugcaauaguggaaagggaucugagcuaggaaccucaguucccauucuuaugacgacuagcuaugugacaugggaaaauuaccuaacuucucugagccuggcuuuugguuuuugucuuaauuuuaaauaucuaagagggaauccaauuaaauucucuucauauuuuccagcuguagaacaugagugacacugaauucagaguagcagccuccuuuguugcuucuuuuuccuucuaaaagguaaaauguugagcauaacaaguuaagaacugaccaaucuuugcuuuuggaauucuugucaacaaaucagccaacauucaugaucacuuucucuacaugaaguuuauaaaguugaaaacuaugggaccccugccuucaaaauucacaguucagaggagaaaacaaacauuaaauaauaacugugauacgaagagauucuaaauuuggcucugccacuuauuggcuaucauaaguuguucuggguaaauuaccuaaucucucuaucccucaguuuccccagguuaggagcuuagcugccagaggcauguugccaggguugaguucuggcuccucugccaucugugaggcguguaaccuugggaaaguuccuuaaucucugcacuuucauuuccccaucuacaaaauggggacaauaauguuuaaguucuugugaaaauuaagugaguuaauauauguaagauuaucagaggagugccugauauauacuaagcacuuaauaaauguuaguugcuguuauuguaaggauuacaucagugcaugcauguuaagcauagugucugguauccaaguagaaacuggaucuguuuuaguuauuauuaguacuauuucuacaauagagguuuggauagauggcuguuagaaugcagagaaaggagaaauuaauggugagggaggagcuaacagcccucuuguauaugucugaggaaacucaauccagaaaagcucaggagauuuauagcaagugagcaacaaaacuaggauuucaauccaggagauguuacuucugguccagcauuguguuagggucacuaguacaguuagugucccuagaggccggugggugugaauggguacagcaagccugaggucagacaggcccacagccaccccagccucucccuauucaugaacucacugaguguuuagaagcuaggcuuggucaaguacagcagguaguuucccagggcuagaaggcugggcagaaccuggucuugccccgagccaagguuugggccagauuuccaaagccuucuucauguccaccucuuuuuuuuuuuuuuuuuuuuuuuuagacagggucagggucucacucugucucccaggcuggagugcaguggcaugaucucaacucacugcagccuccauccccagggcucaagugauccuccaaucucagccucccaaguagccuggaccacagacacaugcuaccacacccagcuaauuuuuauauuuuugguagagacgggguuucaccauguuggccaggcuggucuugaccuccugagcucaagcaaucugcccaccucggccucccaaagugcugggauuacaggagugagccacugcacccggcccacuuuaugcccaccucuugagcuuggcuugggaacuguggccaggccagacucacugaauguccaguuuaaagaugggaggcaauggggcauaucauccaucucccuggacaagcagugucaccauagcuccuuucccagcccggcccucuggagccccuucccuccucucuccuuuuuccuaucuauuccucccucacucccggaaucccacuuuccccucauccucucuucuucccucccuucuccuaucucccuuaccucucucuucauuccugaacacuccuuccuuuucuauccuccuccacucucccuugugacucccccacccaauccaucaauccucccuccucucccagucuggacagcaccugaccucuggggagccaccccauuccucagcucccaaaccucacucccuguucccaguuggaccuccaccucccugguccugcugugccgccguggggguggggcugggccugcacaggcaggcugcccugaaugacaagcggggauauugaucgcguucugaacucagcccagccgauagaagguaauuaaugacuccauuugccucacuaccgaggagaacaauugaguuugaaacugcaacaacuggcagcugggaagacuggggggcagccugggggugaaccccucagaggcggaaguaauguguggaguagcuaggcagagagagcaccuucugagcagaggccaccaucagaacgggcagagcccccauccccagcacagcuggccccugagccccacugcucccccagcccuugaggcccaaggcccaucacccacugguccccccaccuccacgcuuuucucuuuucuucccauaucacuuuuugaggucauuuucugccugcggaugaagacucaguuuucccaagacugcuucuugccagcugugcaaucuugcacauauuuugaacucucccugagccuguuuccucguuuguaaaauugaacuaacaguaucacuuuugcaagcauucugugaagacuguggauaauguguauaaaguaccuugagccugcccagaacacaguaagugcucaguaaaugaugauggguccuugacagagaaggcaaacaugguagaguggagagagcuucagaguccgacaucccugaguucacauccaggcucugcugcuuccuagcugugcaguguugaacaaauaauuuugccucucuaagacuauuuccuuuucuagaaaaugagaguaguaauaaguaccucguaaaguuugaagagguugaugaguguaggugaaagcccuaauaucauuacuuucuccauagacagauagauguuuguauuugagcuuagaaaacugaaguuaguguaauucuuuuuuuuuuuuuuuuuuuuucugagacagagucucacucugucacccaggcuggcaugaucucaacucacugcaaccuccgccuccuggguucaagcgauucuccugccucaggccucccaaguaacugggauuacaggcgcccaccacuacacccagcuaauuuuuuguauuuuuaguagagaugggguuuuaccauguuggccaggcuggucucgaauucaugaccuugugauucaccugccucaagccucccaaggugcugggauuauaggagugagccaccgcgcccggccaaaguuaguguaauucuuugcuauacuuaaauucuucucaaauaccucaucuugcuuccugggauuugaugggcaaccccguucaucccacccugauuuuguagacuuugaugagccuuggugcuuucugcccaagcaaaugacaucauuucauuuucauuuucuuuauuuuucuuuucuuuucuuucuuuuuuuuuuuuuuuuuuuuuuuugagacagggucucacucuguuguccaggcugaaugcaguggcacuaucuuagcucacugcagccuugaccucccaggcuuaagcaauacucccgccucagccuccugaguagcugagccacaggugcauacaacuaugcccagcuaauuuuuuauuuuuguaaagaugagucucgcuauguugcccaggcuggucucacacuccuggacacaagcaauccuccagccucagccucccaaaguguugggauuacaggcaugagccacuaugccuggcccauuauuucauuuuaucuauuaccaccacccccaacugucucuugucccuugcagugacccuucugucccuagcccuguucccaagacaggguucagggggugucucccuccccaagcugcugagaacccacuggacaacuccauucaugacuggccagugccagggcccugaccuggggugagaggugugagauagggcccagcuccagggccacccaggaauagauggggagugagugcagggcugaaugaaugaggagaugagauauuuugguugaggaguaaagacauuuuuaauagugauuuuagaaguagcacauacuaauugcacaaagccuggaugguauggaaaaacuuagaugaaaagaaaauaaaaauugcuugugauugggaaguaaccacugucaccaugccggcagcucuccuuccagucaaguugaucuuugguuuuggaguucucuucguuugccuggagacuaggguccugcugucaguagccccacacucugggcucuggcugggcaggcagccacucuguccgucuauuuaguccacagcugucagggcaccugcccugugccaggauccccagcaaauguccccuugagccagucacuugcccucgcuucaccugcaccucauuuacucugagccucaguuuccuccccaguaaaaagggauuaaaaucccuaccuaccuuggagagugguugggaagcccauauaaccuaagaucuaugaagaccuuuuguuaaaugcuaagcaaauaggaaacagucagauaagaagacaauaugagcuuuguuauccucgaaagaauaaucuaugucaaaguuuugacucagcaguuuguuuaaucgaauuaauuuauuuacauacuaucuguguuccaaaaagaccuguaguagcucacccccuugagagugcucaugccacaguggacagagcaccuggaauggcccaguccugggagucccauuccccaguugugugaccuuggaaaagucacugcccaccccugcuaguuaugguaacaugaaaaauuuggaccagacauccucuaaucaucugggcacagucugcacucagccagcaccugugccacaggcuguagccuccauuuggggagggugccaggcaaagaacgagggaugccgagaggaaggcugugcccuggauggagccaaguggccuucaacugggcccacuguguuuggcacccaggcugcagagugaaaugauuuagagggcaagcucuguacuccgacagaccuggauucaaaucuggcugucauuuacuagcuucauggccuuugacaagcuacuuaaccucucuuugcuucagcuuccuuaucuuuaaaaugguuaucauaguaguucccucacaggguugucggaaggauuaaaugagcucuguaaauaacagcaauggcauguaaugaguucuugauacuugugagcugcuacagaaugggagcugggcagggggcagacggagaaugaggcugaacccucccucuauggggacugacuagcacacggucccuuccuugcucuguuuggucuuauuaaacccacagccaccauauuuuccagccccaaucuaaaaauguggccagagaauggggaagaauacuggaaaucagaauuccuccugaaagcccaggacacaugaccagcagccuccagcccucuuggugcagggaguucaaauguagauguguucuccaggccccagucuuaagcagccucugccaccugcuuuggauggcagcucagcagccccgggguuaaguucugcugcucaccaggaacacaguguucucugucuauugguagaggcaccagagaugggcaggaugguguugcugagaguggaaaaggccugugcgucagagcugaugcuguuagaggcuaacaagcaguggggauagcacaucuuuugcuagccagggauguguggggcuuaccugaugagagacuggguguccuugggugccaggccagucagauggccagucccaaaaccuucugccagagguauggcuuugaaugccacccgggagagucugaguaccuacucggggccauuccugaugcuggagcugcagaaaugcauuagucacggucccugccacaaggugcucuuugacuggcugcugggccugggggcaaaggggcuguuggauaggggaucuucuuugaaauggauggugucuaaucacucacgcgcucuccuucccugcucacuagauuaagaucugcuuuuacauccuagaaaccuagauuaagaucggcuucugcuuccaccucuguuucagcccagcucugccagacagcccuucaacagcugggccuaacaguggucucuuucuuccuccuugccgucccgucugagacuuugcccuuggaaagucccaugccgagcucgcuccccaucuucccgggagaacccucuagguggucagcacugacagcugucuuccuucuuuccuuuuugacucuuccuccuuuacucucuucuucuuuuccuccuccucuccuuccccugcaaagccacccucauccaggcccugggcagagaagguaucaggacacccagucuucagcgaaaguagagccagcugguuuuauuccugcaguaaguguccucaccccagccagcacuuccagcuucuggugcggaaggcuucuucccuuucuuccccuccuucuuucugcccuuccacgccucugggcuuccuccuucccugagcuuauccuccuuggaccuucugauccagggcuucucccaaccuccuuuccucauucccuuccugcccucucuccuugccuucauuccucccuuccuucccuagcugauggaaggaugccacccccuccucuggaaagagcccuugagagccuaugguacgugugguguauuuggagggcuggcuggcugucccccaccaguaaugccacugcccucuccugggcccugcggcucaccucccugcaccccauaaguuucuuugugcuccuucgccauucaucaugacugcugccuuccuucuccuacaggaguucccgcaagccuccuccagccucucugggggguggggguucuccgcaugcuuucaucacaccacuuuguuuuccuucuccucuaacgccuccuuucuccuccccacuucccucuccucugcuuccccgccucccacugccaccucuuccaguagcaggcuuccuuagccuuugccuccuuucccucccccuuccccuccuuugcugccucuguaaccugucuuaccaccagggccugaguauacaaaaaaauaaauaaauaaauaaaaaggucagugaguggagggagcagcaauaaccccuaaaacaguacuaucaguggaacaugauugaucaauugaauuccauagcggcugaaaaaugugggauuaaguaguguauuauacgcacaaugaguugaggcaugauguucauuucaaguucauuucgccggccucugccaccagaucaggcaaucaauaggggcagcagauaucauauaucaccucucugcgggccggggagagagcaccauaaucucucgcaaauuuagagugacagauuugucaagaucugaagggccccugaauaaaugaaggcaaagagacuccuccagccagugaccugaggacaaagcuucaguucagccccuacacacacacacacacacacacacagacacagugagccaagccacacacagacaggcauauacacaaaucuacacagaggcaugaggagaguccugccacacaugcacacacauaaugugugaacacacgcucacaaauacacccucucugccccuacaauaaccauauaugaagauauuugaugcuuuccucagcccugagaguccggcuuccccaaaagguaggagggcuccaggaagggagaaucaaacacaauaggacacgcaaauagcuacagggagugaaaugaggaugauggcacauccugaaaaaagaaguaggcacaggagaaacggggcauguggccucacaguccucaugcaaucacacacagacacacacauucuuucaggaagcuucucauucuauuuccacacacgcagacccuuguuuaucuggacguuuauauauguacaagcgcguagacacgcaauacucacacaaaagggaaaaauaaauuuaccacacuucaacuuucaacucauauguugaugcauacaucccguaagacugaaaugauuccagagccuuaugcagaagaaaccacaaccaccaaguuuuguguucaugggaacaaauaccauugaagcugcuucugucugucuucuucagaugugguccuggucuugaucucugucucucucucccucucuuucucucucuccuucucucucucucucucucuccuucucucucucucucucucucacauacacacacacacacacacacacacacacacacacacacacacacacacacacuuucuuugcuuucccacccccuccagaauagauauggagggaagaugggaggucacauuaggaaagcaaaccccaugcucggucugggaggccagcaagggaggauggcugcagguugaguuaaucaauauguaauauuuucuauggucuccugaaugauacuguaugguguuacuguauauaaugcaauauugauuauaucauaucguauaaucaccuauaaacugauauauauaacauucccagaggaacacccuggggccuccggcaugggcuggccccaggcccaaggcuccucagcuggucuugggcugagggaagccuggagugaccaagcugguaugggguuugggggggaaaccccacuuuggggggcugcaagguguggguucagagagaggccacagagcaggcacauugccuacuguacaccuugaaaacuccaaggaaccgacgcugggaggcaaggauaggggagggcugagaacgccugaggaaaggggacauggagacaggauuggccuguagacucaggggagcaggcaccggugugauaagacucugcucccucuggagacuugcaggaggaaccaggugaccaagaaacuggcuccuguaggaggcuugagccugggucuagguuggagacagaggccgagaaggcggccagggcauagaggcauccacaggggcccuucugugggcucugcccaagcgggagcuuugcugcucuagcgacaccucuuuccucccgcuugguuucccucuggccucaguccuggcccaacccaagcagagugccucagcucugccucagagccccuccucccucagggcgaaguugauuacuucacccagucuccagguuacacucggccucggaaauuugaugguuuucaacccuuggaauuaguggaacugaaauucaucucggagccgaguucaauucuccacaggcucaguaaugccagucugagacacccagcuucuuucuuccccaggcuggcccuggcuugggggcagggggugguucagggagacaugccccagggagcuggcuccugggagcccccuggcuccaccucugccuaauccuuccugaccccacagugugaccgcuccaucucuuaccagguccucagguccuucucuuccuugggcuuccucagccagaucucugaggcagggccacccucuggugucagccccacuggcccaggggcugagaguaaggggucccauaggggugcagagcuccugggcccggaaccagaugcccaccucuuugcccugcacuguuccugugccucugcuggccuggcgcuaacgccccgaguguccauguguucuccagaugugucugagggcucaguccccaauggagauucccagagugguguggacaguuugcggaagcacuugcgagcugacaccuucacccagcagcagcuggaagcuuuggaucgggucuuugagcguccuuccuacccugacgucuuccaggcaucagagcacaucaaaucagaacaggugaggagggagcuuucugcuugcagaaguagaaaggagccggcagagcaaggccucucaaaaacuuguucacuaaacaccacaugcauagccagcauuguauguguuacacacguguguucugugugugugcagugugaacaggcucacaugagacaguaugguaucguuaagacaaaucauuauggucuguauaugguaauuagaaaugaguucugggugcaagaguauggccuuggguaaaucaucucuguucagagccucgguuuccccaucuauagaaugaagggcuuggauguaggguuugucaagucccuucuagcuccgcuuuucugugguucuugcauggaguacucaggaacauccucuugcugugucccuugcccacacccccucaggguccuacagaaagucuacgcuagacuggggagcucuccuugcccagugucaggagagccugccugugccugccuccugcuccccaagccagcaauucaauggaacccuagguaggcuggcagcuucccacuuacacccaacacuuucugcagacacugagcagcccaggacacauagcauggggcacagcauguaacacaccagcaaaacgcacaacgcagaaaccaucuccgaacuuuucuaugugcuggugugcaugugcucacacuccaccauccaccugcuccccucacccacagcccaugguacugugcucacacaccacuguccaccugcucccccacccacagcccacgguacugugcucacacaccaccgcccaccugcucccucacccacagcccacgguacugugcucacacaccaccgcccaccuguucccucacccacagcccacgguacugugcucacacaccacuguccaccugcucccccgaccacagcccacgguacugugcucacacaccaccgcccaccugcucccucacccacagcccacgguacucacagcuagccccggcagccgcauggagccagugggugugugcugcccccagaucaccagcucagcauaccccuagcauaugccuccacccacauacgcuggguggagcccccagcacacccgcucccacacaggggcacacucccaucccugcuacacaugcagcccaggccaggcccacagucacagcacaagacagcauugcugugcuugcaugcaugcacacacgcacccacacaugcacgucagugcagccccacagcguugaacgcuguaguuccacucuuaagacuccaacagcucccagccacucgccuuucuccccgcccguccuuuuaucccauaagcuguuugucuucauaaaacaaaaaucaaaagucuuuuuaaggugcccugagccauaaaccaacaaaggaggagcuggccgaggcgggcggcucagugcacccucccugaguccccgccuguauuacaaugaauaaccuuuauuuacuuucauuagacuauuaaacaccagcacagucauuuuucccccugaaacucggagcagggcccauaaagcaaauccgaagccuaauugaguucauuuuaauuucucuccgaucacagcgaauuacucuggugauaaaucagggggcagcuucacccccaguagaaggccuaauuugcagcuaauuacaaaacugauuucuacaggaagaucaauacgagaaggaauuggaaaugacgaggcaaucccguccagccauggaggggaggggguacucuaggggggccaggaagcggaagggaaaaaaacagacccgaaagagcaggaaaucaguuuuaauuuaacguaauauuaaucagagcaacuuuuccugcuuugugcaggcucccggucugcccagcucuggggucuggcuuggccguggcugcaauaaaaaggcaauuacccgaguguuucaggcaggacacccuuucagagucaaugacuggcccccuccuacccuucuguuagccauguggacucucccccuccccaauuucauaccccagugcacaggcagacagcgaggggcccauggggcugucauuguuuguuuuuaaaaaaggggcgcccauacccgaucagccagcagugccaggcugaaggccccacuaggcccuucucccagcuacuggcucugccagucaugucaugguucccccuccuccccaaggcuccucgacaucccaugccucucaacaaggguauccccacuacuacacccuacccgcaggggugcuuaggcaggagaugcuacagaaacauaaagggugcuggcauuaagugcccaaaauguguaaagggugcugugccuccgguuucaccaagucaggucuacuacccgcacaaaacuugccaucauccaccaagcccccgcaucuccccucugccccaccaucucuuucuaccccaucugggcgggcuccccuguuccuccuccccaucugcacaccgagcccuuucucugugcgugcaucaauagagagcugucacuuuucucucuccucccaggggaacgaguacucccucccagcccugaccccugggcuugaugaagucaagucgagucuaucugcauccaccaacccugagcugggcagcaacgugucaggcacacagacauacccaguugugacugguaagggggcuuccaggagggugggggcacugcguucaguggagggugccucagcccaugccaucugaggcccagugugaggagcaggucccccaccgugauauuuacagagagaacgaggcuucuaaaaccagggugcuuccugaacaggggugugcagauguggggagaaaaaaacuggggucagggcaucugugggcuucaaccuggaaaggcugaugcuaggaggggcuguugccaguucuuccuccuguccuucgccucucccuuugucuauuucucuucccucucccaaguugcccagaaucaugagccucuuguuaggaugucugcagaaagcaaauaagccaggcuggugagaguggagcauggguacccaguguccagccuccacacuugggucuccaaggcuccugggggacccgcuuaccgcucccuccaggcagcaugggugaucauggcuuugggcuugagggcauggcacccagcucuguggaguuugagaugaguacaauuauuccagccuuccuccugcuucccagagaggucagugacaccaaggcuugauuucaaggccagguaggaucaggcuuggcccacaaucaaaugcagagcuaggggcgccauggccaggagccccuacaaaugaagagcagcagggccaguuaguuuggaaggggagguggaguccagggaaggccgcagagcuccaggcuguggaaugcacgugccacugcagaaggguuuccaggccaggagacugcccaaaugggagagacacgcauugagguguuauuaaaauucaccuaauuauucuggagacacuaaagccaaugugccguuuguuccuugggagacaggaugauugagaagggucucgguggggauugggagacacugaggcguuaccugcagagcgaggcaagcggagguggccugcggacccagcagcagggcugcagagccagcggcaaaggcagggaacaggcaccgcccacucuaggacugggcccugguucugccugugagcuggucugagugcggcugcauuugagccugagcugggcucaguggccacccagccuccaccugggggcuuaggagagcccugucaguuuucccagccucucccuaaggggcuguacugguacaacuguuuccagccuagaucuuuggcuagggagucagagguugaauucuagaaguguuggagaccuggacugggcuuucgggagugacgaccuuagcuggguuagcugggccaggacacagcccaugaccaaauggcccucagcaugagccauccuucgcccagcugggaagcucucugaccugcuagguauucugacccaaggcagagagacggcccaggccaggccaccuuucuccugaccugcucagaaguacaguggucacuucccaaagauggccacuccaggcacuguucaaagagaacccgggagacuucucuaaccccaucugcugcccagcgcucaggccauagucuagaaggcaagggcuuccuaggguggagcuauggaucuucaggguagggcuccugccacaggagacccaggggcugguacagagaagugccuccaccuugagcagcccccacccgccucccccccauggcccuggaacagucccagcucagccugggaacaucuccggcugauccaucuggauccaagugugagaaaaguucauuucagacccagcuugacauucccagguggcaaguuagcacuaacaucucaaucuguaugcgacauuucaaucaagcgaggaguaacaaaagcagaaccauuaacauucggagcuguucaccagugguaaugacggggaaacucgcucagaaacuggaaauuaccaaaaagagacaaguguguggagaggugggggagggaagauggggauagggguagggaaugauuuuuccacacuuaggccaagauccacuguuuggauuaauagugccauuacccaagaaagagcugcagauuaugcucauucuuaaaauguuuuugcuggcaauuaaacugcugcaguuauugaucuuuguugauuuuauguccuccuaauuugcauaaucuauuaaagaugaaugauuuaugauguguuuauuauggggacaaacagaauuugcuagagguacugucaaggugagccauggggcauugcucagagacuccauaugccaucucagcaguggguccagcauguuggccuucaggccaggauauuguggguaguagugagcagugaugcaaggagaacagaaacaggagaguggacuuugggugaguucuucuagaaagauacuggcaucugugagaacugggcuccaggcagagcuggagugcgggagaggcccuuaguguauuuguggacacugaccucaaagagucuuuaaaagcuuauuuucuuggcaaauauuaagggcuuuggugggagaagagaaaaggaggcucuuuuagguggguaggugauucuggggaggugugugcuaaagguaagggagcuguuaggucacccagugcccauagccuggcuuaggagugccgagguguucaaggagcccucuuuauccuccacgucucaggcacccugcucaucuucuuccccaggacugacagcugcggcugcaaaccuuaggggaugagggaaugcccuagcccaaccugaaaagccagaccuuauugagauuccugccaccuccuggcccuggaggcugauuucaaacuucaccagccacuugaugcagcuauuccacaaggucaggacugagaggagagaggaaccuagacuauuguguggaggggagaguggggcccagugggccaggacacagcuaaucacauugcaagcaaggguggcugccggaggcuagggcucagccccauagccuccccuccccaccuuccaucagggaaccgaggagagagacugauuuugcuggguaguguuugcaaguucugccgagauuuuaauuucacugcaucacaacucagcaagcugccaagucaagcugguuauuuaaauuuaucacccacuuucccuuccgccgcugggcugcucuagcucagcggcaucucuucucuccagcccacggcucuaggcugcuggucuggaacggagccucgucucuccuaagugauaaagaaagagggaccagcuacaugagagaaugggucacgggcauucuggccccaggcuuuuucagguuggcuggcuguggcugguaccucucaucaccuucuugacccuccaaaggagcccagaggggcugccauccaccucucaguagucccagggcccuccgggucagggcaucugcagugaggacucgcuccaacugcaugcaggaggcuucauuccuuaaagucucccaucccuggaagaaaagauagucccuguucuccauagcauucucaccuugacccccccuccccaugucuggccggggcuccagugacaaaggagcaugcagagacacuggcagugauguugaucugggaggagaagaugagaacuuacuccaggauucccaaagucacuggggauguuucugagcauuagagagucccuugacacagugcaaguccaccccgaaggagagagcccagaugcaaggaacagugcuggagaagucagagacugugcaguuccaugcucucuagaaaaggguuggccaaucuuuuggcuucccugggccacuuuggaaggagaagaaauuacuuaagucacacauaaaauacacuaacacuaagauagcugaugagcuaaaaacaaaaacaaaaauaaaauaccucauaauguuugaugaaaguuuacgaauuugcacuggaccacauucaaagcuguccugagcagcacguggccugugggcuguggauuggacaggcucgcucuagaagcuagggaaagcaccagucccuggagccacugcacccacaggcuucacuggccucuagugggcauugcugccgcgcacuggcagagccuugagcaagugcagcucucaccgcccuuguuuuagucacagagagguaaaggaggaaugagauugaugucugggacccaggcaggcuaccucaccaaaacauaacugaauaaaauauaacaacaaaaauguuaauacgcagcaaaucucacucuuuggugccagaaauagaggggaacucaaagccagaucaguauuggagaggccgcuggcaucacacuggagggagaugcugacugggagaggaugggguuguaacacaccagucagggaaugugacuuugggaaucaggaagccagaacugaguaucauccugcauaaagcaaggaacagaacagggaccacacuguccgugaaaggcaaacacauacacucgucugaguagcccagggaaacaaggaagggggcagaauggaaggucaccaugagacauggagacgccaagccugaugccagaucagaguccaaauuuauaccaugaguauguugcaggaaacccaagccaggaacuuacauaaaaauuuguacaggauaguaacccauucugaaaccucaccaggagcaaugacaaaccuucuuuguagagacauucuaaaauccagggcacaugggacucccacagggggaagaaaaaaccccaccacuaaugaugagcuuacuguaaaaaaaaguacacaucucaugugaauacaaacuuucaaaagggaaaguuaguagaagcaauaaacagaacaguuaacauccccccaagaccugggaacaauagaauaauccaaaagugcuauaaacucagcauguuuaauauucuaaaaaagaucaaaggggccgggcgcgguggcucacgccuguaaucccagcacuuugggaggccgaggcaggcggaucacgaggucaggagaucaagaccauccuggcuaacauggugaaaccccgucuccacuaaaaaaauauacaaaaaauuagccgggcgugguggcaggcgccuguagucccagcuacuucggaggcugaggcaggaauaucacuugaacccagaaggcagagcuugcagugagcugagaucgugccacugcacucuagccugggcgacacagcgagacuccaucucaaaaaaaaaaaaaaaaaaaaaaagaucaaaggaaguaucagcuguaucuuuaccacagauccagaucccccagucccuucccaccacugcucaccaaauugucagauaauggagaucaaaaagggcaaagaaugaggaccauaccuauagauuauugcuuugggguccaggaggcauggaaagagcugagccucaggcaacucugaaaguagagccuguuccaggcuuguccaggcucccagacugcuaagccucagcagaaaaucuuauauuuucuuugagaaaaugucugaacauuagagagcuagagaugggcacaguaccuuucuccccaguggggugggggcaggugggaagccuccguagcuuccccauccugguugggggaaggugguuuuauucaagagcuugggagaaaugucucuuaauugcugaagacugcaguuuugaaggaagcuguaauuaagauccaggaagagauguggaugcugcccaagagggaagugcccaaggcaggaagagggagcagaagaggcuggucucccagaagcuggcugauuugagcagagguaggggaggccagagaggcaaaguucacagcuggacagcagcagggaccagugugagcaguguggauguagcuucugaaaaggguugccaacucagaagcucggccuccuggcccacaucugagauggucagcaaaguggccuuuuagcagauagagguguggacccugggaaaccuccuccuccuacucagggcauccugaggaccuccaggaacugccucuuuccuguaguuaacaacccccuuccaaugcaacugcauuucccuccauaaaacaaacagcuuagcccuuggccagcccccgggggaggagagggcaauaaagacugagaaauguuucucaaggaggcugggagucuccuagucuugucugucagcucaaagccccugauuagcuagaggaauuuagggcacagacaucauaguuccucuccuugaaaggagagggcuaagacaacuucagacguguggcaagucagagaucccuuuacuguggaggccaaagcaagccagagggcuguuccucagugcucacaugcccuagacccuuccuuuaggcugugagggucccaagaaaagaggcuagccuccuucaaacaucccugagucugcuggccacauccccaaggaccuccagcccccaaccucagcucugauuuaauuaugggggcauuuccauagcaaugagacauugacagauaugcggcugcucucggccugcagccuagggagucauuggaucaggccucuuucccuuccuccuuuauccaguccacugauagagguaaaggauauggaaaagaagaggcccuaauccacugucgggaucagagucaggccauauuugaccagaauaaaagcugugccaccucaaucucaggucccaaucccauguccuugucugugccuaccggccacccugugcugcugggcugcccuucccaggagggugccauggcagaaguacccuggcugagaauggggcugcagagggaggagcaucguagggagggugacaaagguaggaaggguuuggggugucuuagcaaagacguaguucugguguuuucuacgcugagcucaaauuuggcccuuaaccuugggccuuucuucuuaccuccucccuucaucucuucccucuguccgugaggcccaaaaaccugaacaugccaaauggagugcuuauuccuccaaggauggccucacuuguucaucagagaucagagagagagagaaaggggccagucugaauuugaaucaaaauauuuucuaagaaaucaaugaucuugcuaucaagugcauaacaauagccaacucaggccaauaaaggauugcccaguugagaauacuggccacugcuuucaugauucgucagguuacgggacccuuuugguuucuguagaugucauuuagauacuugaugugucccacaggggaauucuccaaaaaagagaucucccagcacuaagcuuuuuaguccguuauuugguacuuuuuaagaagaaaauguuggcuaaguaaaaguaaggucagucaacccaacauuuuuugaaugaccggaaauccuaaagacugcugucccaaugaaacagguauguauugguaccaagggcucagaaaugucucaguggccucaaagccaccuaggcaagaccugaaaaccuguuucccccagagggccggccaccuccaaggugacaggaagaccccccacuuuuuucccaggguagccagaaucccuuccaccuccacaauuagcuguagccucaggacaaacaagcuagugcuuuugcaacccugagcuuugggagacaagcuccgccacuauugucacuucugagagggcuuugcaugccuucagccugaauccuccccucuucuccccaguggugguggcggcugggcuggcaggcagggaaggaggaaauccugcagggcucggagaacagccuaaugcugcagaggcuuaaguggccguuuuccuugggauuaggguuucacuuacacagagcgccugaaaaacacugcgcuuuuggaaggauuagagcugacaauucagugcucucagagaacaaaauaaagccagagaggaacugggaggccuggaguaucagaagacucugcaaacaggcuuaaccucugcccacccagcaugagggucucucaugcucugagcccaucuuugagccugggcccaaccucuugagugccaguaccugcccaacuccaaucuucauuugugauuugcucauggagccagagaaggcaacacagggacguugccuucuggaaagaggacugggaaguugccaacugggaagaggacuggaaaugucuuccccucucucugagccucaguuuccuccuccguaaaacaagggaguuggacuagaagauauccaaguuccuucucagcccuuugaaaaugugauucuccccaacauucccugguguuauccuaggaugcugaagcugcauuuccauccaugguccagcugaauuagaaggaaaccaccuccugugaggcccugagccaacaggcuacacagcccagaggagggcggggugcugggagaagggauggaaacagcaugacugguuguguccggccgguuggcugucaagguguagaccucacuaagccccugcagaucuggguaacaucccugccuaggacacaccagggauucaagguggcagugggagcugagaucaacuggaagagcagccacccugaguuggaggcacagcccccucugcuggaaccuggagcaggcaagccucaggugggguauggggcugaggccagagccuggggcugugggcugucccauagucccuucugcccuagaggacaacucaaauccugggaggauuuggaagcuugggaaauaagaaaugaaaggaaauauguagauaguuauuuuccucuccuuuuaaaacaucuuguguggauuuaaaguuuguuacuuuaguguaauagauauacguugaauuggucauaaggugcucguaauuguuauaguaaauaccaauuaugcauuuauauauuuaggcagcaauuacaaauuuaauaacuguguauuuuuguaaguauuauaaaugccuaugucaaaugcaggcauagacugccagccuugaagaaaucuaaugucuucauuuucgcuaccuuaugagaagcagacagaacuugaggauagggcaguaaaacaagaguuauguuuucuggccuuaggguccuccgcagugucaaguggguagcaaaagugcucauuuucagagaaagaugcugaggaaaagcaucucugaacuccucgauagaacuuuugcuauauaaaucuaugucuaauaagucucaucugagccaucaugagcagcaguuucugcuucuuucguggcuuccuuuuuauuuccuugaucuucugaaugcugacauuuuccuugacuugagaugcaacucccugcuacuucacauguuauuuugcugugcuuuguaucauccuguuuauugauacaauucaaguaguugcaaacaaaucagugucuuaugccaaagaacggggcucuuucacuuuuuuauaaacagugcuuauuaaucuuuaagccauauuuuuugagaauaugauaaaagucauguaccaucuacacagaaagauacagauauacaauguccauaacauuuuauguauagauuuauauagaccccuugaagugaucuauggguucuugagggaucaguuaaccccaauuuaaaacccccacuguaaaaaaguggaagaaacugaaacacauaagaaacaagaagugacaagauguucuguuauaggaaggauucacuuagcaugaucccauauuacuuuccuggaccaaacaccuaucuauuuucugggucugcacuauuugagaacaauaucauuccaggaucauuucccaaguauacagccuguucuguaauccaguuucugccaucuacuagcagugaaaucucagacguaauauuuggccccucugaguuuauuucucaucuauagaauggggauuaaaggccgggcgucguggcucacccuguuaucccagcacuuugggaggccgagguggguggaucaccucaggucaggaguucgagaccagccuggucaacauggcaaaacccugucucuacuaaaaaauacaaaaguuagcugggugcaguggcaggcgcuuguaaucccagcuacucgugaggcugaggcaggagaaucacuugaaccugggaggcagagguugcagugaguggagauugcaccacugcacuccagccugggagacagagcaagacucugucucaaaaaaaaaaaaggggggggaguuuaaaaacauaucaauggcuggucccaguggcucacgccuguaaucccagcacuuugggaggcuaagacaggcagagcaccugaggucaggaguuggagaccagccuggccaacauagugaaaccccgucucuacuaaaaaauauaaaaauuagccaggcauggugacaggugccuguaaucccugcuacuugggaggcugaggcaagauaaucacuugaacccaggaagcagagguugcagugagccgagaucgugccacugcucuccagccugggugacgagagcgagacuccgucuuaauaaaaauaaaaauaaaaauaaaaacaucaacaucauaggguugauaugaagauuaaaugagauaauacaucauauaaaauguuaaggacaccgcccagcauauagaaggugcucaaugaaugcuagguaguccuggcccaaguagaaacacagcucugaccuugaaucuuagaccugauggugaaaguagcacaaauuaccugaugacuacaauuuuucaacuuucuuaauaaagucuuucacuuugcuuuucucuguacuuguaaggggagcugcacuuagauucuccaaagcaguugauuugaucuggcccauuugguaaggaaugucugacgaaagugcacugucugaugcaguuguagugauugcuguagaaauuggcuuuagaaucuucagggacuucugcaguugaacugagaagacauccucaucaaguacagugcuuugaacacuucuggggacuuuaagauucuccacuaccacuguuucuugaagacccucuuuguuuuucagaaaacucucacaggagauuaauacuccaccccauggaguuuuauuauagacuuuuggcaucgggauuuuauucucugaguccuuuuuauccacagccaugacgauaugagacuuuguuugucagaugacuucuuuuccuuuucuuuggcucuuuuggggaguaucuggcuucguguuauuaaaaggcagugugguauaaacauggcuucaaauuuuggcuguaucauuuacuagcuguguagucaugggaaaacugugaugcaucuuugugccuucauugucucacccuugaaacaaggaaguuaccucaucaucuggaaggcuauucaucuuuaaaaacuuuguaaccuuggccaggcgcgguggcuuaugccuguaaucccagcacuuuuggaggccaaggcaggcagaucacuugaggucaggaguuugagaccagccuggccaacauggugaaacccugucucuacuaaaaauacaaaaauuagacgggcaugguggcacacaacuauagucccagcuacaggcuaaggcaugagaaucacuugaacccaggaggcggagguugcagugagccgagaucgcaccacugcauuccagccugggcgauagagcgagacuucaucucaaaaaacgaaaaacaaaaaacaacuuuguaaccuuggaaagcaaguguccaacaugaaaugcccaucuucuuguaauaauaugugggguuuuguccauuuguaauuucugaugcuguuuuuauguuacuggccauugucauugagcaacaaaaauccucuacugcuuucuguuggguggcacauauuuuauaacugauguauucugccacauaacuguuuucuccuuuuucugugcuuuugcuuguuuguauaaaggaggugcugugcuguuguacaguuuuagagucugucugcacucauguuuuuccauccaucuauaguacagcaaggcccagugcucugucgauucuugcuugcacagauuccauuacccauucauauucuuucacuaaaagaggcuugcucaaagaaugcugcugggcaaaugguaugacagucuuaguaauuugaaaacuuccugcaguauguguuuuccauuauugacaaugguguuccagaagaauauauggcaagaguuuggucaauuuuuucugcucuuuaagugucaccugugugcuaaugaagcaauugagagugcuuuguaugcaguggccagcaccuuugcuggcucagggguccugaacaggguacuccuuuguggagauacugguguuauagacuccgcagcagcaggugcacagcuguaugcagaacacgaggaagcuugcgugcuuuuuccuugucuugggacucuucuuucacguuuuaaaaauuucuacauggcacugcccaacuucaguuuucuaaauagaauuuggcaaugugccuuucaaucagcuguucagugggugacuuucagcaugcaaaaguuccuaccugagggaaguugccauuuugcaagacagaaaggcaguagaaauaaaacuuuccaauaggacugcauccagguuagcuggaaacaucuuucuaguuauccagccugucuuccuuccuccugaagugagguaggagauuccgugacaaaaccuuagauuauaaggaauucauggugacagauugugggaaucauaaaacugaaaaccagaauucagaugcauuuaaauuccuguuuauuaagaaagaggcacaccccuuuuccugcugcuuugcagacuuuaugaugacagggaaggaggaauuagguuucuauaucuguucagcuucaaaacuucugcgucuucccuaacucgauccuguccugggccuuucucuuuuuuuugaccaauaaaugccauauuauuaaucucucuaggaauugauuuugauauugcugucauugucuacuucagguccacuccacugagagacagucaggaggaguguagcuuucaaugacaacagaagucaauaaaagaaaacccacaucaaagcaaacacaaauccuuuauucugucucucuaggagucaaaagugaucucuuguuuggcaguucuacucugcuuguucucgaguuuuaggaaaugaaagauauuggcuauauuagacagguauagaggaaagucauucuauugcauaauaaagucacaauauaugagucccucacuguaaaccucuuaucagccuauaaaaaaucauaaucuauuguuuaaauuguuuuuuaaagaaaaagcauauucuaauauuuacauuuuauccaagccuuuacuucuuuaaugagaccaauauacaugaaacaauaaaaaaaaugauaacccaucaggaauuggcuguuaagugcaauagauugauggacgauuaaucaacaaguguuuauugagcaucuaccacguucucaacuaugcaggauaaagcagaagacaggguccugcccucagguugcuuaugaucuguuugaagaagcaagcuaugauaugaaacaucagggcucauauauuaugaaauauaauggcaugguaaaccaugcagcacagaugcuguagaaguuuggaagagagaaacuucccugauggguagaaugguagggauuuuaaggcuucaguggggaaggagaggaaaaccguaaggaagaagaaaaggucauggcaaaagcauaggggguucacaucacacaagccaugaaaacagucaaacuaaaccaggagaggugauaaucuuaaguuggauggagagaguaccuuagcagcuuuaaaagccacagaguuucauuucaaacuauagacuacagggaaucaguaauaguuuuuacaagggaaguggugugaugaaagcaaaguuucaugaggacuagccaagcagccacauuuaggacagacaggaggggaagaauguggagucagggaaugcaagcaaaaauauucuguggcaaaaagaaggugcuuagaagcugagcuaggaagguaguggaagaaauggaaauugagcagauguaacagacauugccaaggagaauugacaauacuuggugacugacuucaucuagaaugggaggaagaaggcuaugucaagaaggacuccaaaguuuuuggucuuaugauauucaagaucauaagaaccgacagagggaagaugaaucuguuuuuauuccaguuagguuugagguaacagagggacagccaaggaaaauguucagcaggguacuagaaaugcaaaaaccugagcuguagcucuguauagcuagggaaggauaaaucacucagacgugucaagguagggaugaggaaacucauacagcucuggaaugcagggaggugaggccaucuucaaagggagaguagcaaagagagagagagaugcuuuggaauagccauugggagaauaaugacuauggcccagcugaugaaaagaaagugaacgggcccagguaugcauaguucuguuacuuucuccagccaugccuugccuucccaaggauagacagaggcauuagaguaauagaguggcauuggcuagugaggagaauaaggggaaucuggagggguuaaggggguuccaggagguccaggagaggauaaagagauuauggcagaggggagaaagcaaauuauuauuagagaucagagcaugcuaaauugcaaagggaggugguggccccuucauagccauggaggaugcaggcaagguagggagcccagucaugugcagcugugucccagaggacaugucgguggaccagggguagcacccucaucuugacucgcuuugucucccacccuccaggcuuuagcugauagagcccuccagggacagaaguccagcagcuggugggggagcagauuuugcucauuggaacuuuaucugguccacuugcacuuuuggcucaaagcuccugauucacuucagggugguuuucuaucauguaaaugccauaaacacuaacagcaaaauagcccacuggcugccccccugcucuccacaccugccaggaccaggaccugcagcuccacuuggagaggacaaggaauagccaucagucccuguaggggugauggugggguguccuccaagccugaaggaaagaugggguguuagggagaggaaagauaagcaagaugauagagguccauuuggcugcuggagagaccacagcugaauaucuugcugagaaggaggaguaaaaccaggucaucucccucccaucuccaucuggguuuggaaugcacagagacacaggcaaaggcagauacacacacacacacacacacacacacacacacacacacacacaaauacacagagacacaaagagcuacacaaaacagagaugcguacacacagcugaucauagacauuuagcuuagacacaugcaaaggcacacucagauggcgcauucaggugcacaguggcacacauaccccugcacgucugcacagagcucuuuccucuccaagaguuuccucuccgugcaguacccuggugugaguagaggcaggccccuuucuuccaggccucaccccuuccccuuuguguuuuuccaggucgugacauggcgagcaccacucugccugguuaccccccucacgugccccccacuggccagggaagcuaccccaccuccacccuggcaggaauggugccugguaggugacaaugcugcagcugccuaaucuagguggggggaacuaaauugugggugagcugcugaauggucuguagucugaggcugggguggggggagacacaacguccccucccugcaaaccacugcuauucugucccucucucuccuuagaggcugcaguuggucccucauccucccucaugagcaagccggggaggaagcuugcagaagugcccccuugugugcaacccacuguaugucauggccccuccacagcgcccacccacccaagucugugcccgaggagcacucagccucagcuccacccucagugcccagcccaccccagccagcugacacugcuuggaagagccugcccugguuuccauggaaacuuggagccaagaaccauuuccaggggcaugucagucacucagacaaagccacccugguccacaccaagacacaagggaagaccaauguugagaaccaaccccaaccccaacccagagacaguagggagcuagucccuaagaggaauggaggucaggcugcggcgggaagcagggagagucgcugcagugagacaggcuagaacaccccuauaccucuucagaggcacccagccuuccauugcuucccuggggcucugacccaucccuaaucagaggaguuggguuuggguuguuugaaucagagagacagaggcuguauuuaaggucuggugacugcagcuggagguuguacuauaccuaaccccuaaccccagauugggagcagggucuugaagccaaagagaguugaaguuccuaugugcacaaacaccaaaacacucuugucuuaaggaggguuagacucacucagccagcaacucacucccucuggccgcccucuauguggccuuucccugaaguucaacucucauugguauggggaauggggaggauagaagagagugguuggccccauccauccagggacauuuagguauaacccuggguaagcagagcuugggguaggggcagcggcaaagagggagauugcugcugggucuuauggacuaggggcugaagggaguuagagguguggguaaagggauuccugcccagauuuaggggaaggaaaguagaagccuuguugggaggcaaggagauuuuagggagaaacucccagcagugagcaggugggggcuggaggagguuuuaaagagguggggugagggaagaguggggaggugggggcagggagucugcagggagguggggaagaggggagccgcagagagcucguggugucgaggggggagucguuaaacagaaucuagugcugaugaggaaauuacacuuguuucauuagcgauggggaaggagauagcucaguuccucuuggucacaguugagcucagaagcucauuauccugcugcacgcaugcuuucccuccucgucaauaaacaggcuuuccaguggcugcaucccccacccccaccccagcucccucucagagaggggccccuucuccucuacuuaacccgcgguuagggaucacuguaaacagucuggggucaucacacaggagaaagggcgagggggaaaccuggaggccuggccuuucucccgcagagggagggagguagcuuccgacgacggcucccaacccacgggcccuccgcucaccgcuagcggaccagcgggcaguccaccugcgccgccuccauccccugccgcguagcccacgcauccaaccucuugagggaaaggcgggagggcggugucucccaaaagagcucccaccucuuguguuggcacugcacauugaugccauucuuaggacuuucugggagaaaaaugucccgaaggccuuucuucgccaccgccccccacucccauuuccacccauuaggggccaugccuccuagaaccggaguggcaucuauaaaggcccuggcccccagcgcgacaggguggacgcgccccaauacaaacccuucguggguggccgcgagcgccuccgcugggaagcccugggcgggcaccggcccacaggucccgcccgugggugugcgagcgcgucggugccucccgccuccccgggcucucuccacgcggacgcggugaucgccccaccuccgcccggcccgcccgccacggccauuacccugcccgcgacaccugcgccugagacccggcgggaggagcgggcggagaagccaccggccggacucgugggguccgcccuggcuugcaggcgucugauccccacuccccgacccucccgcagggagcgaguucuccggcaacccguacagccacccccaguacacggccuacaacgaggcuuggagauucagcaaccccgccuuacuaagugaguacgccaccuggcuggccggcggcucagcgcggccgcgcggcuucugggcacggucccacucccggcgacccgaccucuggggacccggccgggccagggggacaggcuuguuagugcagcacugaggcccggggaccccucgaggacgcccgcaccuccugcccucccgugcccucccuggucgcucgaaggcucugcgccgcccucgcccucggauccccuggagggugcgcagccgggcgucaccagaucgggucccucucaugccccgugaacgcaacuauucuccggggcaacuggcuccacugcccagccaaggucucccaguccggaucccgcuggaccccagccaggggaggucuuuucugugcuuuucuuuccuuuuuuguucuccuguuuguccucucacccagcccauucuucuccuguguuaacuuccagguuccccuuauuauuauagugccgccccccggggcuccgccccugccgcugcugccgcugccuaugaccgccacuaguuaccgcggggaccacaucaagcuucaggccgacagcuucggccuccacaucguccccgucugaccccaccccggagggagggaggaccgacgcgacgcgaugccucccggccaccgccccagccucaccccaucccacgacccccgcaacccuucacaucaccccccucgaaggucggacaggacggguggagccgugggcgggacccucaggcccgggcccgccgcccccagccccgccugccgccccuccccgccugccuggacugcgcggcgccgugagggggauucggcccagcucgucccggccuccaccaagccagccccgaagcccgccagccacccugccggacucgggcgcgaccugcuggcgcgcgccggauguuucugugacacacaaucagcgcggaccgcagcgcggcccagccccgggcacccgccucggacgcucgggcgccaggaggcuucgcuggaggggcugggccaaggagauuaagaagaaaacgacuuucugcaggaggaagagcccgcugccgaaucccugggaaaaauucuuuucccccagugccagccggacugcccucgccuuccgggugugcccugucccagaagauggaauggggguguggggguccggcucuaggaacgggcuuugggggcgucaggucuuuccaagguugggacccaaggaucggggggcccagcagcccgcaccgaucgagccggacucucggcucuucacugcuccuccuggccugccuaguuccccagggcccggcaccuccugcugcgagacccggcucucagcccugccuugccccuaccucagcgucucuuccaccugcuggccucccaguuuccccuccugccaguccuucgccugucccuugacgcccugcauccuccucccugacucgcagccccaucggacgcucucccgggaccgccgcaggaccaguuuccauagacugcggacuggggucuuccuccagcaguuacuugaugcccccucccccgacacagacucucaaucugccggugguaagaaccgguucugagcuggcgucugagcugcugcgggguggaaguggggggcugcccacuccacuccucccauccccucccagccuccuccuccggcaggaacugaacagaaccacaaaaagucuacauuuauuuaauaugauggucuuugcaaaaaggaacaaaacaacacaaaagcccaccaggcugcugcuuuguggaaagacggugugugucgugugaaggcgaaacccgguguacauaaccccucccccuccgccccgccccgcccggccccguagagucccugucgcccgccggcccugccuguagauacgccccgcugucugugcugugagagucgccgcucgcugggggggaagggggggacacagcuacacgcccauuaaagcacagcacguccugggggaggggggcauuuuuuauguuacaaaaaaaaauuacgaaagaaaagaaaucucuaugcaaaaugacgaacaugguccuguggacuccucuggccuguuuuguuggcucuuucucuguaauuccguguuuucgcuuuuuccucccugccccucucucccucugccccucucuccucuccgcuucucucccccucugucucugucucucuccgucucugucgcucuugucugucugucucugcucuuuccucggccucucuccccagaccuggcccggccgcccugucuccgcaggcuagauccgagguggcagcuccagcccccgggcucgcccccucgcgggcgugccccgcgcgccccgggcggccgaaggccgggccgccccgucccgccccguaguugcucuuucgguaguggcgaugcgcccugcaugucuccucacccguggaucgugacgacucgaaauaacagaaacaaagucaauaaagugaaaauaaauaaaaauccuugaacaaauccgaaaaggcuuggaguccucgcccagaucucucuccccugcgagcccuuuuuauuugagaaggaaaaagagaaaagagaaucguuuaagggaacccggcgcccagccaggcuccaguggcccgaacggggcggcgagggcggcgagggcgccgagguccggcccaucccaguccuguggggcuggccgggcagagaccccggacccaggcccaggccuaaccugcuaaauguccccggacgguucuggucuccucggccacuuucagugcgucgguucguuuugauucuuuuucuuuugugcacauaagaaauaaauaauaauaauaaauaaagaauaaaauuuuguauguca

SEQ ID NO: 140015 - RNA, 84231 nt, Homo sapiens
cgggggccuggcccgcgcgcuccccucccgcaggcgccaccucggacauccccgggauugcuacuucucugccaacuucgccaacucgccagcacuuggagaggcccggcuccccucccggcgcccucugaccgcccccgccccgcgcgcucuccgaccaccgccucucggaugaccagguuccaggggagcugagcgagucgccucccccgcccagcuucagcccuggcugcagcugcagcgcgagccaugcgcccccagugcaccccggcccggcccaccgccccggggccauucugcugaccgcccagccccgagccccgacaguggcaaguugcggcuacugcaguugcaagcuccggccaacccggaggagccccagcggggagcgcagugcugcgccccccgcccccgcgcgccccgcagcagccgggcguucacucauccucccucccccaccgucccucccuuuucuccucaaguccugaaguugaguuugagaggcgacacggcggcggcggccgcgcugcucccgcuccucugccuccccauggauaugcacugcaaagcagaccccuucuccgcgaugcaccgugaguaccggcgcccggcuccugucccggcucggggcucuccgucccaacccuguccagucccagcguggccccggccccucgcgcucaggucccaucuuggaggccucccuggcuucuggucccucuuuucguucuuucucucccucgcccgguguuucuaaugccuccaguuucucuccugccuucugucacccauucuuaccucucugucugccugccuuccuaccuucccugaucccuaucaccugccuuugcucuuucuauccgcuccuucuuaggucaugggauccacggccucggagcccugguuccagccacccucucccuagucagccucuugcccugggcuggggggcaaauuagcaggcaguuuucaggguguuguuuuguuguuuucucugucuuuucucucuuucucucuuccucuguuugccucccucuccugucuccccacaucuuuaucuuucucaaacuuaagagucgugggguccaggagacuccaagaguauucagccucagugucaggacaauugggcagaagaguguggggguggggugcccccuucugacccucaucucucagcaucuccaggcccuuccagcccagcauaggcuucuuguggguugguuugaaauauuuucuuccucuuccuuucuuucccaccccccuucccuugccuucccuucccuucacauugggaaucccagguugucaagacacgauggucaucuuucccugccucugccugggggaugcucuaaaaacaaagaggggcuccgagaagaaaucgaagucagggagagagccagcagcgcagccuuccaggugggcccccggcagagugcagcucugcucucagcucuggaggcuccuugccuagacugccgacuccccauugaggaucacgcagccagcaaccuggccagggggucagcaaagagcaaaaaaugagggggaaagaacaaaaggaaagcaaaugccaaagcugaggagaaaggaaaagagaaauccaaacacgggaaaggaaauuaaagaaagaaaguugacaugauguuacagaagaaaagggagaagggagaaaaaaauagagaaaagagggaauuauuuuaauaaaauuugaauuuaugccaugucuuuagcuugaaaaacuauucugagauuuuuuuugcaggcuuuuuuuuuuaaaagcuaaaauucuaaauagaaaacuccucccuaucugcagauuaauaauuaaggauaauuuguaacuuuucacaaggaaacuuuagacccggcuuggaccuguguuuaggacaagagagccgaggagggagagcuguguuuuucgcuaaucauauauuuagcguugcggggguuggggggggcguuuaaaaauacuucugggauaaaauauauuuuucuaaguaauuuccaagcgcaggaaagccgcgccgagggcaucaggccuccgcgggucucggcgagcgggccggaaagccucgguccuuuucgggaggaguggaaccggguccacacgccguuuucgcccagccagccugccucgcggcccgcugccacagcucucguucuccuuuuuugcggauuccgccggggguccgccgaguccuggcugcccgcgggcagccacuuugaaacccaaagguuucugcacggccaagcagaggucggagggagagagccgcagcgcgggcccgcgggccgguggacuggugggugagacaccgcagcccgagucggugcuggcggccguggcgcauuccaggcccgacucagcgccgacucgcugcagucccccagcccuggacucccgccguguccccuucccauccccaccccuuagacuggggcugaggggccgggcccugagcccggggaggcugaauuauucaucuuuaaucugcccgcagcugccgccuuuucauaccgguaacgcgaguucucccggggccuaaauuauugauggucgggguuuggagggaggggagggugagaaguggggcuagagauagggagauuaacggggugggcaaggggguaaaagaaggggcuucagucucucccagcaacgcgaucagaggucuuuccccaggguuucaccgagcuugcucuagguaccccccgagaaagggaggggagagaaaugaggggggcacagauguccccgcuuucuccgaaacucgcgugaggcuagcggggcaggggcugcagcuugccaguccgggccgacccgacucggccgcuagaagucucugcgcuuggauugcucaguaccugcggcuacggguugaucgcucugggugcaggauuucuagacugcuguaggccagggagaauggggcacaggaagcacccucaggccuggcacccaguggccgccucgguuccgagaucgggagcccgcgcuggagccggguuggaaaccccgugcccuucucuuggccgaaagagcaaaagcccgagccgcucgguuuccugggggggcugccgaggucugaggggucaaagggacucgagucggguuugggucggcuacacagggcgccccgagaguuauuaacucgccagcgaggccuaugccgugccaccugggcgagacggugggccccaaccaggcucugcgaggcgcggcaggcaggcgagcccaagcagccggcauucucugccugcugccuggagccgcucugccucccugucucugagcgcagcagaccccgggccccugccucauccgccuuccuugcucuacuucagauacuaaggaggugaaagagagauacggucccccuacagauaaauaacauuagaaaaacuucccaucaaaaacaaacaacacaggaaagagguagaaaaauuccgauuacaauuuaauacuuuuuaaagaagaggcagagagcaaaggggggugugugugucaggcacuuauccccugucugugcuaggagcucggauaaacagucagccgagccucgacgcccccaaaucguccgccuccaagccccgcacgcgcggacagcucccggguugccugcggcgcaggcgggaugcugcuucgcacuaguccaguccucugccaggcccuuccucuccucgcuuucuuacgcccuuuccgcuggcaugaauuccccuuuggcauuuucuccccucuccccucuuuucugucaucugguuucucuccaguccccccuuugcuuucuaccuugcgucgcaaggccugagucgcccucucgcccagcccccagucuucagcccagcgucugugcuuccaguccccacuccuccgcguggucguggagguccaccaccuuucuucucaagcucgggaacaugcccuuccgcccugccugcuuccuucgcccgucccgggccgcggacccugacuaauggccggucccugcugugugugggguguuguguuuuuuucuugucucuccccagcagggcacgggggugugaaccagcucggggggguguuugugaacggccggccccuacccgacguggugaggcagcgcaucguggagcuggcccaccagggugugcggcccugugacaucucccggcagcugcgggucagccacggcugugucagcaaaauccugggcaggugagggcuucgcagcugucccgggagacgccuugccuacuuccccggccagcccugggucuccagcuggaggacguggcuaaaaguccagcgugccaagccagagagggagauccccaaaggggucuggagaggugcuccuuuuggagagaguguucagaugguggcugaagacccaggagcgaggguggcgcagugucacccagugcuugcccugccccuggucccuggugagaaggcagcccguuucuggcuucagaaagggaaggaugacuuuccuaauggaguuaaggcagauacggggugggagacauuagaggaauggggggggagugaaaauggguccccgagaggagaagcagcagcauuugggaggcagaaggaggguccugguucccacagaugcucugugcccaguaggaaagggcucgagguggugccucaacccuggccucccagagaccuugcagcgcuguucguuuugcucuucccaagugaaaggcugggcuuucacucccacgggugccuauuugggcuggugcgaacccagccccugguguggccgucucccuggagggaugguaccccuuguccuccuacuccgcggcgcuccuccuagccaggcacccucaggaagucagcucagccacacugggccuuuucccuccacuccgcugccucggccgggcaggagaguggcucagcagcucuggaaccugcagccccccugccccgccacaguccgcuucuggcugaccccgccggcuuucccggcgcagguacuacgagaccggcagcaucaagccgggugugaucgguggcuccaagcccaaaguggcgacgcccaaagugguggacaagauugcugaauacaaacgacagaacccgacuauguucgccugggagauucgagaccggcuccuggccgagggcaucugugacaaugacacagugcccagcgucucuuccaucaacaggugagcaagccacccggguuuucagggcuggacuccagcuccuggcuccugccugcaggggugucccacgcccagucucugcucuuuguccagccucugcccuuucucccugcuuccagccccaaauccuucugucagagaaagggaaccugugaggcagagaguuagacagacagacagggcugucugcaguucagggcuggguauucccugccaggcuucucccgccggcguccuggaaaugaauccaaguguuugugguaauuaagacuccaagauuacgagcauccagccuugggaucuugagacaaucacagccugcagccggagccuuuaaaaugaccagugucuauucaucccuccaaacagacuggccuuucuaaaggcugcuccuuccccaggggccgccgcuuguccuggcucccucacccucccugccaacucccacaaagcucaccucccaggagucuggucuugcuagccagcuccacacaaauuucuggccuguaggcacugggauccgggcuugcagaacaaaugccaaccaccagccagcaacuggcagggaguagaggagcuggacaaggagggagugccaagcagggagggagaacuccagacuuugagacugaaccuugggugauacccucaaccaccuaaggugccugucuccaggcugaagucuuugcacugaugacaggcucacacacgugaggacagcacagggcugagucagcuugacguguaggauauuuaggucuccuggucuccaaaccccuccagugugcucucggggagaacacaugugcacacuccaugcauguccacccuagccagugugccaauaugccuaucugugguagcuacagaacauacaagcagcacugggcucaggaacccaggcugguuucaagaucacagaacuguacaaacugacaguuguucacagagucccugcacaagucacacaccagccuuggccccccauuuugagacaccccaaaaugaaaagagggcuaagcaguucauaccuuuguuauuuuuugcauucuucauaagcucauuaucagggcaacuaauaauucacauggugccuuauucugaaauuggcaucacauauaaaggauuuuuuaaauauuuugcaaaugauauggaauuaucccaaaucauccugaaaacagcagguaaaauuagcugguagaauguaccuuggcuaaagaagauucccucugccacacucgugcuguaauguacugcgaggcgaccccagaaauuaucccagugugugccaucuguauuaaaaugguuauucaguuaugaacaggguaacauaauacugaucagcuaauuauacacccuccgaaaacccuccagcucccucggccuggcucagccagguauugaaagcauagcgauuugacauucagauaccuuccaaaggagcuggagaaagacgcugggugguuugggagaggaauaagcccuuugcuuuaaaagccaggagaggaggcuggggcagcuuugggcugaggcaagaguggcacuucgggaggggaaggggacaaagcauuguuuuaugagccauguagagacucagucucuuggcugauugcugguccugggcaugaguuggaacugagaucucaagagaagaacagccaagggccaagaguggcccugcugugugcaguguugcugggacuggguaguggucuucugcagaacauuuaagagaaaugcuuguugucaguaacagaauuuucaagccuuuggagaaacccaagucauguaggauuuagguaauuuguuucucuugaaugggguagaggaguggcgcaacaagucaggugugguggccccguccaacacccccugccccuccccucaacaacaugcacuccucauuggcugagaugauuuuggaagcuggcuuaggcauaaguuuggaaauacuucuauccugaaaagccauggagaacaagggccaggugacccuaggaucaagcuccagaggucuugaggugcacccaccagaauuaggacaaaguagacaagugagccacaagugagaugaggguggggaaagaguagccucagcuugacagcugugacagcugcagaaccugcccagcacagagcccuaucaccugaggggcacacaggcuuccuuuggguguggagaaauagccaucugugggcagauguugcuggagauggagagggaguaggaggagaggaacagguaagccaccaacaacacgggcagccuacccuggguccguaguuaggcuucauggcuggcuuugucuacaaggagcaggaaaacuauucccaauuuugcuuuuguccagaauccucucaugguucauauuuuggaaagaauucugggggcuucccugugugcugcugaguuggggcuggagaaauccaccuggggaaccacgcucucaucuucaucccuguaggugcuuuuugcucugaagagggaagguuuaucugagauguauuguuucacccaaaagccugauaaaaacaggauguuucugcuagugcugguuauaucagaaacuuugccuuuuaucaguucugggaauucucacucacuguaggaagagcccggagauuuuccugugugcacaaaguguggugcaccggggaacgggugguucuugaguuuagagcuuuguugguagugaccugcccacuuguguuggguacuuuauaacaguuaugaguaagguugugcaugagcuggugguuggcaagaaaagaaguccacacaugcucacccaccugagcuagugguuuuucaucuucuccuucccaaaacagaugcugucgccacacuugaaauaugcuguuaugguuauaaacuaaauugcuuuuuucacucuuuaaaaaugguuuuggcauucucugauucuguugugauaaaggccuggccauccagccuguauucuccacuagcaaauccucagaaaugccucucugaaccagaggacugggucaggaaggccuccccacugccacaaaccacguucaaaaaucccaaggcuugacugggcuccuuagcauguggaauuuaucugaaucuuucuaaacauuggguuaccaauggcugagcauggaguugccagcuuuuugguuuguacaccgcugcuguaaagggcagguguuuauaaacaggggacuuuagauugaaaccuggugugggacauggccuggagaggggagagguggagggagauccaugcuacugaaaaaggaaaaagucgucuaguuacauagcugagcaauugucuaagcaggagggauuuuccugauuauaugccaaaaucuucugguuuggcuguuacucugggcagagaauacaccuccuuugaaagaacaggcacagaccccaaauagagucugggguuacugacaaucccccgagggugcucuuuugggaagagcugacaauaagggugucaccuucuaacuuuuuuagcuugccuaacacucuuuggagucagggcacucucugccccuagaucuuuggaguggacccuggcagaaucaacuucucacggaucucccacuauccacacucucucuuagccuguuaggcucuaggugaguacauucauucuccuagcaguggcaacccagggcuguguuaaggaauuccauccuguaucauuugggugucccucuucugucauucucaggucuuugagucauucucaggucauuguuccccuugggucaggcaguggggugacaauggucuacuaguuguucguucaaagaccuuuccaaauaagcugggagcuauuaauccuagccccgugaauguugaagauauguuccgggcuagggucuguuucucccucucugaaacucagguuccagaacauugccuauucuacucuuggaccuggcuuggcaugaagcuuggccagaggggugguacugccuaccacaucuccauaucuuuguagcuguuugguggucagggcuguuggucucauggcaaagagacagggcaaguuggagaguucagaaaaagacuucuauccacagaggaauggcagaaacaaggacagggaacucaccuucuguggccugagccuagcagauugggcccacaaauagcagaccaacaugccaauuucugucagagaagccucgcucaccuguccuuucccagagacaguccccuacugugagguuacccaucauuggaauaacauuugaaacaggcaugaugguugaaauucucauuccuuaaaaugagcuggaguuguccuccugaaaagccucuuuuuguuuuuguaguuguuuuagccugggcuuccuggcccacaguccuguuggucugacugucucccuguuggcugguucuguggguguucaggcuacaaaagggguuucuggugagagcaauugcugcuugcccugccuuccuaccucagcuggcaacucucgagaagaggcagacaggaggcacugggccugacaacagcuccaggugcauuucagaaggugacgcaaagaagaaaagagagggaaaacccaaaaugaauaaauaaauagugucccaacuguucugagaacucaauaaaacaaucacaucaaauaugaagaggcauaaaucuugugucugcacagguaaccuacucaauugcuuuuauuaucgcucaggcugccuccauuuauuaccguucauggccugggcaaaggaggcugcguggaggguggucuccagugcaauccuacacccugagaggcaacaaucagcccauacagccagagauuucgaugggagcccaggaagggcccaucugucugcaugaaaaccaaucaauaacucuguaaccagagcccuugucacagggaaauggacaacacaacaguucaauagaggggccacagggggaauuagccaaguggagauggggccaaacaggagcagccccuagagaagggaaacaggggugccuggaguaggggagauuagggaagggguggagauguggcaggggagagcaauagcuucauaugcauguugguauuagauggggaguauugugcaaaauagacccagggaaugacaggcaauguuggaaguugaggugguagggaacauguguuuuggacagcauuugggaaaugggcuuguucuggugcacaugggagagugugacuaugcaugauggcaugugcuugcggacuagaauguuacagcuucuacagaaagaggaacaauaguaguaacugguguggaagauuaaucacacuccauacccccuaaaaccccucugaaaaggggguuccuaugagcccacaugggauagggguccugcuucccagucuucuuagcaggacugaugaaagagccccauuguccgcucccagcuucuuagguguccaacaauagcuacucugcagguugccucuuaauacucaagucuaucuucacccccuccuugugucuaccuggaauuggaguuuuuauauuaagaagagaacaaugguguaaaagugacaagcauccaguagaaaucauacuucaaguacccaaacaaccauucuguuucucacuuucaauacaguauucaauaaauugcaugagauauccaacacuuugguauaaaauagucuuuguguuagaugacuuuggccaacuguaaauguuuugagcauguuuaagguaggcuaggcugaccuaugauguuccauagauuagcuguauucaaugcauuuucagcuuacaauauuuucaacuuaucgagccauuacccuguugugaguuaaggagcaucuguacacugaaaauaauuuauuuuucacuuccuguccuuuaaaagaaugcucauccgaccugccaguucucugcaucccugcuguuucuucucacacuucccccgccccuccaagccagguguccagagcucagauucuugcaggggaagcagcuucaggugcagcuauccccagugcagcuccccagccaugcaguugaguccagagaaggggaaagggcuccugaaacugagaugugggaaauagagucucacaaccaaugcccaaauagcaagugaaauauuagacagcugaaacauuaaaucacguuugguuuuucuaucuaccacugaacuacuagguugagaugguuuucucuuguggaacaggcuauuuguuuuggggcuagcaaggcauggcuugaauauauucaugaugguuugcaguguagaaguugauaucuucugugcguguggauuuguguguguuuguggguaccuaccuaugucugcuuuuaggugaaaaggcccugaggccaagaggagaaaagggaggaaggcucacaggacaugaccugcagucacaggcaaggcuggacaccuuguacuugggccaucagaucaauuggcaaguagucauugggccacugggcgaaguggcagcagcaauaaggcuaggcugaagauuccucauuucacagucuaggcaaauuggagccacauuuuccuucaguuauuugcauuguaacacucuauaguccaguuaacccuggauaagaggggcuuugcuacaaugaugccacaagagcugugcgaccagcuguccauccuuacuuugauacuuggguccaagcccuguuggcaggauuaguuagggaccaauugcauaagcagccaagaaggcgcucuucccaacacaauccuuccuccaaagcuguggucccgcagugggaggcaugguagcagcccugggacacaacggugggcagagcucaccccagggccagccugcaagucuuuccucaaucauccaggugugaggggcauagggaagaggcuuacuguuugugagaaaugcagagcuggccacugcagaaggcuugggguguagaugaggcgugauggcagaggcagccucaggucuccugaggaaggcugggcacaggggagcuguugaggguaugggaagcuaaagaagaauggucuggcgcuguaggagagggagcagccucuuguaggcugggaacucucagguaagagaggaagugugcaggaaagagguagacaggcgaggccguagagccaggguccccucauggcacauccgcaaucaaccaugggagaaaugaggcccuuucuuuuguuuucugagagauaauguaaugagaacagauuuuguguuuuccaagggagaaggaaagagauagaaagagagcagggcagggggagcgagucaggugccauucuuuuuuuuuuuuuuugagacggagucuugcucuguugcccaggcuggagugcaauggcacgaucucagcucacugcaagcuccgccucccggguucacgccauucuccugccucaaccucccgaguagcugggacuauaggcgcccaccaccacgcccggcuaauuuuuuguauuuuuaguagagaugggguuucaccauguuagccgggauggucucgaucuccugaccucgugauccgcccgccucggccucccagauugcugggauuacaggcgugagccaccgcgcccggccgucaggugccauucuauucuagaaacguucagguuuguuguagggauguugggggaaggaaagcagugcccagaaguccagacugggguuugccaaaagcaaugauggagaugcgcuguggcugcaggagucaugagcacaaaagacucccaggccccagcaggaagaggcuccagaauaugagaugaaaaguggugagaacuggacaaacagccggagcacaugggcccugccugcaggcagugaugcaggaagaccggauuuuaaaaaacucucugcugaccgaauaaaacucaacuuugggccugauuccauccauuggccagcauucagcagccuuugguugaccugacuggauggacuuaucucucugccuuagaccagggcaguaacauccacgcaaguggaaggggaugggacauuuccugggucccuugguccagaagcuccuggggaaggcaguggaggagagauuaugacucccuauagccggaggaggagaggugggguguggguagggagaggcagaaagugaggaugaggacugggagagugaggcaggaagcgaugaagcugagagguggaaggaagggcgcugccuugggcuggacaggguuguucgggauuggagcacauggcugagcaggaaauggcacggcagagcccgcaaggggagcuuggauuugcucauccgagcuggggccuucaguggcccugcaaggucuuggggguggugggaggaaaccugagcuccaggcaucugguaguacaggcugaugggcccugaggaggggcccagaggugaugaaggagaaaggggaagaggaagguaagcagguuucugagaagaguauggagcgaaggaaauggcaugggaggaauagcggccuggcuggagcuaugcagcccuuucugagaggaaaccucaugagugugccgcaauggucuggcuguggccccucucggcaggcugugaggcaggccagcaguggcuccagccuagucccuggcaggcuggagagggagaguaggagagcagccaaaagggagggaggcaggccccugccugcuggggguugcagauucgagagccaucuccacccagagccuuugaccagguugcuguggacuuccuccucugccugcccucaguccugccugaaccacagauuucucucugcugccaccugggaacagaacaagccagggacaggaccgguggcuccuggcagggcugaggcagggcagcaggcugggaggagaacuguguucacccugcaggcacaguagaaucaagaaaucagagaggaaggauuggagaggacugggagagaggggagcaggcagaaagggagaacaaaaguggccccugagcaugagcaaaugggagugagcacugggggcugcucucccuggucuuggugcucccucuuggccugggggucuuugcugggcccaacugcccagcccauaccuggcaggcagaugauagaagcugaagggcaugaggagucugcaggcagcuucuggccugcaggacauggaggcggucaggaaggagacacucauucagccucuuaguccagaagcuuugauccugauuuuggagggcaagcaguggugccugccuuagugcguuuucccaagagaaguuggugauguguugggagccucugugcauggcucugcuuuggaaagacuaugugugcuggugguaucuagcuaggccuggcuucuaugcccugggaagcugucuaaauggcccuggcucccagggaacucucgaaaggagucagucuugucaaacugggaguuggugguuugcuauucagaaggcuuccggcuaaagggauuguuuggucccagaaugaaagucccuguuaucacuuugauggccugccuguuugggauguuaguuaauguucccuggagagcacgugguugaauggacaguagacauccugaugggucaaugaacggggguucugaaagguacacacagggucccgacacaucuagucugugugcaugcacaaguuuggggaugugaacgcuuaugaguagugugcauuugcucugcuggaugagugaaccaagccaugugugauggccaggguggaggguguguguaguaucgcacuaggagaacuggaagcaguuguuucuugugugucugcugacguccucaaagggagcauguauuuagguagagacaaaggucaagauagucaccuccuuuuaucauuugcaaaguggauaccacuaucccuucccccagucccuuacuuuucuuccucuuucuccuccuccuccucguuccucagguuagcugguuuggguuagggggccaaucucagaagacucuaauuaaagagugaggagaaucugauaagauaaggaaggccauccuuccucuagggaccaauggagguuucauguuccucacuccccgcugcuucucugaggagcugacacuagggcaggcagccugccgacugugacugucuggagucugggagagccagagagaaggaggugugacugggguugggacucggguuccuacccauuugcaaugguccuggaagggaaaaccuagcagacuccagaugagagcgaggggaggguagaagagagagugcagaagucaggaagagagaagugggagccagaugugaucaacacagauaugccucgcuaaguccuaguuuuuggccacagaaauggacuguacgggguggggugugguaccuuuuuuuuuuuaauuagggaaggggcuaugaagccauuuaacccaucuuuggggcugagcacuuagcuccugcagagaguacagcccugguuaggguucagcuccuccuagaaacaaugcucaccugcgcucucgacccuccgcccucccaccuagcacauacacuuuucuuuuuccccacccucguuuccucugaacuuggcucuguggaucaggucacuccuggccccauggagacagccaggaaggccaugcagacucccuuaggagaugaccucccaggguggguacaaaaaaaguugagagaaauucauuucauggccaguggcugcuuagaaaaggcgauuccagcauccgaaugugauaaaugcuaacugagcauuaaucgcauuaaagagggcccuauaaacuuuucacuucuaauuaaauuuguccaguggugcugcccaagcgaguacucugggccuuuguuuauguggaaaauuaaaaugcaaauacaaugagauuuauuuccaggaguggagugaugggcuggccccucuggcuacuggucuccaggccugucaggucaggugacugcuucuuuggaggugcuaucccccuugugacagauucuugugugaagggagaggccagaguucaaggucaaauagaguuaguaaauggggagaagauguagaaagaauugaagagaaggagaaaaaggcaauagauuaccaggaauauagggagacauuauucugguuucccacccuccuuccccaccaacucacaucucuagggguauagacccccaaaaucuuacuuguuaauaucaccacaagccuccucugaagcuaugagaugaaggaguacaugggagagagaauuuggaggaagcagcccugccaggcucggcauggcggcucacaccuguaauccuagcacuuugggaggcugaagcaggaggaucacuugagaccaggaguuugagaccagacuaggcaacagagugaggcccaucucuauuaaaaaaaaaaaaacaaaacuaaguggccaucaggaagggucaagggccuggauuucucuccagcaguuugagggucaucugcuguccacaccgggguuucacugggcucuuccugccaguuccaaguggcauugacauggggcagugaagcauagaggcacaaaccaaggaggacauugugcaugcacgccugcacgcacgcagccuucuugcacauaaggagagccgguuucucauaagaauaaacaaaugucccuugcaaggagucauuuagugccgugaucccuugauaaaagugguaauccuaaaugcuacugaauggaacaaucuaaauuuccuauuuacugagaacauaaauuaagucgaggggagagaaaaccugcauaagaaaaauuaguaggguauaucaguuagagacacugaaagauagcuaugcugcucucuggauaaggaaguuguaaauagcauuaaaaagucaagcaggaaaggaaauggagguaggagaaaugauaaaagacagagcacuaaaucacaaauagggguacauguacgaagucacaaaccggcuuuaugccaagcuuugcagaauccacagcuuggacugacaauacauagagaugcuaaacacacaggcaugcagacuuccagagagugucaguaugcagaggguggauuggucgcaccaugggcaagcuguugucugugcuggacucugggauugauccaucaguuccuccuugcagggaucugauuggguacaguucgguaggcagucgaggauacagcuguaugagguuuuuaaaggucuuuaaacacaugagucucuugugagcuggauccaccuucuaauggaucuccaagguagcaacccauucccagaacacugccugcuugacugguuuugucaaauagcugcuaccccuguccuccuuuuucuguuuuauucugggcuacucuuuuccuuuuuaguguucacuuaugccucuuggaaauucaugagcacuugcugacaaacagguuaaugacuguggcaacucccaaacaucuggauggaaaccaaaacuucagucaaucaucuauaaagguugucgauaugaugccaaagaucuggcgauuuagaaauguccacauaauugauugaauuucucaguuuuuuauccaggcucagaaucaacacauugggaaacaccuauuuucagagaaaaauauuccaggaaacaaaguguucucauuagaaagcaucuuugauguguucgagucugauuucuggcuugaaaggaggcugggcugggcucuaagucagauggagaucuggugguuagaguaguuaguauuggaacgagcacagcuggugagagguuuccuucccccgaaaguuggccaggaggguagaucacuuuguccaaauaagcuuaggcugccuguuaggccugguuucucuaagggaguccauuuugccauuuuaagggagacugucagguucuuaagacauguggcuuuuucuucauuuaucuuuucauucauccauucagaagcaaguaggugcuugcuaagcaccuacuaugugcuaggcaauucacauaaagcuauguggcauaguguuagaaagcaggcucuggggagaaacugccagaguuugaagcuggcuucccuacucacuggcuagaggguacuggguccaccuuauauccucugugggccccaguuucuucacucauaaaaugugggggauaauuguguaggucucucauaaguuuucaugaggguuaaaugagugaguccacauaaaccagcuuagaauugcaccuggcagguauuaagugcucaauaaaugcuaguuauuauuauugcaguaguaauaaucaagucuguauuucuuguuaugcgucuauuucaguguguaugcauucugcuuuguguaugcacaaacauugaauuuuuuuuuuuuuuuuuuuuuuuuugagaaagagucucgcucugucgcccaggcuggagugcaguggcaccaucucggcucacugcaaccuccgccucccggguucaugccauucuucugccucagccuccugaguaccugggaccacaggcgcccgccaccacgccuggcuaauuuuuuguauuuuuaguagagacaggguuucaccuguuagccaggauggucucgaucuccugaccuugugauccacccaccuuggccucccaaagugcugggauuacaggcgucagccaccguggccggccugaaauauuuuuaaauaaaaaaguuugaagagccaaaaggauauucugugaacagaauuguguaucaugaaugccagugagaaucauggucccucgugagcccagauggauuuaggaaggggacccacucaguguauuuccagaaaaaaagacccucuaugauucaguaaucugaccauugagcagaauuagucagauaauugccccuuugucaacuuugagagcccagaccuuguggcuguguguguguguguguguacuuuguauaacugcacauuccuucucuuggaagccugcuauugcuugaggaauucaagguuggcauuuucuaggcuucauggcauuuucguagguuguggugcuuugcauuuuguaguuuuuuuaaaagauaaaaugaaaugguaguggggaaaaaguccuuauuugaugcauuugaaggguuccacugauucuuaaaugucauacaggggagaggaaagggagguaaacaggaagaggaggggaagagaggagagaaaauggagauaagacaaaggaagaagaaagaggaaagggagaagugagcaaauacuuaacaaauucaaaugaaaucugucuauucuugucuggcaugucuggauauucuaaggaaguaugggaguuugacaaucauugcaguuauuuccauugcuaaggaguaaaaguuuuuaagaaaaaaauuucaggaaaaaauuacuuugggcuuaaucuauuugaugaauggcuccaacuaacuggacaacugcaaauucuauuuauucuuugccugacaagagcaaauaugaaacccaguuucccaaacucaugacaauguguuucucaucuuuaugggaacuuccauggaacaagacugaggugcaaucccauucuugccucaaguucucccugccccuuuggcuuaguuaggugaccaaguucagcucaauggauggcuguaagacccacacccaaauacuuacagagucacuuaucugauaccuuuuauaccuuuugcaucauucucaaauuccuagauuucauuauucgucauuuaugccuauuagcugguaaagguucugauuuucaaauuagaaaguaaauguuuuuaaugagcaaaauuagaauccugaaagcucaaucauccuuacauuuuucuuguaguacgaaacaagucaagggcugccuauucauuaccagaugcagggccagaugcugcccucuguguggacauaggcaguggugagcucugucaauccccagccccugccacugcccagauggcagggagagaacuacccucugccccugugcuaccuggcugcaauuuuugcacuucucugcuuaaaacacacacacacacacacauacaccucuuaauuugucuuaggauuuuauguacacuagcacacauguguacauguuuauacacauacacaggccaaucuuauggcugcuuuacucagaaagccuuuauauuuaucaucaucaucaucaucaucaucaucaucauagugguuaacaagugcuuacuacaguaggaaccguuacaagcauguuucaugcauuaauugauuuaagcauccuaaacaaccccauagggcuuuauaggauuguuauagaugagguagcuggaguacagagaaguuaaauaacuugcucaaggucacagacuaaguagcagaaguaggauuugaacccaugcaguccuggcucuaaaacccacaugcuuauccccuaugccauacuucauaucuacuuuggaucaagggaagugcaggcacaggcaaucuccuggggaacucuguauauuuugcagucucuuacaagcucaaaacaggaaaccugcacccuagcagauggucacaccucuguguaucucuguacucuuccaugguguguguuccucagugcaggccacugcugagccacaucaucuagagauacugggaaggaagaagauacuaauagccagagccacagaguagaguggaauggggauucuuggaacuagaguuuauauugcuguucccauugggauuggcaaguuuacucccguccauccuccuccagcuccaacagggaucuagacucucaauuggcauaagguuuggacuaggggcuuaacucuccaaaucaggcagaccuguucucguuugguaaagucguaacuguucagcagagcagggacauuugcuuccaagaagaauagaaucguauuuuugguuaucaagaagagauuuguccugcaucucuagaaucuuccuucugaaaagcagcagugcaaaugaccaggccagaguaagcuaaaaaagcuaaaggauggauccucucacccacaaccacaccaagaaggcaauuaaagcaauuaccgaaucauacaccaucacccagauccagcaucauuacucaacccacaucaccaaggagacacccauuaaccuaaucucugagacauacauuagggaaaaaagaugcugauaugaucaaugaacacaauaauucaaagcagaaacacagacacugccaccaaacaauacucaaauuccuccaacucaguguuacacaaagugcagccaccucaauacaauaccacaaaacaccaaguaacaaacauuaagcuagcugccggaaugcgucaacacaaugcaauaauacacgguaaugcacaacacaguucaaacucuguaucccauaggcacacccauacccacaggcugaaaucauguggccacuugagccacaugggcagacacacacagagacagagccaauagcgcagcacccaauucuccugcacacccagcagaaaacgaucacagcugcaguccucccaagcacgaugcagccugccagaaagcagcagcaccaugccguuucuccagcagguggacguguccagaccaucaccucuaauaaggccucugggcucucauugcuaguaagagaguaaacuguccccugagccugcuucccgagacaggacaauucaguucuauccugguugggguuuaauaagacuucgcuguuagugaaaaugacagagcuccagggauaaagggaaaggugguggugggaggggagcucacuaagcugggugcaggaauuccccuuccucuacccagcccuaccuucuguggccauuccagagccaaagcccucaugcuggguguucacggaguaucgauucagucugcaagcaauuuuaauauuucuucagggacuuuccagcaacagcacaagucauuaauucacccucccaaauugcuuauucaauagcaggaacauggcuccugaauaaagucccagaauuuaugugacucgcacgagucaggaggucaaacaacuguuauggagcgaaguuaaaaauccaaauaaaauauugacacuuuuuuggggagggggaggugggaagcaaagguauuuaaaauagguuuuuguugcaaugcccccaggauaaagaauggaaggagacugaagacaaguuggaguuuauaaaaucaauggaauuuauugcacagcuacuuggcauuuaauaauucucucauuuccacaucccccucccccaccccauccuggccauagacagagagauacacagguauacaaaugcacauuuauguacgucaauacuggugcauggaccaauauaaaaacacgauugugaugugaaaaucucaaacaccccaggaagggaacaaugaugguguagagucucgcuguaguuuacauauuugacagaaaugggcauaacuuggcagauacucaugaagcagguuuugauaaauauauccacuauuauaaaucuuagaucaaugcauuggagcagaccugaauauaaagauaaacuaaucauagaaauagauccucaaaacagaaauugagaaacacaucuauauguaguaucauccugcaaucauguacaugauuuggaaacuagauagaugaaaauaauuuggaaaauuugccccccaaaccuaccagugcauauaaaauucaccgaagccuauagcagcuuaaucuaaaauugugauuuguuaguaacacagacaugaugcuuaucaaauacagcuauggcacaugcaugggagaggauaagcguguuuaaaaucacagcuaccugugcucucuguuaauugucuacauauauaauugcucaauuuuccaaaaucauggauaugaaaaggcugaaggaaaaauuuguucauguccaaauaguuaauaaauaaauauauauauaaauuucccaaaaagaucaacugauucagccuacagacauugaagucacaagccuggauccaaugucgggcucuuacccgaugcauauguauaauuauaugucaauugaaaaaaauaaacaccaaccaaacaaacaauuucuggcuccaaugcuauuaagcaugugacuuugggcaaguugcuuggccuuucuguuguuucuuaggcaaaauagagaggauggcuauuugauagaguuauaguugaauucgaaugagaaaacacauucauuauaaugccuuucauacagugaauaugaaauaaacgauaguuauugcuuuuacuauuauuagauucagcucuucuauucaggccuagccucucauagauucuaccaucgguucuugauaugacugacucauucuacucaaugguuagccgcauaaguucuagagugagacacucagguuuaaauucuggcucuguuacuuaacagcugugugaccuuccguaaguuaccuaaccucucugagucucagcuuccacaucuguagauuauggacaauaaucuucauagguacuugugagaauuaaguuaaauaauccauauaaagugcuuugcacagugccugguacauaguaaguguauauuggcccacugugucccuuaagauuaugucauuguuauuauuggccagguacaguggcucaugccuguaaucccagcacuuugggaggcugaggugggaggauuacuugaggucaggaguuugagaccagccuggccaacaugguaaaacccugucucuacuaaaaauacaaaaaugagcugggcgugguggugugcaccuauaauccuagcuacucaggaggcugagguugcagugaaccugggaggcagagguugcagugagcugagauugugccauuguacuccagccugggcaacagugugagacuccaucucaaaaagaauaaaauaaaauaaaauaaaauaaaauaaaauaaaauaaaauaaaaaaauaaaaaacaaaaaacaagaguauauuauuguuauuauuauuaauaauaauauucauuuguuauugaacaaauagcuaucaaguacuuacauuauaccagacaccauugcuaggugcuggggaaagacagucgugagaaaaauagcagacaucugccuucucagagcuuggagggguggacucuaugugaacugaguaagcaagaaaacaagguuucagcucuguguuagacccugagaggaagagggaaacagagagaaauagauuggaaagcuaggauagagccagauaagggaagauuuugaaggccgggcugaagaauucugaauuuauccuauaggugauaggaagugauuguaggguuuagccagaucacauucuuucaggagacagagaaagacugacggacuguuuuugaaugccugaguaggcgaaagguaggaaaggcuagagguagggaggccaggcagucacuagcgggcccuacaucugcugcugcucaugugacugcagagggaggugagcaugccuguggugggacaggguugggggauggacaggugcagagugggagacuuuaucccagcaaugaaucuauagcaguaccuuguucaccuuauaucaagcagucuucaagccucuggagcuucccaaacaggaucauggggguggacagcugguagauuccagcucuagccagaagcucugacagaugagggcagggccaguggugagaggcgcuagucugucacgcucugggcuuggcaugcaccacagacugguuuccaaaugguuaguuaaacacauugccccuuaauuuuuaaaccuaugcauaucuugaaguuaaaucaauccauaugcuuagcauucaucauauaaaccaucacuauugcccccuugggccagccccauggcccaucuagccugguaaauugucucuggccugggcucucaggggcacguggcggaaagauuaucgcccucaaugccagucuuggaaggcuaaguugaugcagaauauaugccugguaucuaaguaacccacugggaauuuaucauccuggaauguaccaaaaaccauuuugaaauuauuucaauuuuuaaccuaugguuuuguuuccacagagcaacugauagcuuauugaauuuuggugacuaugucagcuggagucaggguuaauagauggagagaaauguggaucgauagaguaugagaaaggaacuuucuuaacucacuaagacuuauucccagcucuuccaaggauccccuugagaaaccaaccagaaggaugguuucuucaccuccuggcuuaagcuagucuucucaaauagaguucagaaacucuaauucaggucuaagaugggacccggugauuugcauuuuagcaagcaccccaggggauucuaaugcagguaguucaagggcaguaguuugaggaaacccuucugccagcuuuuugguaggacuuucauuucuuggagcucagcuaugacuucugagagucaacaagaguugacacauuugggaagaacccugguaaccuggaaccuguguauuccagcaacauccugccacagccagaauggaagguccugcccacagcucugaagaauggccuggcccuuaucaguggccauguucagaacccugccugacauauggucaguuauccagacugaaaccugcagggcauaugagugagcaugggcaaaaaaaccucuaaacucagcccaaacugcagccagaggcuacaaaaacaguguguuaagugauucaggccugccuuaaaggaagccacgugcaggagagaugcuguuuccuuuguguuucuguggagaggaggaaguaaauuucaauuuuucaguuccugggguauacaaagggggagacucuaguuccuuagaguucucaggaguagggaccauuuccaggagagguaaacauuuccugggugaucuaugacaucucacucaagguucugcugugaaaagucucccgcuguuaguguugcugacuugccucggggccaagccauggauacgugccugauauaggcagcucucaaagacuuguguugaagcaauaaccaccugcauuagcugggcaaaauauccuuugcugaagcaaauaucuucuuuuuuuuuuuucuaagacacagucucgcucuguugccgaggcuggagugcaguggcgcgaucucugcucacugcaacuuucaccucccgcguucaagcaauucucugccucagccuccccaguagcagggauuacaggcauccgccaccaugcccggcuaauuuuuguauuuuuaguagaggcgagguuucaccaucuuggccaggcuggucuugaacuuccgaccucaugauucacuugccucggccucccaaaguguugugauuacaggcgugagccacugugcccggccacaaauauccuuuuuaauaucuuuuuugugugugugacagagucucacucugcagcccaggcuggagugcaauggcaccaucucagcucacugcaaccuccaccgacuccagucguggguuccacuucaccacugcaaucguggguuugagagauucucccaccucagccucccgaguagcuggaaccacaagcaugugacacccugcccggcuaauuuuuguauuuucaguagagauggguuuucaccauguuggccaggcuggucucgaacuccugaccucaagugauccaccugccucagccucccaaagugcugggauuauaggcauaagccaccaugccuggcugcaaauaucauuuuguucucuaggaugauugaguuuauaaugcccaggcagucugagaccacuggcagaggcccccaugaccauucgucuggcuuagugggcaauggggccagcuagucuggcacauuuucuacccuggagugccuuugauuuacugaaucaggaaagacccuccccauaccagggauuaaauauuuucugcaaagacucuaaaguggacaguuuacuccaggacaauuuaaacugauuuauacauguauauaacacauauauccagauacuugacaucuugcuccuaagagcagccugccucaagccuggucaugucacugguuuguucaagcucugcuaggaaguaauuuuguuccucuagggaauaauucuaaaauugggaaggaagucuguucuagacagcaggaaaggauuucauggugacauacuuggagauccaauguacagggguugucagcaauuggguccagcagguguuaauacucccauuuucuagugaggacaacugagguucagggaaaccucucacccuucauuucucagaagggacugaaaauagaaguuucaauuuggugccuuugggugucucuccccuggaggcaguauaauuuagcagguaagggauuagucccugggauuagucuaugugaauucaaaucccagauuuacuguuuauuaaaugggugacuuugagcaaguuguaauaagccuuaugugcaaaaugcguuguuguaaggauugagugaacuauuuauuugaaguacauagaacauugccuagcacauaguagauacucaguagacaguuuuuuguuuuuguuuuuaaacuggagccucuccugaggaagcauugcuccuagaaagccugcccagccuaguccaguaaaugcugccaccucacuccucccaaggugagcugucugaggucaccucaaugcuaauaggaccucuucuugucuccaccucagggaguuuuugcacaccauguauuaucauauaauauaaugcaauauaauaucauacauaacauaacauaauaugauggguagguuaacuuggaaacccugaggcggacgguggauggauggauagaugaauagauacauuuguacuaaguauacauacauuauaucauucuauugauuuguaaaaaguucccggucugccuggcuguaaugagauuuuugaacuuugcguggcgaucaaugagaggaauauuauuggccuggagaauugauauaccugcucucaguggcuuguucugcucccaggcugccccggccccccagguguaugauuccagcagacacuuaaccuuuuuuacagugucaucaggcuaaaaggaaucuaauagugacacaggacuugugcucagcacucugccacuauugcuuuccugucacaaauaauuuauagccuucuauuuccaccccugagccugcaccccagccuugccuccugcuucccccagcucccaggaaucaauaaacucacauagccacggugggacuucagggugcaaggagacagacagacagacaaagagaggggaaguggagagaggagcagagaaggagaagaagagagggacagagagugaaacacagagaaaagaauggggaaggaggaggaagagagagagcugaacuagaagaugaguaagaaugccuggugcucucuuaaaagguggagcgcuucucucuuucuucuugaguuuaacacaguguuaauaggaguuucaugcagggcuuucauucuuacucacagagccugagacuguguugauauccaaguuggugagaggugggggucuuccgggaauuuaaccaguaagggaguggccuccccaccugcccugucauccuuugcucugaaguccugccacgacccccugccaucccuugggucuccuguggauccuugccagugacccuaguggggcuugguccagcccccagucugucugcuugagagucugacgcaaccuccuuuugggucagaugucgccgccgccacugcugcuguuucuugucuucucaaugcucuucccagggucucaguggcaccugcauugaccagucuggggcauacuggguagggaggucuccugccugcaucggccuaaauugaaagcacccgggccuaggggucacccauaggaauaauaauacuggucaucauuguuauuauagguagcauuuauagaaccaaccaucauaguaaucacauuacauggagugucccuauuuaguccuugccacaguccuaugaaguguaugguaguauuaucuuauuuuacagagaagggaauaagaaacugccagggguuucacaggaaacaaguaacaaagccgggauuccgacuaaggcaggcugagcccagaacccauguccuucuuccuuuugcugcucucacucccuuggaagugugggagacucuaagugccuggaaguccccaugcggggcccaggccaaagcccuggagguccccaggaaagggcgagcucucaucggaaaugguggaggagaaagagcaucuugugaaggaaagagaaguggggagcaggcacccuggcagggcagucucucaguggaaauggaaaaaugacaccucccagcuucugagcagagcuguguccuccagggucccagcugcacccuccagggaucuauauccagaacuugaccuuccaggucaaaccugccuggggccguggagguuugaugugugucuggcugucuugugaggccaaguaugaaaaagaauuggagaaagaggaggaggaacauggggaaacgguaucaggccgucaucaucaacaacugcuuuacuucauucauccuuuagccccgagugaaauugccaugaguuguuggguuguuguaugggagacaggaggacaauggaugaccaucagauuuccaugaucccaguucuuaaauucuccgagaucagcucuagggacuggcaagugcccacugccugaggucauggauggacaccaagagcauuaguaacucacagcaggcacccugcccagcuccucccccaugcaccaccaagccgcugucagggaguagugauuuuccaucacucgcugccucagcuaaauuugcgccagugcccuaggggucagaggcucuggguaacaaagacagaaacuccucaagcccguccaguucucucucucagccagccccaccccugggguucccuuagucaagagcccaucagcccucaagccagagccacccacaggcccagugagcucacagaagcuguugcugcaguaaacuaggagcagcugcucugagcugcucagcaucuuucuagacuuuucuuguagaugauuguacacugccucucagcuacuauccaaucuuuuccauugugaucaaacuccaaaucuucccuccaacucuugggagaugaccuugccuucugcuuugcugagagauaaaagccguaaaagcuccuuuucaaagcuuuggccaccugaaaauaugccauuucuggcuaacaccucccuggagucugcacuccauuuuuccuuguucucccuugcucuguuaaucauccacagucccuuaggcaacuucagucucuuccucuucacugguucuuccuccucagucuacaagcuuauccaggucuuuccuacccaagaaggccuucccuccacuuagcugcccguuccauccuccaccuuccauacuuuccucuccuuucguuuuccaaaaacuucugaggcaauagucuccguuuacugcccugccuccuuuuacucccuaugcauucccuaaccuuguucugucuggcuccugcuccagucgcuuugcugagacuccuccucaaggucacuaauggcuaccagaaucccaaaucugugcuucuucuuguuccuaauucccuucgguccccauguugcuguuggcacugcagguuguguuuuucuugaaacauucuucuccacugacuuaggugaaacugaccuaucuugguucugccauuuccucugcaauuaauucucugaauccuuugcaaggucaguuucuuuucccagucccuggaaauaaauguccuccaguauccacuccuuaggccucuugucuuuuaaacacuccuuuccccggucccugacagucuccuaaauccauaccucugugugccugcugaugcaggggcauugccccuggacgcuccucuuucaccucaaaugcugcacaucuaggaccaacaucaccacuucccuccaaaaccagucaccucccuauagccuuauuccugaccugcugauguaaacuccaccaagcuuccaguuacacaaaucugaguuuguaaaaccaugguugacuccaguugguugccaaacucugaccauucugccuuccucuugucuugcaaauucuucccuuucuuuccugagaccagcucccuaucgccucaugccucauguauauguauguugcuuuacugggaucuguuuguagagauccccccuaguuuagaaaucacucauggcuuaaggcccucuaaaccugguuccuacauguugggggcaggaugacaaaguaacaaaaagcauagauuuuagaggcugcauucugagucuucccuaauugguacugugauuuuuuuuuuuuuuuuuuuuuugagacggagucuuacucugucgccuaggcuggagugcagaggcacaaucucagcucacugcaaccuccgccuccuggguucaagcgauucuccugccucagccuccugaguagcugggauuacaggugcauaccaccacaccuggcuaauuuuguauuuuuaguagaguugggguuucaccauguuggucagguuggucucaaacuccugaccucgugaucugccugcgucggccucccaaagugcugagauuacaggcaugagccaccgcaucuggccuuuuuuuuuuuuuugagauggagucucacucuauugcccagacuggaguacaguggcuugaucuuggcucacugcaaccuccgccucccggguucaagcaauucuccugccucagcugccugaauagcuaagauuacagguaucugccaccaugccuggcuaauuuuuguacuuuuaguagagucgagauuucaccguguuggccaggcuggucucaaacuccugaccucaggugguccacccgccuuggccucccaaagugcugggauuacaggcgugagccacugcacccagccaguagugugaucuugagugagcuacuuaaacuugucucagcuuugguuuucaauuugcaaaaugaggauaauagucucuacuuuggaggugguugugcgaauuaacaguaauauauaugucauauaaauuguguauaauauuggcacauaguagauguucaguaaguggaaaauggugaugguucucaucacauccaaguuuucauucuuguuuccucuuagucccuugccugucuccacucauucuggcugaccacucugggcauuaacccagaaggcagcaggcucgcguggcuuccgcuuccaccagcuugugaugcccuccccucuacuucuuuguucaucuuaggaucaaguuauuuuuuacuggggaaagagacaguggagauccuguaguccaaccccuucauuuaaagcugaagaaacugaggcccagagaaguugagaggugagaccaaggcuauguggcuucuuaaaugcaaaaucagaagcaggacucagggccccugccaugcagcccaguguccuuuccgccauccucugugccucugauuucagcccuacuuggcuuugaagaucuacaucaauuucccucuguucagcgacuucuuccgcaguucccucuccugcaaggggaaugguuccucuccuccaaguuuccagcacuaacuaccugauucccucggguaacugagcuuuuuuggggauuaagucuccccuccccaccuucauauccagcacugugagcuaggggccuuaucccaacugccugcaaguguucaggaaaagcuuuuagagcugacuugcucauggcuugugacucaccuggcugguugaggugagcuuggcucacaugccucucuguggggacaaggaacgcuaucagaaaaguggcuuccaaaggccccucauuugaccaguggguagggggagcauuccuccgucuuggcccugggacuggucuuuggcaucauugagcccucgguuuuucagaucccugaaaagcaggcuccuggaauguuugauuuggccccuucuccccaggauguacagggagggcaccagaccuuucaaccaggcuggcaaagacgcugcaauccaaguaagaaccucagaaaaggaggccagcaaaccagccagccauauaggaacagggcucugacuuguuugagggcaguaagugggcucaagaagagauuguucagccugacaucuggcaaagggacugugugcuguguuggaguccuggggacaaaagaaagggucaccugugacccagccccucccuggcuacuucucauucuuucaggauauggggaaaucucauccucucaacucugaaggacugugacacagucccaaguaggaaagccagcuccaaaaugaucucaaaacccaggagguccugguaccaggaagagaugcgugugugguugaggagagaaagguggacaacaagccacuagggcaguccucacccugcagaaaaagaaaggaugcugugcucacugggucucugcccugaucuuugcuaccaaaaaucaaacaauaauuugggugaugcacauagcaggacauaaggcaggcugcauucacccagagcugcauuacguuggaucugcggagccaacagaaggaaaacccugugccuugcagcagucagugagggcagggacacagggagcagauggaugaggaaaucgcugaggaacuugggagagagccccuuugcagggcugggcuggaauuggccgggauaggagugggcauuugaugugugaugcuguugugacgcuguugcagaaucauccggaccaaaguucagcagccuuuccacccaacgccggauggggcugggacaggagugaccgccccuggccacaccauugguaagagggcucagggaaggggaggaaaccagaucccaccuagagaaaggcaggaaacgcagcuccaccccugggaacugccugcccgcuugagguccagagcccaaccuauuugccaacuccucucaccugagcuccuguccacauagggucuuccugagagauacugguucucuaggacuguucucugccucccacuugugucaccucccucugcccugcuuuagucagucccuauccucuccccuccucuccucucucuuaaguguuuuucuucuagcauuucuucuucuuuuucuucuucuccuccuccugcuucccucucccucauucuccaacaucuuuuguuuuuaucugauucugucucccuaccugugcccucuuucuuuuauaucaacuuucuuauuccaucuuuguuuaacauuccaucuuguucuuaacauuguccucugucuucuccccuuggcuccucuucuuuucucccucugcccuucccucucuucucucuucuucuuagguguagcucuggcucuguucugucuuccuccuuccucauggccucuuuccucuuggccuuucucucuugauugcucagccucugucucacccacucuguaucucucauccuuucuccauccuccucauucuuugagccaugcuuagggccucucaaagacgugacccaggccuacuagaacaccugcuaacacuccuccucuguccccaacgcacacagacuagcuucccucuggcccaaggagaaacuuggugcuacuguagccauagaugaggcccgggguuugaggggcugggaugugguuacauuuuuccugcugcuccucuuggcaguugucuccuucugucuugaccagcagguaauagaaaugacuaguuccagcccuccaggaguuggcaggagcuguuguuuacuaggccaguguuacagugugugcugggagggaggguugggccaggcuguaccugaguugaucaccauagagcgaauggguucacuaaucuugcccuaagggggaaauuaggaguuucucaagugauuucaagaccaaaagcagcugagagagagaaaugcacacuccuggggaacaucaggaccagucuugugucuccuggagaaucagagacagaucuuagaaagccacagacucuaaaucaggauugguaaagacucagcccaggagacugagaacaaugagcuggggcuucauuagaaggguuugcccagccccagggauuggaugagcugugcaaggggguauccaaggagcugugcucucuagaggaccauggaggugcugccuagaaggagacagguuugcuguuuccugggccuguacuccauccgucuuuaggagagugaguuugagaaccccagugaaauccacaggucugcagagaaggccugggguuaaacugggcaccacuuaccucagggcuggacagaagugaauaauagccuguauauggcaaugcaguccccucuuaaauagaccccagaggaaguagaggaaugagaggaacgugggcuccucaucccuccuuauguccucugcuucucucugccccccagccuuggggcuuuggccuacgaucacaacugcuaaacugcuauccugaugccauuuccuccuuccucucauccaguucccagcacggccuccccuccuguuuccagcgccuccaaugacccagugggauccuacuccaucaaugggauccuggggauuccucgcuccaauggugagaagaggaaacgugaugaagguagggaggagggaagagguguggcuuccccuucacaugcuuuguccuuggacuccaagcuccgguuucggccuggccucgcagcugcucugcugugagaucaauuuuaguagcaaagcccagguccccccacugcccugcuggcuccuggagagagggaggguggcugcuaguggggccaucagcuucaccaucugcucagcagccccggcugccucaccugccacuagggcucacccuaucgaucccugugggaugucaggaggagaagcaagaaccguuuaccuugggaagguuuuggaguugggggaacagcuggucucuggccugaggaugaaaggccaaccuaccuuguccuuaccugaucccaaucugucuggaggugagguagugaugucaugugcagccuagccugguguccuuucucuuuaacaccugcacaccgcccccaguucaaaccucacagggagcuggacaugggaccccucucuccucuucuucuccaugaguagaaaugccacuccaaauccccuggcccucucccucaccucccugaaaugccucaaggugcagccaggcuguuaggaagggugucaaagggaagggggaaggaagaggaggaggagagaagaaaagaaauaagggggagagugguagggaugauccugggacaaaguguuuuucaaaugucgugacauugggggucccuuggugaccaucugguucucuucugaugcgugaagcuggggcacagggcuggcagacccugaacaacagagacaccagugucuccggccugcguccugcccccauuuucucaugguucccgcuggagaagugguaaccuccuggccuucagaggauuuuaaagacaucucccaggaaagaggcagaauccucaaacaaugagcauaaaggggugaccaucuaucccauuagcccagaacagucccaauuuaugccuguugucucugcaucuuggccagucagcaucucagcaucucccuuuucucucaaaaaugucguguuuggacaauaaauuauguggucauuccacacauagacaaacccucgguaggggaagccuaauggagugaggagcagagaaaagggacaacacugagcuugccugggcccacaguccaagaucccccagccuaggcugagggaagagagugggagaggccaggcccccagcggaagggacagcguggaggggaggccuaggccugacaagacagugaugaccuggcgcuggccuccuuccagaagcccuaauggccucguuucacagggaaacagcuugucuggcucuauuucuccuucuuccaaaauauccaaaccgauuuggccgccacggccuuugccauucacuaaauuucauugugguuguuuuggcggcggccccugaugggcagggggagguugugggaaaggcccuaagucccaguucucccugaggcucccugugcucaggccuuggccaagcuccuuggcaccccaagugcuuugguagaaucugccucaaacccuaaaggucucucccuuaaccagcagccccuguguuuuuuaggggugagaggcccagcagcccaugggaggccacagauaccccucuguacucucccuuuucagucugaggcuguggccaaguaugccaaccucguggccaaguaugcccucugcugcaugggcuccuguggggcaagaaaggcuggggguagggaggcacuggcaugagguuguggucacccagggcugcgccuggcuggcccagaacagggcgcucuccugagugguugaucgccuucauuguuucuaaucaauucaguucagugaaccuuuccuggacaucaguuucaagaaaggcuugguacuauaggaucccaaagcagaacaagauaugauucuuguccuuaaggagcuuacauucuaguggggcauguuaaacaugugagcucaaagagcagauaggcccaucagauauccuguugcgauggaggucugguggcgggccacaggaacugggcuggggagggaguacauggccaggaagggcugcucuuugaggaggggccugagggaugaagaggagaauguucagagacaaugguagccugaaauucuaucugauagacugagccuugugaccagaaggcccuuuggccagccacugcagggcagcuuuagcagggauagaaggcacaaagagaugugguggacaguaaggcugaggagacagguuagggccacaggauagcaggccaggucuagaccauagaaggaguuugggcuuuuuuuuuuuuuuuuuuucugaaagcaggaguagucugagcaggaagggacaggagcagggcuggguuugggaagcucaugcuccagcagugugacagugaugcaccagggccauguugcaggaagcagugaaagccuucaaagcaagagauuacggugcccccaaguuuccucugaaacauuuaccugcugggccuauccggguggcaagacauaucagaggccucacucuuuuuugagagacgguucuccuccucuuaccaacuccucuugaccaaccccaggccaaauggagauguauuuucccugguggaggccuggccuaugagggagaccaguucucccugaccucccccuccaauccugauccaccagccccuggugggaagggagaggagagagcaaagguagagcuguggcagccccuccuccccuuucccccacucuggaugcuucuaaggagccaggcccaguuugcauuagggagcagcucagaugauuaagaauaagggagauaauuaugugucaagaugauguagcccaacucugcagucaggccaagguagcaaagcagcuggcaggccagucacagaaggcagccucgggcaugggcugcagacacccagguguguccuucagugacugggccgggacugcagcaaaagagaauacugaccaggggacuaagggguguugggaugggacugagcacgcacauuaaagggcuagacccuagagggaauggaggggcucaucucccuccaggaggacccuuaaagacccugccagacuggcccuccuuuggccccaagcacuguggcaucuuccuaggagugucauaccccaagggcaagcugugaaucucuuuguccuccaggaagcugcuccucuuuugcucuggguacaguucggccuauucuucagcucuaacaaugucacggugaugggcauuagugaggacaaucacugcagugagugcuggcauuauuggagacaaucucagcaguaguuauugguguucacagugauaaugcccagaacauuauuggcacuggcacucggaauauggacaguguuauuaguaucugcagcaaucauuucccuggggauauuaggaaaggacugaucagcugugacucuggggaaaaacuggcagugacugugagccuguuugagaccccuucccaugccuuggccuuugagaguauggaaaacacccccugacuuucccuugagaaaugugcuggucaagaggcuuugacccucaucccaagagcccaggagcucccagaaugagacagguagacaguccagauagaugaggaaguuauguucugaagcacccagaagacaggcuguccaucaguccgagaagguagaauccccauucauaucauucaaaaauccucacuucuuagcuguaauuaugggugggcauguuagugcuggauucccugggcccuuugaagggaugccaauucccugaacacugugugagcugguuuauguggcuggaggagagagauucuuguauuucccuaucuacaaucaggcugaaaacuggaaguccuucgccuuuacccaguugcuuucggcuggggcccaaaacauugcuguucaucggugaugguauugaagcgcagggcaguuacacaacuuguccaagaauccaaaugaagucauauggugagaaucugcuggucugugugagggagguguguugggaucauccuuugaggugugagauugcagggggccaugauuuugcauuccauucauuagguguacaaugaauugugccauugaguggugccaagcuggugcaguugugcguuugcaggcagggcagguugcauggcugcagauggccgaguccugucacugccuuuaauagcucccuucugcuuuggaugaagccauaaauggaagaagcaguuuauuuccuuaguuagcuaccauccuagagguccccaagaguguugcucagguuagacuuggagcaaaugaggggauuaagccguggaaaugagaagcaccugcccuugucuacgagccuggcuugaggcagcagaagguugcaaagacucccaccaggaaggaaggcacaggguaggagugagcaugccaucccuagagcagggcauggaugggcaguggggcucagugggaaugaauguggccucuggagugagcacagcagggucugaauccuggugccccucacuaguugggcaagucaccuaaccuucaucagcucaaucuucuccucuguaaaaugaagaugguaauggcacuuccuuccugggggcuguggagaggauuccaugaggucgugaauuuaguguugagcugacuucaucuuggagacgcauccuuguguaucugggaaagaaagccuaauuggcagguuuauguuucaugaggaaaugaaguuguguuagaaagaaauuuauuugggcauaggcgcccuaaccuuggugcagcuccuuguaacuagggcagccuuuaguggaugcugggauuagcuaacccggaugggaccagcgcaguggaggaaagcugucguccucacacccgggauugggagaacguuuguccauuucuaucuguucauuuacucugugguuacccacuugggccacaugucaucuuucagccuccacaggcauuuuagguguguauaaauaaauaaacauaagauccucuucuuuuucuaacaugugggcaucucucccucuauucaucuguggacauuacugcucccacaugcaaguuuauuucuuuaccuuggaaaauguauguuuguuuuauaaacccaaauguaauuuuuuacacaguuuaugcaagugugaguaugcauguguucuaccgcucugaggucuuuggguauaaggggaugggaaugucaugcacugggaaggugugcaguuaccuggguagugugcgugcuuggagagagugccgggugugacugugugagcggggagagcucuaagccaggccucaguguguugagcgcccaugguccugggcacaggcaucacccuaccuucugcugauaaagggaggggcuguccugagccugccuccagggguggccuagggcccaagacuagggagacuaaggcccuuacagccaggcugugagggaauugcagcucagaacccuuguagcccuuagaaggggagucuggucucccgaucuugggauccugcccccaaucuucugccugccugucuuucgggaucucucaguguuugucugucucuuauuugcucuaguugagguauacacugauccugcccacauuagaggagguggagguuugcaucuggucuggacuuuaagagguaugagggccagagggaacauggcgugggggucaagggaaauagcuuggggguggcgguuagagaacauucagagaguggguuccuaagggccagagcauggaaaaggaggaguuggcucaggcuuccacugggagaccuggaggcuaacagagucucagggccuggauuacuuccgccaugggccacugaugggguuugggagcugaggccccgguggccuggagggucaggcacucaguggauggggggucacuuuuucuagcccuuggaaaaacaaagagcagaucggguaguaaaacaaaagcaaaggagaccuggaagcaccugacagcccuaauucaucacagcccaaguuuuuuccuguguucccauuauauuuguuuguaaaaguggaaaucaauuuugaagguaauuuucuggaaagaauggaagggaggugggagggccggauaaggcagagaugguaaaaggaaaaauuuaggccaggcacagcccaggggcagcucuuggcaaggugaaagaaaauugcauauucaaucuccauccaugaaucuuccucacugcugcccgccuccugcuugaaaacaaugaaggcuuuuucccaacgcugggcagggccucgguaucagccucacuuuaacuucagggucauuaauucccugauuauugaaggagaagagaggguugcagcaucgucaauuccaaaggcacccccucaugugaucgggcacuggcugggguuggguggggggcacccagggcaaagugagguguuguuugagaaaggugugaggagcgaggaaaugggggagccacuggacuaugggggaaggaagccaggaggguggaagaaggcagucauuacugcauaccucuguuguguuguuauugcaaauuaaaaguagcauguuccacuccacagcuaucuuuggggagggaggggcaccgagggaggugggggaucuuaucauugcuucuucagcagaccagccguggugucaccgugugaggugacauuugaauuuacaauuccgcugagaaaagccauuaauucacaaauuaacauuucucccucucccucucucuuuaacacucucucccucucucacauggaugugcaagcaauugaaaagacaaaggaaauagccuuaaggaagagacuuuacugcuagucugugcugagauugcucccccugcuuccagauagauaaaccaauuaccugagcagcucugcuccuggccgcccgcgaucgccuccuuuuguaggcugccuccauggcuggauuacacucgguguaucucauuaauguaaaccaggcgugcccuggucaccaagcucucuucccggcucuccuucuggaggggcagugggaggagggcuggggucaguaaaggcaggcaaggaggaccccgaggaagaccagaggcugccacugccuggcuucccaggcccugggcacucgggugcagccugccauguuggcugaggcugaugggggaagucggugggugagcgcuccuuggugggcuugcucugaacugagugagggcuggguauggcugggggcagaggaaggagacagggccugagucucucagcggcauuuugguccagaugcagggggcuggcagaaccagagagggaucugagugcucccugcuugggaagagcuuggagaaguuuugcugaguacacacuauuuuagugggaugggauucagccugaaggagcuuggagagaggcugaggagggcccaggagacuuggcgagguugcaccauauuggguaaacaaaaacccagcacuuggauacaauuaugucuguuuaccaccuaauucuugcaugcacacacaccccccccgacacacauacaugcacaccgacacacacacaugcacacccagccauccgacucuuuugcuagagaagacggggagaaggagugugcucccagguuucuaaagugagcuuacaucguggguagggaauugcagggccucucucugcuuuugcucuccucccagacccugguucagcacuguaagaaggcauuuauguugguagggggcagcugagcagaguuuuugcuucucucucucucuuuuuuuuggaugaaguuucacucuuguugcccaagcuggagagcaauggcaagaucucagcucacugcaaccucugccucccaguucaagcgauucuccugucucagccuccugaguaguugagguuacaggcaccugccaccauaccuggcugauuuuuguauucuuaguagagacaggguuucaccauguuggccaggcuggucuugaacuucugaccucaggugauccacccaccucagccucccaaagugcugggauuacaggcaugagcgacugugcccagccugaguuugugcuucucuaaggagaggugcucuguggauuauuggugggauucuaugauuucacacacuguacuaucuagcacaucacagacucuccccucccuaggagacaggcccuaugaaaguccagaaaccaaaucuauaugaugguaaccaucugucuagacaaguuucugacuuuaacugcauuggcucaaccuauguucauuuuccaacucauacccaaaaccuggcuaagguccacuuaguccaagaaagagcugagguucaaaggucagcacucaccaaaacacagggggaaaaaaaacucauuuaugaacacacauucauugcuaugauuauaucucccuaguaaccaaggaaauuaaacuguucauaccugaggggggagguuuucugucuuaguuggaucacauauuuuagccaaacucucuggguagaguuggccgugagccuguugaauacugacuaugucauuauccagagguagguguagguucugucgauguuuuagaaggaccuuuaucuugggcccugugcauaggugauuuguacuuuuuuuguggggaaguacagggguuuagcccuggcuguguggaucaacauaggugcaugcaucugcauauaaguccuugccuuuauaucagagacagcagccaaaucaccaacuaccuuugcuucccaacuaguuaaugcuguuguggaugaagaauuccaucugguuguuuggggaaguauuuugggauuuagcacaaaagaguauauauuuuuucauacaaugccagaaauucagaauagagaggucaauuccacccuaccaggagagaauauacagaauugcccuagaggagacuguauguguccauccaccgcuggaaauuggggugggcggguguagguauaccacugucucagcaaaggcugucugguacuccugcccagcuccauguuugcacccucguggacgagcacccaucuugucagaauacaucuucaacuuccuagucuuucacuuggcaacuaccuuccagcccugcagguaggcauuguucuccuuucccacccagcaagggcaccaagcaggaaaucugcugccucagcucugcccuucuuccccaagcacaggcuauggaagcaggaaggaggagaugagcgccgaagcuauccccgggcccugcuacuccugaguucaccucccugggcgccucuuccucugcagacaagcaggaagcugagaagcgcaggccacuggaaaaaggguuuggagaggauguaggcuagggagaccccagaucccugccugccagcggaaugguccuggcagccuccuugaccauugcugcccgcccuggagcccagaaaaggaccccuccugcccugccuuccucagagccaugguggccuuagggcugucugggacccucuccauuuugccccauugggguggaaaggcauagagggcugggggagggcugggccuggcucaggggcugcgagacagaucacgagccucagagccaaguugcagccucagagccgaguugcagcggagccaguaauucaaaccauccugacccuucggugaaccugaaccugcugaccuugacagcacuagacaacagaggccucacaaaccucaaccugcacggaggccuggccuucccucccucccauucuuggagcccuguggcccauccuccagguggcuccuaauuuggcugcccccaugaaaugucagcauccccucccucccugaggcuccgccugccugcuucaaagcacccuuugugcucaucucuacuggagacaagugugugggcaucuccugggggccuuuccaggacuggggcuggggcuuuauccugcaggcagagcuuuuacaccuugcccuucucuuucugccccaggcuucaccuuuuucaggaggacuggcuagagugugugugcauguguauguguguacauguguaugugugugcauguguguaagguugggguacacacaggggcagcaguagaaugugauccagacagcagacaaggggagggaagagaagccagaggaaagcagcuccaggaaccugcauuaaaguaaaugcaguuuaugaaguuuaugcuuuccuccuagggagagcuggauuccauccaacagccucccagagccugccaaacagcuccugaagcagaaagugugagcaggagagcaagcgagccagugacagagggagagaugcgcggacacacucacacacccuugcuggcucacacagaucucccucggcccaggcagccugggaagccugggauggagggauggggacaguagguuugguaggagugacuccaggagccguucuuuccuccuuucuucccuccucaccugccaucuccaucucuuuaggcagagugcccagcaugagcccuugggcagugugggcaccuggguggacuggugguguggggagccgagggcacugugggccaccuggggcagccagcuuguaggagccgccugggugagggacaguguggguggucuugggcaguggguaugugguccaggcagcaaaagggaccagaaugcuauacaaaggaaccucuagggacuugcuuuuucuucggaugcuggggauccauuuuucucuggcauuuuggucugaaccaugugggugccuuacagccacugaagauaauuauuggagucuuuuaaggagaaauagagaccguauuuuuuuuccugguaauucaaaggaaauaagugguugacaauguuaaaguaugaaagcucacagagggacuuaaaagcaaguuggaauauuggaguaucuguucuucuggacucuucuucacgugcacaagcacauggguucgugcgugugugcacuaauaauguguaagugggccaggacccuugacuuuagaugaaaggggagugugggggagaaaaugccuggagaggaaguccgcagcauaggccuuugcucuggccugugggcuuggcaccaucauguugcuugccccuauggcuucugcgacauaccucagcuggggacagacagugagaagucuaucucccuucucuuucugggaacuccaugucugcucuauucaaauucuaccaggaacugagacagaagaggaugacagagguagaaccauccagaagcagaggauggggagaagagggcaaaaggauagcgaaggaugcucagaaauugcugacuguggaggacgccuugggaagccaggaggugcuaggcacaggaggcagaaacuggccaaggauggcguugguccuuucuccccccugcucucucccucccccucccuccccucuucccuccacacaucuuuauugguucugguaauagcguugauuugcaugucaggcaaagccuugcuacacacacaaaaagaaaaccccagcccuggcgguguggcagugucagcucucgcuguuguucgacaguguaaaauuaaauuaauaaagcccccaacacaggaaaacauaacaggaaauuaauggccuuuacugucgcucugaugcagucauuugcaacccugcuuuccgcaccaaagacuucauaaaugcaagcaguuucucuaaacaagcauacuuagggcggccugguauguaauuuuucgccuugcuuguguccuuugagcuaacaaagcccccuuuccucuugguuccagagauuucuaacugguucuggccccugcuggagccaaacggggacagcaccaggcagagggccccacccgcucccugagagcccagagaaggcugggaaagggcuagggucccaggagcuagacgcucagugagcccuccuuccccaccagccccugcagcaggccagcaggacugcauaccagugcucccaggcaggaaaguugaucuccucggggaauuccccuaaacccacucaaggcucaccccucuccuuccuccccgggucuguccucccucucccacaacuuguguguucccuuccugaggccucuggccuucaccucccuccuugucgguacccacucuccaccguuccacuucuuaauacauggaucgcacacaucuaggcuggcugugacuuggcaguggggugccacgcucuucuucuccacagguaaccugggggcucuuuuucgggggagcuaaguuauucaaagugaggaaaguaaaugugcugguacaauuccccgggguucuagguuuccuccauaucucccucuucucuaccgguugguuaggaaaugccagggcccuaaggggccccucagacaaucccucuguccucggcaguuuucagugagcuaagaguccuugacugcuuugguguguaaaucgguaggauacugaggaaacugacaccuuccucucuggccucucuggggaucuuuguaucaaugugggcccaggugcccaguguguugggagguaugagaggagcagagaaccgggaugugacucucaggagcuuagagccugcuggggaaggcaaggcuguugcacucagacaauuggcuguucauuaaaugcccagacacauggcuguguguuccauaggaaucuggggaaauggacuagaagggcaagcaggaaauggggcuucagccugggagccugggaguggcugagauugagagaggccuuggcugggcuggauggugacaaggcagagugucagauucuuaagggucauccugucuuaucugccacucaccauagaacucuuuccuccaacaguucugccugaaaggccacagcccugccuggacauaugucagagauggacaguggccauuguuuguuugcagcaucacuuuauaccaagucaugcggguugagggaagaccacgggacgugggauccaaauguccagauguggguccaucuccacucccuacuugcucugggaacuuugacucauuacauaauaucucugaaucucaguuuccucaucuuuaaaauagagguaauggcauuugccacagagaauggugguggugguaaagcucuccauuugacacccucccuucccuauccucccucccucccuuucauccacuccaccuuauuuacugagcucuuggcaaaugcugggcuggguccuggguggauuucagauucucacaugauaugguuccugcccuuggaguucccucaccauccugguuacccaucucagaauucauuauugaagguuaaaguuccucugaaaugaacacugaacuccagagacagucuaaccaaugccaggcacaguagagccuugccacucucccaucuggagacucuacauccauaauauagccuaagauuacauuugauuuuuuagcagccaugucagacucaagcucauauugaguucguggucaacuaaaaccucgagaucuuuuucacaucaauugcuaucaagccaggucuaccccauucugcacuuguguaauugauuuuuuuuuuagccuaaacauagggcauuccauuuaucccugcugaauuucaccuuguugguuuggguucuuaauucuacccgauuaaggucauaaggaugucuucuauaucaucauccaacuaguuuuuugcaaaagaguuauuuuccuugaaaacacaggaaagccacauggcccaccaauggggaccuccuccuggcugcuguaagugaaugaaugcuuugggaacuacugagcccaacagccaucaaucauuuuacuuguuuucaucuuguccauuaugcuaggaaggagauucuugguuaaauguuaacacucacuacuuccacauaauuuccuuaauaaauuauuuuuaaaaaucugguuuacaucgaugagcaaauugagugccugcuauguacaaaguauggcaggacugauuuacaaagguaaauaggacacaguccuugaccucaagaaacuuacaaucuagcagggagguagacauacacaucauuauauaaucagaaugugaugaaugccgugaucaaggcaugaagucauaugaugaacgaaaaaaacaaaggagcaguugcuuccacucagggcaacuagggaaguguuuaugagggagguauuugaucuaagcguugauauggaguaaauaugccacaacuuauuuuugugagugcgugcaagcucugggauaucaccauuuucuuuucuguugcccauaaauuaacuguauaauaauuucauuuaaaggauuuccagagccugauccugaauuuaugauuuugagugucauuugcauauguguaccucuucccccuuuucugacaggcaggauggccuugggcuugucacugccucacccuuucuuugugacaucucagggaucaucaacagcaguuuuaggguccuguguggaccugggaaaguucacugaaauggccagagguuaccugccuggccccucccugaccagggcacuagugcccuccuacugggcucaguuugaagauucuuucauuuggagaagacaaaagcaagcuaagguugagaaguucugccuucucucucaauauuacauccucuucccuaggacugagccaaaaccugccuuucuuuucuuucuuucuccaaggcccuuuuuuguugucucagcuuguucugagcuuuugucuuccugacaggcucaugccacccucauauccauccuugguuaugguccccgcuuccaucugucauguauccugcauaagaggaaaaaaagugacuucuaugauccuaagugcaauacaugcucauugggaaauaccuggaagagauaguaaauuuuuaaaaauucacucacaaugucgucaccaggagauaaccacuguugaauuugguauauuuucccauucucuuucuuuuuuguguauauauaauuuuuuaaucaaaaauugaacaauaccauauaaacagcuucaugucuugccauuuucaccuaacauuacuuaauauaggaccauuuucacauaucauuaaauauucuuugaaaacacgauuuuuuaauggcugcauaaucuuccacuguucgauguacauguccuuuuaaaaucugggaucaucauauuuuaaagcuuaucugugugcaacaacagugauuuuccugaaauguccuucucuuuucaccccucccccacucccacucccuuuaugcugucagguugauuauuugagcuuauagaagcagaauuucauuuuuagagcaucccauccucguggaauuauggucucuuuuagaaucucuugccauggaaucccuggccaugucuuucccccagcauggagcauuuugcuuucuucaguucagauucugcccugcacccccuuccugagcuacugccaacucuagacaugcuugcuuucucccugcauccccaucauuucccuuucaucaguuuuucuuucuuggucagaauuaaguggccugcaauaguggaaagggaucugagcuaggaaccucaguucccauucuuaugacgacuagcuaugugacaugggaaaauuaccuaacuucucugagccuggcuuuugguuuuugucuuaauuuuaaauaucuaagagggaauccaauuaaauucucuucauauuuuccagcuguagaacaugagugacacugaauucagaguagcagccuccuuuguugcuucuuuuuccuucuaaaagguaaaauguugagcauaacaaguuaagaacugaccaaucuuugcuuuuggaauucuugucaacaaaucagccaacauucaugaucacuuucucuacaugaaguuuauaaaguugaaaacuaugggaccccugccuucaaaauucacaguucagaggagaaaacaaacauuaaauaauaacugugauacgaagagauucuaaauuuggcucugccacuuauuggcuaucauaaguuguucuggguaaauuaccuaaucucucuaucccucaguuuccccagguuaggagcuuagcugccagaggcauguugccaggguugaguucuggcuccucugccaucugugaggcguguaaccuugggaaaguuccuuaaucucugcacuuucauuuccccaucuacaaaauggggacaauaauguuuaaguucuugugaaaauuaagugaguuaauauauguaagauuaucagaggagugccugauauauacuaagcacuuaauaaauguuaguugcuguuauuguaaggauuacaucagugcaugcauguuaagcauagugucugguauccaaguagaaacuggaucuguuuuaguuauuauuaguacuauuucuacaauagagguuuggauagauggcuguuagaaugcagagaaaggagaaauuaauggugagggaggagcuaacagcccucuuguauaugucugaggaaacucaauccagaaaagcucaggagauuuauagcaagugagcaacaaaacuaggauuucaauccaggagauguuacuucugguccagcauuguguuagggucacuaguacaguuagugucccuagaggccggugggugugaauggguacagcaagccugaggucagacaggcccacagccaccccagccucucccuauucaugaacucacugaguguuuagaagcuaggcuuggucaaguacagcagguaguuucccagggcuagaaggcugggcagaaccuggucuugccccgagccaagguuugggccagauuuccaaagccuucuucauguccaccucuuuuuuuuuuuuuuuuuuuuuuuuagacagggucagggucucacucugucucccaggcuggagugcaguggcaugaucucaacucacugcagccuccauccccagggcucaagugauccuccaaucucagccucccaaguagccuggaccacagacacaugcuaccacacccagcuaauuuuuauauuuuugguagagacgggguuucaccauguuggccaggcuggucuugaccuccugagcucaagcaaucugcccaccucggccucccaaagugcugggauuacaggagugagccacugcacccggcccacuuuaugcccaccucuugagcuuggcuugggaacuguggccaggccagacucacugaauguccaguuuaaagaugggaggcaauggggcauaucauccaucucccuggacaagcagugucaccauagcuccuuucccagcccggcccucuggagccccuucccuccucucuccuuuuuccuaucuauuccucccucacucccggaaucccacuuuccccucauccucucuucuucccucccuucuccuaucucccuuaccucucucuucauuccugaacacuccuuccuuuucuauccuccuccacucucccuugugacucccccacccaauccaucaauccucccuccucucccagucuggacagcaccugaccucuggggagccaccccauuccucagcucccaaaccucacucccuguucccaguuggaccuccaccucccugguccugcugugccgccguggggguggggcugggccugcacaggcaggcugcccugaaugacaagcggggauauugaucgcguucugaacucagcccagccgauagaagguaauuaaugacuccauuugccucacuaccgaggagaacaauugaguuugaaacugcaacaacuggcagcugggaagacuggggggcagccugggggugaaccccucagaggcggaaguaauguguggaguagcuaggcagagagagcaccuucugagcagaggccaccaucagaacgggcagagcccccauccccagcacagcuggccccugagccccacugcucccccagcccuugaggcccaaggcccaucacccacugguccccccaccuccacgcuuuucucuuuucuucccauaucacuuuuugaggucauuuucugccugcggaugaagacucaguuuucccaagacugcuucuugccagcugugcaaucuugcacauauuuugaacucucccugagccuguuuccucguuuguaaaauugaacuaacaguaucacuuuugcaagcauucugugaagacuguggauaauguguauaaaguaccuugagccugcccagaacacaguaagugcucaguaaaugaugauggguccuugacagagaaggcaaacaugguagaguggagagagcuucagaguccgacaucccugaguucacauccaggcucugcugcuuccuagcugugcaguguugaacaaauaauuuugccucucuaagacuauuuccuuuucuagaaaaugagaguaguaauaaguaccucguaaaguuugaagagguugaugaguguaggugaaagcccuaauaucauuacuuucuccauagacagauagauguuuguauuugagcuuagaaaacugaaguuaguguaauucuuuuuuuuuuuuuuuuuuuuucugagacagagucucacucugucacccaggcuggcaugaucucaacucacugcaaccuccgccuccuggguucaagcgauucuccugccucaggccucccaaguaacugggauuacaggcgcccaccacuacacccagcuaauuuuuuguauuuuuaguagagaugggguuuuaccauguuggccaggcuggucucgaauucaugaccuugugauucaccugccucaagccucccaaggugcugggauuauaggagugagccaccgcgcccggccaaaguuaguguaauucuuugcuauacuuaaauucuucucaaauaccucaucuugcuuccugggauuugaugggcaaccccguucaucccacccugauuuuguagacuuugaugagccuuggugcuuucugcccaagcaaaugacaucauuucauuuucauuuucuuuauuuuucuuuucuuuucuuucuuuuuuuuuuuuuuuuuuuuuuuugagacagggucucacucuguuguccaggcugaaugcaguggcacuaucuuagcucacugcagccuugaccucccaggcuuaagcaauacucccgccucagccuccugaguagcugagccacaggugcauacaacuaugcccagcuaauuuuuuauuuuuguaaagaugagucucgcuauguugcccaggcuggucucacacuccuggacacaagcaauccuccagccucagccucccaaaguguugggauuacaggcaugagccacuaugccuggcccauuauuucauuuuaucuauuaccaccacccccaacugucucuugucccuugcagugacccuucugucccuagcccuguucccaagacaggguucagggggugucucccuccccaagcugcugagaacccacuggacaacuccauucaugacuggccagugccagggcccugaccuggggugagaggugugagauagggcccagcuccagggccacccaggaauagauggggagugagugcagggcugaaugaaugaggagaugagauauuuugguugaggaguaaagacauuuuuaauagugauuuuagaaguagcacauacuaauugcacaaagccuggaugguauggaaaaacuuagaugaaaagaaaauaaaaauugcuugugauugggaaguaaccacugucaccaugccggcagcucuccuuccagucaaguugaucuuugguuuuggaguucucuucguuugccuggagacuaggguccugcugucaguagccccacacucugggcucuggcugggcaggcagccacucuguccgucuauuuaguccacagcugucagggcaccugcccugugccaggauccccagcaaauguccccuugagccagucacuugcccucgcuucaccugcaccucauuuacucugagccucaguuuccuccccaguaaaaagggauuaaaaucccuaccuaccuuggagagugguugggaagcccauauaaccuaagaucuaugaagaccuuuuguuaaaugcuaagcaaauaggaaacagucagauaagaagacaauaugagcuuuguuauccucgaaagaauaaucuaugucaaaguuuugacucagcaguuuguuuaaucgaauuaauuuauuuacauacuaucuguguuccaaaaagaccuguaguagcucacccccuugagagugcucaugccacaguggacagagcaccuggaauggcccaguccugggagucccauuccccaguugugugaccuuggaaaagucacugcccaccccugcuaguuaugguaacaugaaaaauuuggaccagacauccucuaaucaucugggcacagucugcacucagccagcaccugugccacaggcuguagccuccauuuggggagggugccaggcaaagaacgagggaugccgagaggaaggcugugcccuggauggagccaaguggccuucaacugggcccacuguguuuggcacccaggcugcagagugaaaugauuuagagggcaagcucuguacuccgacagaccuggauucaaaucuggcugucauuuacuagcuucauggccuuugacaagcuacuuaaccucucuuugcuucagcuuccuuaucuuuaaaaugguuaucauaguaguucccucacaggguugucggaaggauuaaaugagcucuguaaauaacagcaauggcauguaaugaguucuugauacuugugagcugcuacagaaugggagcugggcagggggcagacggagaaugaggcugaacccucccucuauggggacugacuagcacacggucccuuccuugcucuguuuggucuuauuaaacccacagccaccauauuuuccagccccaaucuaaaaauguggccagagaauggggaagaauacuggaaaucagaauuccuccugaaagcccaggacacaugaccagcagccuccagcccucuuggugcagggaguucaaauguagauguguucuccaggccccagucuuaagcagccucugccaccugcuuuggauggcagcucagcagccccgggguuaaguucugcugcucaccaggaacacaguguucucugucuauugguagaggcaccagagaugggcaggaugguguugcugagaguggaaaaggccugugcgucagagcugaugcuguuagaggcuaacaagcaguggggauagcacaucuuuugcuagccagggauguguggggcuuaccugaugagagacuggguguccuugggugccaggccagucagauggccagucccaaaaccuucugccagagguauggcuuugaaugccacccgggagagucugaguaccuacucggggccauuccugaugcuggagcugcagaaaugcauuagucacggucccugccacaaggugcucuuugacuggcugcugggccugggggcaaaggggcuguuggauaggggaucuucuuugaaauggauggugucuaaucacucacgcgcucuccuucccugcucacuagauuaagaucugcuuuuacauccuagaaaccuagauuaagaucggcuucugcuuccaccucuguuucagcccagcucugccagacagcccuucaacagcugggccuaacaguggucucuuucuuccuccuugccgucccgucugagacuuugcccuuggaaagucccaugccgagcucgcuccccaucuucccgggagaacccucuagguggucagcacugacagcugucuuccuucuuuccuuuuugacucuuccuccuuuacucucuucuucuuuuccuccuccucuccuuccccugcaaagccacccucauccaggcccugggcagagaagguaucaggacacccagucuucagcgaaaguagagccagcugguuuuauuccugcaguaaguguccucaccccagccagcacuuccagcuucuggugcggaaggcuucuucccuuucuuccccuccuucuuucugcccuuccacgccucugggcuuccuccuucccugagcuuauccuccuuggaccuucugauccagggcuucucccaaccuccuuuccucauucccuuccugcccucucuccuugccuucauuccucccuuccuucccuagcugauggaaggaugccacccccuccucuggaaagagcccuugagagccuaugguacgugugguguauuuggagggcuggcuggcugucccccaccaguaaugccacugcccucuccugggcccugcggcucaccucccugcaccccauaaguuucuuugugcuccuucgccauucaucaugacugcugccuuccuucuccuacaggaguucccgcaagccuccuccagccucucugggggguggggguucuccgcaugcuuucaucacaccacuuuguuuuccuucuccucuaacgccuccuuucuccuccccacuucccucuccucugcuuccccgccucccacugccaccucuuccaguagcaggcuuccuuagccuuugccuccuuucccucccccuuccccuccuuugcugccucuguaaccugucuuaccaccagggccugaguauacaaaaaaauaaauaaauaaauaaaaaggucagugaguggagggagcagcaauaaccccuaaaacaguacuaucaguggaacaugauugaucaauugaauuccauagcggcugaaaaaugugggauuaaguaguguauuauacgcacaaugaguugaggcaugauguucauuucaaguucauuucgccggccucugccaccagaucaggcaaucaauaggggcagcagauaucauauaucaccucucugcgggccggggagagagcaccauaaucucucgcaaauuuagagugacagauuugucaagaucugaagggccccugaauaaaugaaggcaaagagacuccuccagccagugaccugaggacaaagcuucaguucagccccuacacacacacacacacacacacacagacacagugagccaagccacacacagacaggcauauacacaaaucuacacagaggcaugaggagaguccugccacacaugcacacacauaaugugugaacacacgcucacaaauacacccucucugccccuacaauaaccauauaugaagauauuugaugcuuuccucagcccugagaguccggcuuccccaaaagguaggagggcuccaggaagggagaaucaaacacaauaggacacgcaaauagcuacagggagugaaaugaggaugauggcacauccugaaaaaagaaguaggcacaggagaaacggggcauguggccucacaguccucaugcaaucacacacagacacacacauucuuucaggaagcuucucauucuauuuccacacacgcagacccuuguuuaucuggacguuuauauauguacaagcgcguagacacgcaauacucacacaaaagggaaaaauaaauuuaccacacuucaacuuucaacucauauguugaugcauacaucccguaagacugaaaugauuccagagccuuaugcagaagaaaccacaaccaccaaguuuuguguucaugggaacaaauaccauugaagcugcuucugucugucuucuucagaugugguccuggucuugaucucugucucucucucccucucuuucucucucuccuucucucucucucucucucuccuucucucucucucucucucucacauacacacacacacacacacacacacacacacacacacacacacacacacacacuuucuuugcuuucccacccccuccagaauagauauggagggaagaugggaggucacauuaggaaagcaaaccccaugcucggucugggaggccagcaagggaggauggcugcagguugaguuaaucaauauguaauauuuucuauggucuccugaaugauacuguaugguguuacuguauauaaugcaauauugauuauaucauaucguauaaucaccuauaaacugauauauauaacauucccagaggaacacccuggggccuccggcaugggcuggccccaggcccaaggcuccucagcuggucuugggcugagggaagccuggagugaccaagcugguaugggguuugggggggaaaccccacuuuggggggcugcaagguguggguucagagagaggccacagagcaggcacauugccuacuguacaccuugaaaacuccaaggaaccgacgcugggaggcaaggauaggggagggcugagaacgccugaggaaaggggacauggagacaggauuggccuguagacucaggggagcaggcaccggugugauaagacucugcucccucuggagacuugcaggaggaaccaggugaccaagaaacuggcuccuguaggaggcuugagccugggucuagguuggagacagaggccgagaaggcggccagggcauagaggcauccacaggggcccuucugugggcucugcccaagcgggagcuuugcugcucuagcgacaccucuuuccucccgcuugguuucccucuggccucaguccuggcccaacccaagcagagugccucagcucugccucagagccccuccucccucagggcgaaguugauuacuucacccagucuccagguuacacucggccucggaaauuugaugguuuucaacccuuggaauuaguggaacugaaauucaucucggagccgaguucaauucuccacaggcucaguaaugccagucugagacacccagcuucuuucuuccccaggcuggcccuggcuugggggcagggggugguucagggagacaugccccagggagcuggcuccugggagcccccuggcuccaccucugccuaauccuuccugaccccacagugugaccgcuccaucucuuaccagguccucagguccuucucuuccuugggcuuccucagccagaucucugaggcagggccacccucuggugucagccccacuggcccaggggcugagaguaaggggucccauaggggugcagagcuccugggcccggaaccagaugcccaccucuuugcccugcacuguuccugugccucugcuggccuggcgcuaacgccccgaguguccauguguucuccagaugugucugagggcucaguccccaauggagauucccagagugguguggacaguuugcggaagcacuugcgagcugacaccuucacccagcagcagcuggaagcuuuggaucgggucuuugagcguccuuccuacccugacgucuuccaggcaucagagcacaucaaaucagaacaggugaggagggagcuuucugcuugcagaaguagaaaggagccggcagagcaaggccucucaaaaacuuguucacuaaacaccacaugcauagccagcauuguauguguuacacacguguguucugugugugugcagugugaacaggcucacaugagacaguaugguaucguuaagacaaaucauuauggucuguauaugguaauuagaaaugaguucugggugcaagaguauggccuuggguaaaucaucucuguucagagccucgguuuccccaucuauagaaugaagggcuuggauguaggguuugucaagucccuucuagcuccgcuuuucugugguucuugcauggaguacucaggaacauccucuugcugugucccuugcccacacccccucaggguccuacagaaagucuacgcuagacuggggagcucuccuugcccagugucaggagagccugccugugccugccuccugcuccccaagccagcaauucaauggaacccuagguaggcuggcagcuucccacuuacacccaacacuuucugcagacacugagcagcccaggacacauagcauggggcacagcauguaacacaccagcaaaacgcacaacgcagaaaccaucuccgaacuuuucuaugugcuggugugcaugugcucacacuccaccauccaccugcuccccucacccacagcccaugguacugugcucacacaccacuguccaccugcucccccacccacagcccacgguacugugcucacacaccaccgcccaccugcucccucacccacagcccacgguacugugcucacacaccaccgcccaccuguucccucacccacagcccacgguacugugcucacacaccacuguccaccugcucccccgaccacagcccacgguacugugcucacacaccaccgcccaccugcucccucacccacagcccacgguacucacagcuagccccggcagccgcauggagccagugggugugugcugcccccagaucaccagcucagcauaccccuagcauaugccuccacccacauacgcuggguggagcccccagcacacccgcucccacacaggggcacacucccaucccugcuacacaugcagcccaggccaggcccacagucacagcacaagacagcauugcugugcuugcaugcaugcacacacgcacccacacaugcacgucagugcagccccacagcguugaacgcuguaguuccacucuuaagacuccaacagcucccagccacucgccuuucuccccgcccguccuuuuaucccauaagcuguuugucuucauaaaacaaaaaucaaaagucuuuuuaaggugcccugagccauaaaccaacaaaggaggagcuggccgaggcgggcggcucagugcacccucccugaguccccgccuguauuacaaugaauaaccuuuauuuacuuucauuagacuauuaaacaccagcacagucauuuuucccccugaaacucggagcagggcccauaaagcaaauccgaagccuaauugaguucauuuuaauuucucuccgaucacagcgaauuacucuggugauaaaucagggggcagcuucacccccaguagaaggccuaauuugcagcuaauuacaaaacugauuucuacaggaagaucaauacgagaaggaauuggaaaugacgaggcaaucccguccagccauggaggggaggggguacucuaggggggccaggaagcggaagggaaaaaaacagacccgaaagagcaggaaaucaguuuuaauuuaacguaauauuaaucagagcaacuuuuccugcuuugugcaggcucccggucugcccagcucuggggucuggcuuggccguggcugcaauaaaaaggcaauuacccgaguguuucaggcaggacacccuuucagagucaaugacuggcccccuccuacccuucuguuagccauguggacucucccccuccccaauuucauaccccagugcacaggcagacagcgaggggcccauggggcugucauuguuuguuuuuaaaaaaggggcgcccauacccgaucagccagcagugccaggcugaaggccccacuaggcccuucucccagcuacuggcucugccagucaugucaugguucccccuccuccccaaggcuccucgacaucccaugccucucaacaaggguauccccacuacuacacccuacccgcaggggugcuuaggcaggagaugcuacagaaacauaaagggugcuggcauuaagugcccaaaauguguaaagggugcugugccuccgguuucaccaagucaggucuacuacccgcacaaaacuugccaucauccaccaagcccccgcaucuccccucugccccaccaucucuuucuaccccaucugggcgggcuccccuguuccuccuccccaucugcacaccgagcccuuucucugugcgugcaucaauagagagcugucacuuuucucucuccucccaggggaacgaguacucccucccagcccugaccccugggcuugaugaagucaagucgagucuaucugcauccaccaacccugagcugggcagcaacgugucaggcacacagacauacccaguugugacugguaagggggcuuccaggagggugggggcacugcguucaguggagggugccucagcccaugccaucugaggcccagugugaggagcaggucccccaccgugauauuuacagagagaacgaggcuucuaaaaccagggugcuuccugaacaggggugugcagauguggggagaaaaaaacuggggucagggcaucugugggcuucaaccuggaaaggcugaugcuaggaggggcuguugccaguucuuccuccuguccuucgccucucccuuugucuauuucucuucccucucccaaguugcccagaaucaugagccucuuguuaggaugucugcagaaagcaaauaagccaggcuggugagaguggagcauggguacccaguguccagccuccacacuugggucuccaaggcuccugggggacccgcuuaccgcucccuccaggcagcaugggugaucauggcuuugggcuugagggcauggcacccagcucuguggaguuugagaugaguacaauuauuccagccuuccuccugcuucccagagaggucagugacaccaaggcuugauuucaaggccagguaggaucaggcuuggcccacaaucaaaugcagagcuaggggcgccauggccaggagccccuacaaaugaagagcagcagggccaguuaguuuggaaggggagguggaguccagggaaggccgcagagcuccaggcuguggaaugcacgugccacugcagaaggguuuccaggccaggagacugcccaaaugggagagacacgcauugagguguuauuaaaauucaccuaauuauucuggagacacuaaagccaaugugccguuuguuccuugggagacaggaugauugagaagggucucgguggggauugggagacacugaggcguuaccugcagagcgaggcaagcggagguggccugcggacccagcagcagggcugcagagccagcggcaaaggcagggaacaggcaccgcccacucuaggacugggcccugguucugccugugagcuggucugagugcggcugcauuugagccugagcugggcucaguggccacccagccuccaccugggggcuuaggagagcccugucaguuuucccagccucucccuaaggggcuguacugguacaacuguuuccagccuagaucuuuggcuagggagucagagguugaauucuagaaguguuggagaccuggacugggcuuucgggagugacgaccuuagcuggguuagcugggccaggacacagcccaugaccaaauggcccucagcaugagccauccuucgcccagcugggaagcucucugaccugcuagguauucugacccaaggcagagagacggcccaggccaggccaccuuucuccugaccugcucagaaguacaguggucacuucccaaagauggccacuccaggcacuguucaaagagaacccgggagacuucucuaaccccaucugcugcccagcgcucaggccauagucuagaaggcaagggcuuccuaggguggagcuauggaucuucaggguagggcuccugccacaggagacccaggggcugguacagagaagugccuccaccuugagcagcccccacccgccucccccccauggcccuggaacagucccagcucagccugggaacaucuccggcugauccaucuggauccaagugugagaaaaguucauuucagacccagcuugacauucccagguggcaaguuagcacuaacaucucaaucuguaugcgacauuucaaucaagcgaggaguaacaaaagcagaaccauuaacauucggagcuguucaccagugguaaugacggggaaacucgcucagaaacuggaaauuaccaaaaagagacaaguguguggagaggugggggagggaagauggggauagggguagggaaugauuuuuccacacuuaggccaagauccacuguuuggauuaauagugccauuacccaagaaagagcugcagauuaugcucauucuuaaaauguuuuugcuggcaauuaaacugcugcaguuauugaucuuuguugauuuuauguccuccuaauuugcauaaucuauuaaagaugaaugauuuaugauguguuuauuauggggacaaacagaauuugcuagagguacugucaaggugagccauggggcauugcucagagacuccauaugccaucucagcaguggguccagcauguuggccuucaggccaggauauuguggguaguagugagcagugaugcaaggagaacagaaacaggagaguggacuuugggugaguucuucuagaaagauacuggcaucugugagaacugggcuccaggcagagcuggagugcgggagaggcccuuaguguauuuguggacacugaccucaaagagucuuuaaaagcuuauuuucuuggcaaauauuaagggcuuuggugggagaagagaaaaggaggcucuuuuagguggguaggugauucuggggaggugugugcuaaagguaagggagcuguuaggucacccagugcccauagccuggcuuaggagugccgagguguucaaggagcccucuuuauccuccacgucucaggcacccugcucaucuucuuccccaggacugacagcugcggcugcaaaccuuaggggaugagggaaugcccuagcccaaccugaaaagccagaccuuauugagauuccugccaccuccuggcccuggaggcugauuucaaacuucaccagccacuugaugcagcuauuccacaaggucaggacugagaggagagaggaaccuagacuauuguguggaggggagaguggggcccagugggccaggacacagcuaaucacauugcaagcaaggguggcugccggaggcuagggcucagccccauagccuccccuccccaccuuccaucagggaaccgaggagagagacugauuuugcuggguaguguuugcaaguucugccgagauuuuaauuucacugcaucacaacucagcaagcugccaagucaagcugguuauuuaaauuuaucacccacuuucccuuccgccgcugggcugcucuagcucagcggcaucucuucucuccagcccacggcucuaggcugcuggucuggaacggagccucgucucuccuaagugauaaagaaagagggaccagcuacaugagagaaugggucacgggcauucuggccccaggcuuuuucagguuggcuggcuguggcugguaccucucaucaccuucuugacccuccaaaggagcccagaggggcugccauccaccucucaguagucccagggcccuccgggucagggcaucugcagugaggacucgcuccaacugcaugcaggaggcuucauuccuuaaagucucccaucccuggaagaaaagauagucccuguucuccauagcauucucaccuugacccccccuccccaugucuggccggggcuccagugacaaaggagcaugcagagacacuggcagugauguugaucugggaggagaagaugagaacuuacuccaggauucccaaagucacuggggauguuucugagcauuagagagucccuugacacagugcaaguccaccccgaaggagagagcccagaugcaaggaacagugcuggagaagucagagacugugcaguuccaugcucucuagaaaaggguuggccaaucuuuuggcuucccugggccacuuuggaaggagaagaaauuacuuaagucacacauaaaauacacuaacacuaagauagcugaugagcuaaaaacaaaaacaaaaauaaaauaccucauaauguuugaugaaaguuuacgaauuugcacuggaccacauucaaagcuguccugagcagcacguggccugugggcuguggauuggacaggcucgcucuagaagcuagggaaagcaccagucccuggagccacugcacccacaggcuucacuggccucuagugggcauugcugccgcgcacuggcagagccuugagcaagugcagcucucaccgcccuuguuuuagucacagagagguaaaggaggaaugagauugaugucugggacccaggcaggcuaccucaccaaaacauaacugaauaaaauauaacaacaaaaauguuaauacgcagcaaaucucacucuuuggugccagaaauagaggggaacucaaagccagaucaguauuggagaggccgcuggcaucacacuggagggagaugcugacugggagaggaugggguuguaacacaccagucagggaaugugacuuugggaaucaggaagccagaacugaguaucauccugcauaaagcaaggaacagaacagggaccacacuguccgugaaaggcaaacacauacacucgucugaguagcccagggaaacaaggaagggggcagaauggaaggucaccaugagacauggagacgccaagccugaugccagaucagaguccaaauuuauaccaugaguauguugcaggaaacccaagccaggaacuuacauaaaaauuuguacaggauaguaacccauucugaaaccucaccaggagcaaugacaaaccuucuuuguagagacauucuaaaauccagggcacaugggacucccacagggggaagaaaaaaccccaccacuaaugaugagcuuacuguaaaaaaaaguacacaucucaugugaauacaaacuuucaaaagggaaaguuaguagaagcaauaaacagaacaguuaacauccccccaagaccugggaacaauagaauaauccaaaagugcuauaaacucagcauguuuaauauucuaaaaaagaucaaaggggccgggcgcgguggcucacgccuguaaucccagcacuuugggaggccgaggcaggcggaucacgaggucaggagaucaagaccauccuggcuaacauggugaaaccccgucuccacuaaaaaaauauacaaaaaauuagccgggcgugguggcaggcgccuguagucccagcuacuucggaggcugaggcaggaauaucacuugaacccagaaggcagagcuugcagugagcugagaucgugccacugcacucuagccugggcgacacagcgagacuccaucucaaaaaaaaaaaaaaaaaaaaaaagaucaaaggaaguaucagcuguaucuuuaccacagauccagaucccccagucccuucccaccacugcucaccaaauugucagauaauggagaucaaaaagggcaaagaaugaggaccauaccuauagauuauugcuuugggguccaggaggcauggaaagagcugagccucaggcaacucugaaaguagagccuguuccaggcuuguccaggcucccagacugcuaagccucagcagaaaaucuuauauuuucuuugagaaaaugucugaacauuagagagcuagagaugggcacaguaccuuucuccccaguggggugggggcaggugggaagccuccguagcuuccccauccugguugggggaaggugguuuuauucaagagcuugggagaaaugucucuuaauugcugaagacugcaguuuugaaggaagcuguaauuaagauccaggaagagauguggaugcugcccaagagggaagugcccaaggcaggaagagggagcagaagaggcuggucucccagaagcuggcugauuugagcagagguaggggaggccagagaggcaaaguucacagcuggacagcagcagggaccagugugagcaguguggauguagcuucugaaaaggguugccaacucagaagcucggccuccuggcccacaucugagauggucagcaaaguggccuuuuagcagauagagguguggacccugggaaaccuccuccuccuacucagggcauccugaggaccuccaggaacugccucuuuccuguaguuaacaacccccuuccaaugcaacugcauuucccuccauaaaacaaacagcuuagcccuuggccagcccccgggggaggagagggcaauaaagacugagaaauguuucucaaggaggcugggagucuccuagucuugucugucagcucaaagccccugauuagcuagaggaauuuagggcacagacaucauaguuccucuccuugaaaggagagggcuaagacaacuucagacguguggcaagucagagaucccuuuacuguggaggccaaagcaagccagagggcuguuccucagugcucacaugcccuagacccuuccuuuaggcugugagggucccaagaaaagaggcuagccuccuucaaacaucccugagucugcuggccacauccccaaggaccuccagcccccaaccucagcucugauuuaauuaugggggcauuuccauagcaaugagacauugacagauaugcggcugcucucggccugcagccuagggagucauuggaucaggccucuuucccuuccuccuuuauccaguccacugauagagguaaaggauauggaaaagaagaggcccuaauccacugucgggaucagagucaggccauauuugaccagaauaaaagcugugccaccucaaucucaggucccaaucccauguccuugucugugccuaccggccacccugugcugcugggcugcccuucccaggagggugccauggcagaaguacccuggcugagaauggggcugcagagggaggagcaucguagggagggugacaaagguaggaaggguuuggggugucuuagcaaagacguaguucugguguuuucuacgcugagcucaaauuuggcccuuaaccuugggccuuucuucuuaccuccucccuucaucucuucccucuguccgugaggcccaaaaaccugaacaugccaaauggagugcuuauuccuccaaggauggccucacuuguucaucagagaucagagagagagagaaaggggccagucugaauuugaaucaaaauauuuucuaagaaaucaaugaucuugcuaucaagugcauaacaauagccaacucaggccaauaaaggauugcccaguugagaauacuggccacugcuuucaugauucgucagguuacgggacccuuuugguuucuguagaugucauuuagauacuugaugugucccacaggggaauucuccaaaaaagagaucucccagcacuaagcuuuuuaguccguuauuugguacuuuuuaagaagaaaauguuggcuaaguaaaaguaaggucagucaacccaacauuuuuugaaugaccggaaauccuaaagacugcugucccaaugaaacagguauguauugguaccaagggcucagaaaugucucaguggccucaaagccaccuaggcaagaccugaaaaccuguuucccccagagggccggccaccuccaaggugacaggaagaccccccacuuuuuucccaggguagccagaaucccuuccaccuccacaauuagcuguagccucaggacaaacaagcuagugcuuuugcaacccugagcuuugggagacaagcuccgccacuauugucacuucugagagggcuuugcaugccuucagccugaauccuccccucuucuccccaguggugguggcggcugggcuggcaggcagggaaggaggaaauccugcagggcucggagaacagccuaaugcugcagaggcuuaaguggccguuuuccuugggauuaggguuucacuuacacagagcgccugaaaaacacugcgcuuuuggaaggauuagagcugacaauucagugcucucagagaacaaaauaaagccagagaggaacugggaggccuggaguaucagaagacucugcaaacaggcuuaaccucugcccacccagcaugagggucucucaugcucugagcccaucuuugagccugggcccaaccucuugagugccaguaccugcccaacuccaaucuucauuugugauuugcucauggagccagagaaggcaacacagggacguugccuucuggaaagaggacugggaaguugccaacugggaagaggacuggaaaugucuuccccucucucugagccucaguuuccuccuccguaaaacaagggaguuggacuagaagauauccaaguuccuucucagcccuuugaaaaugugauucuccccaacauucccugguguuauccuaggaugcugaagcugcauuuccauccaugguccagcugaauuagaaggaaaccaccuccugugaggcccugagccaacaggcuacacagcccagaggagggcggggugcugggagaagggauggaaacagcaugacugguuguguccggccgguuggcugucaagguguagaccucacuaagccccugcagaucuggguaacaucccugccuaggacacaccagggauucaagguggcagugggagcugagaucaacuggaagagcagccacccugaguuggaggcacagcccccucugcuggaaccuggagcaggcaagccucaggugggguauggggcugaggccagagccuggggcugugggcugucccauagucccuucugcccuagaggacaacucaaauccugggaggauuuggaagcuugggaaauaagaaaugaaaggaaauauguagauaguuauuuuccucuccuuuuaaaacaucuuguguggauuuaaaguuuguuacuuuaguguaauagauauacguugaauuggucauaaggugcucguaauuguuauaguaaauaccaauuaugcauuuauauauuuaggcagcaauuacaaauuuaauaacuguguauuuuuguaaguauuauaaaugccuaugucaaaugcaggcauagacugccagccuugaagaaaucuaaugucuucauuuucgcuaccuuaugagaagcagacagaacuugaggauagggcaguaaaacaagaguuauguuuucuggccuuaggguccuccgcagugucaaguggguagcaaaagugcucauuuucagagaaagaugcugaggaaaagcaucucugaacuccucgauagaacuuuugcuauauaaaucuaugucuaauaagucucaucugagccaucaugagcagcaguuucugcuucuuucguggcuuccuuuuuauuuccuugaucuucugaaugcugacauuuuccuugacuugagaugcaacucccugcuacuucacauguuauuuugcugugcuuuguaucauccuguuuauugauacaauucaaguaguugcaaacaaaucagugucuuaugccaaagaacggggcucuuucacuuuuuuauaaacagugcuuauuaaucuuuaagccauauuuuuugagaauaugauaaaagucauguaccaucuacacagaaagauacagauauacaauguccauaacauuuuauguauagauuuauauagaccccuugaagugaucuauggguucuugagggaucaguuaaccccaauuuaaaacccccacuguaaaaaaguggaagaaacugaaacacauaagaaacaagaagugacaagauguucuguuauaggaaggauucacuuagcaugaucccauauuacuuuccuggaccaaacaccuaucuauuuucugggucugcacuauuugagaacaauaucauuccaggaucauuucccaaguauacagccuguucuguaauccaguuucugccaucuacuagcagugaaaucucagacguaauauuuggccccucugaguuuauuucucaucuauagaauggggauuaaaggccgggcgucguggcucacccuguuaucccagcacuuugggaggccgagguggguggaucaccucaggucaggaguucgagaccagccuggucaacauggcaaaacccugucucuacuaaaaaauacaaaaguuagcugggugcaguggcaggcgcuuguaaucccagcuacucgugaggcugaggcaggagaaucacuugaaccugggaggcagagguugcagugaguggagauugcaccacugcacuccagccugggagacagagcaagacucugucucaaaaaaaaaaaaggggggggaguuuaaaaacauaucaauggcuggucccaguggcucacgccuguaaucccagcacuuugggaggcuaagacaggcagagcaccugaggucaggaguuggagaccagccuggccaacauagugaaaccccgucucuacuaaaaaauauaaaaauuagccaggcauggugacaggugccuguaaucccugcuacuugggaggcugaggcaagauaaucacuugaacccaggaagcagagguugcagugagccgagaucgugccacugcucuccagccugggugacgagagcgagacuccgucuuaauaaaaauaaaaauaaaaauaaaaacaucaacaucauaggguugauaugaagauuaaaugagauaauacaucauauaaaauguuaaggacaccgcccagcauauagaaggugcucaaugaaugcuagguaguccuggcccaaguagaaacacagcucugaccuugaaucuuagaccugauggugaaaguagcacaaauuaccugaugacuacaauuuuucaacuuucuuaauaaagucuuucacuuugcuuuucucuguacuuguaaggggagcugcacuuagauucuccaaagcaguugauuugaucuggcccauuugguaaggaaugucugacgaaagugcacugucugaugcaguuguagugauugcuguagaaauuggcuuuagaaucuucagggacuucugcaguugaacugagaagacauccucaucaaguacagugcuuugaacacuucuggggacuuuaagauucuccacuaccacuguuucuugaagacccucuuuguuuuucagaaaacucucacaggagauuaauacuccaccccauggaguuuuauuauagacuuuuggcaucgggauuuuauucucugaguccuuuuuauccacagccaugacgauaugagacuuuguuugucagaugacuucuuuuccuuuucuuuggcucuuuuggggaguaucuggcuucguguuauuaaaaggcagugugguauaaacauggcuucaaauuuuggcuguaucauuuacuagcuguguagucaugggaaaacugugaugcaucuuugugccuucauugucucacccuugaaacaaggaaguuaccucaucaucuggaaggcuauucaucuuuaaaaacuuuguaaccuuggccaggcgcgguggcuuaugccuguaaucccagcacuuuuggaggccaaggcaggcagaucacuugaggucaggaguuugagaccagccuggccaacauggugaaacccugucucuacuaaaaauacaaaaauuagacgggcaugguggcacacaacuauagucccagcuacaggcuaaggcaugagaaucacuugaacccaggaggcggagguugcagugagccgagaucgcaccacugcauuccagccugggcgauagagcgagacuucaucucaaaaaacgaaaaacaaaaaacaacuuuguaaccuuggaaagcaaguguccaacaugaaaugcccaucuucuuguaauaauaugugggguuuuguccauuuguaauuucugaugcuguuuuuauguuacuggccauugucauugagcaacaaaaauccucuacugcuuucuguuggguggcacauauuuuauaacugauguauucugccacauaacuguuuucuccuuuuucugugcuuuugcuuguuuguauaaaggaggugcugugcuguuguacaguuuuagagucugucugcacucauguuuuuccauccaucuauaguacagcaaggcccagugcucugucgauucuugcuugcacagauuccauuacccauucauauucuuucacuaaaagaggcuugcucaaagaaugcugcugggcaaaugguaugacagucuuaguaauuugaaaacuuccugcaguauguguuuuccauuauugacaaugguguuccagaagaauauauggcaagaguuuggucaauuuuuucugcucuuuaagugucaccugugugcuaaugaagcaauugagagugcuuuguaugcaguggccagcaccuuugcuggcucagggguccugaacaggguacuccuuuguggagauacugguguuauagacuccgcagcagcaggugcacagcuguaugcagaacacgaggaagcuugcgugcuuuuuccuugucuugggacucuucuuucacguuuuaaaaauuucuacauggcacugcccaacuucaguuuucuaaauagaauuuggcaaugugccuuucaaucagcuguucagugggugacuuucagcaugcaaaaguuccuaccugagggaaguugccauuuugcaagacagaaaggcaguagaaauaaaacuuuccaauaggacugcauccagguuagcuggaaacaucuuucuaguuauccagccugucuuccuuccuccugaagugagguaggagauuccgugacaaaaccuuagauuauaaggaauucauggugacagauugugggaaucauaaaacugaaaaccagaauucagaugcauuuaaauuccuguuuauuaagaaagaggcacaccccuuuuccugcugcuuugcagacuuuaugaugacagggaaggaggaauuagguuucuauaucuguucagcuucaaaacuucugcgucuucccuaacucgauccuguccugggccuuucucuuuuuuuugaccaauaaaugccauauuauuaaucucucuaggaauugauuuugauauugcugucauugucuacuucagguccacuccacugagagacagucaggaggaguguagcuuucaaugacaacagaagucaauaaaagaaaacccacaucaaagcaaacacaaauccuuuauucugucucucuaggagucaaaagugaucucuuguuuggcaguucuacucugcuuguucucgaguuuuaggaaaugaaagauauuggcuauauuagacagguauagaggaaagucauucuauugcauaauaaagucacaauauaugagucccucacuguaaaccucuuaucagccuauaaaaaaucauaaucuauuguuuaaauuguuuuuuaaagaaaaagcauauucuaauauuuacauuuuauccaagccuuuacuucuuuaaugagaccaauauacaugaaacaauaaaaaaaaugauaacccaucaggaauuggcuguuaagugcaauagauugauggacgauuaaucaacaaguguuuauugagcaucuaccacguucucaacuaugcaggauaaagcagaagacaggguccugcccucagguugcuuaugaucuguuugaagaagcaagcuaugauaugaaacaucagggcucauauauuaugaaauauaauggcaugguaaaccaugcagcacagaugcuguagaaguuuggaagagagaaacuucccugauggguagaaugguagggauuuuaaggcuucaguggggaaggagaggaaaaccguaaggaagaagaaaaggucauggcaaaagcauaggggguucacaucacacaagccaugaaaacagucaaacuaaaccaggagaggugauaaucuuaaguuggauggagagaguaccuuagcagcuuuaaaagccacagaguuucauuucaaacuauagacuacagggaaucaguaauaguuuuuacaagggaaguggugugaugaaagcaaaguuucaugaggacuagccaagcagccacauuuaggacagacaggaggggaagaauguggagucagggaaugcaagcaaaaauauucuguggcaaaaagaaggugcuuagaagcugagcuaggaagguaguggaagaaauggaaauugagcagauguaacagacauugccaaggagaauugacaauacuuggugacugacuucaucuagaaugggaggaagaaggcuaugucaagaaggacuccaaaguuuuuggucuuaugauauucaagaucauaagaaccgacagagggaagaugaaucuguuuuuauuccaguuagguuugagguaacagagggacagccaaggaaaauguucagcaggguacuagaaaugcaaaaaccugagcuguagcucuguauagcuagggaaggauaaaucacucagacgugucaagguagggaugaggaaacucauacagcucuggaaugcagggaggugaggccaucuucaaagggagaguagcaaagagagagagagaugcuuuggaauagccauugggagaauaaugacuauggcccagcugaugaaaagaaagugaacgggcccagguaugcauaguucuguuacuuucuccagccaugccuugccuucccaaggauagacagaggcauuagaguaauagaguggcauuggcuagugaggagaauaaggggaaucuggagggguuaaggggguuccaggagguccaggagaggauaaagagauuauggcagaggggagaaagcaaauuauuauuagagaucagagcaugcuaaauugcaaagggaggugguggccccuucauagccauggaggaugcaggcaagguagggagcccagucaugugcagcugugucccagaggacaugucgguggaccagggguagcacccucaucuugacucgcuuugucucccacccuccaggcuuuagcugauagagcccuccagggacagaaguccagcagcuggugggggagcagauuuugcucauuggaacuuuaucugguccacuugcacuuuuggcucaaagcuccugauucacuucagggugguuuucuaucauguaaaugccauaaacacuaacagcaaaauagcccacuggcugccccccugcucuccacaccugccaggaccaggaccugcagcuccacuuggagaggacaaggaauagccaucagucccuguaggggugauggugggguguccuccaagccugaaggaaagaugggguguuagggagaggaaagauaagcaagaugauagagguccauuuggcugcuggagagaccacagcugaauaucuugcugagaaggaggaguaaaaccaggucaucucccucccaucuccaucuggguuuggaaugcacagagacacaggcaaaggcagauacacacacacacacacacacacacacacacacacacacacacaaauacacagagacacaaagagcuacacaaaacagagaugcguacacacagcugaucauagacauuuagcuuagacacaugcaaaggcacacucagauggcgcauucaggugcacaguggcacacauaccccugcacgucugcacagagcucuuuccucuccaagaguuuccucuccgugcaguacccuggugugaguagaggcaggccccuuucuuccaggccucaccccuuccccuuuguguuuuuccaggucgugacauggcgagcaccacucugccugguuaccccccucacgugccccccacuggccagggaagcuaccccaccuccacccuggcaggaauggugccugguaggugacaaugcugcagcugccuaaucuagguggggggaacuaaauugugggugagcugcugaauggucuguagucugaggcugggguggggggagacacaacguccccucccugcaaaccacugcuauucugucccucucucuccuuagaggcugcaguuggucccucauccucccucaugagcaagccggggaggaagcuugcagaagugcccccuugugugcaacccacuguaugucauggccccuccacagcgcccacccacccaagucugugcccgaggagcacucagccucagcuccacccucagugcccagcccaccccagccagcugacacugcuuggaagagccugcccugguuuccauggaaacuuggagccaagaaccauuuccaggggcaugucagucacucagacaaagccacccugguccacaccaagacacaagggaagaccaauguugagaaccaaccccaaccccaacccagagacaguagggagcuagucccuaagaggaauggaggucaggcugcggcgggaagcagggagagucgcugcagugagacaggcuagaacaccccuauaccucuucagaggcacccagccuuccauugcuucccuggggcucugacccaucccuaaucagaggaguuggguuuggguuguuugaaucagagagacagaggcuguauuuaaggucuggugacugcagcuggagguuguacuauaccuaaccccuaaccccagauugggagcagggucuugaagccaaagagaguugaaguuccuaugugcacaaacaccaaaacacucuugucuuaaggaggguuagacucacucagccagcaacucacucccucuggccgcccucuauguggccuuucccugaaguucaacucucauugguauggggaauggggaggauagaagagagugguuggccccauccauccagggacauuuagguauaacccuggguaagcagagcuugggguaggggcagcggcaaagagggagauugcugcugggucuuauggacuaggggcugaagggaguuagagguguggguaaagggauuccugcccagauuuaggggaaggaaaguagaagccuuguugggaggcaaggagauuuuagggagaaacucccagcagugagcaggugggggcuggaggagguuuuaaagagguggggugagggaagaguggggaggugggggcagggagucugcagggagguggggaagaggggagccgcagagagcucguggugucgaggggggagucguuaaacagaaucuagugcugaugaggaaauuacacuuguuucauuagcgauggggaaggagauagcucaguuccucuuggucacaguugagcucagaagcucauuauccugcugcacgcaugcuuucccuccucgucaauaaacaggcuuuccaguggcugcaucccccacccccaccccagcucccucucagagaggggccccuucuccucuacuuaacccgcgguuagggaucacuguaaacagucuggggucaucacacaggagaaagggcgagggggaaaccuggaggccuggccuuucucccgcagagggagggagguagcuuccgacgacggcucccaacccacgggcccuccgcucaccgcuagcggaccagcgggcaguccaccugcgccgccuccauccccugccgcguagcccacgcauccaaccucuugagggaaaggcgggagggcggugucucccaaaagagcucccaccucuuguguuggcacugcacauugaugccauucuuaggacuuucugggagaaaaaugucccgaaggccuuucuucgccaccgccccccacucccauuuccacccauuaggggccaugccuccuagaaccggaguggcaucuauaaaggcccuggcccccagcgcgacaggguggacgcgccccaauacaaacccuucguggguggccgcgagcgccuccgcugggaagcccugggcgggcaccggcccacaggucccgcccgugggugugcgagcgcgucggugccucccgccuccccgggcucucuccacgcggacgcggugaucgccccaccuccgcccggcccgcccgccacggccauuacccugcccgcgacaccugcgccugagacccggcgggaggagcgggcggagaagccaccggccggacucgugggguccgcccuggcuugcaggcgucugauccccacuccccgacccucccgcagggagcgaguucuccggcaacccguacagccacccccaguacacggccuacaacgaggcuuggagauucagcaaccccgccuuacuaagugaguacgccaccuggcuggccggcggcucagcgcggccgcgcggcuucugggcacggucccacucccggcgacccgaccucuggggacccggccgggccagggggacaggcuuguuagugcagcacugaggcccggggaccccucgaggacgcccgcaccuccugcccucccgugcccucccuggucgcucgaaggcucugcgccgcccucgcccucggauccccuggagggugcgcagccgggcgucaccagaucgggucccucucaugccccgugaacgcaacuauucuccggggcaacuggcuccacugcccagccaaggucucccaguccggaucccgcuggaccccagccaggggaggucuuuucugugcuuuucuuuccuuuuuuguucuccuguuuguccucucacccagcccauucuucuccuguguuaacuuccagguuccccuuauuauuauagugccgccccccggggcuccgccccugccgcugcugccgcugccuaugaccgccacuaguuaccgcggggaccacaucaagcuucaggccgacagcuucggccuccacaucguccccgucugaccccaccccggagggagggaggaccgacgcgacgcgaugccucccggccaccgccccagccucaccccaucccacgacccccgcaacccuucacaucaccccccucgaaggucggacaggacggguggagccgugggcgggacccucaggcccgggcccgccgcccccagccccgccugccgccccuccccgccugccuggacugcgcggcgccgugagggggauucggcccagcucgucccggccuccaccaagccagccccgaagcccgccagccacccugccggacucgggcgcgaccugcuggcgcgcgccggauguuucugugacacacaaucagcgcggaccgcagcgcggcccagccccgggcacccgccucggacgcucgggcgccaggaggcuucgcuggaggggcugggccaaggagauuaagaagaaaacgacuuucugcaggaggaagagcccgcugccgaaucccugggaaaaauucuuuucccccagugccagccggacugcccucgccuuccgggugugcccugucccagaagauggaauggggguguggggguccggcucuaggaacgggcuuugggggcgucaggucuuuccaagguugggacccaaggaucggggggcccagcagcccgcaccgaucgagccggacucucggcucuucacugcuccuccuggccugccuaguuccccagggcccggcaccuccugcugcgagacccggcucucagcccugccuugccccuaccucagcgucucuuccaccugcuggccucccaguuuccccuccugccaguccuucgccugucccuugacgcccugcauccuccucccugacucgcagccccaucggacgcucucccgggaccgccgcaggaccaguuuccauagacugcggacuggggucuuccuccagcaguuacuugaugcccccucccccgacacagacucucaaucugccggugguaagaaccgguucugagcuggcgucugagcugcugcgggguggaaguggggggcugcccacuccacuccucccauccccucccagccuccuccuccggcaggaacugaacagaaccacaaaaagucuacauuuauuuaauaugauggucuuugcaaaaaggaacaaaacaacacaaaagcccaccaggcugcugcuuuguggaaagacggugugugucgugugaaggcgaaacccgguguacauaaccccucccccuccgccccgccccgcccggccccguagagucccugucgcccgccggcccugccuguagauacgccccgcugucugugcugugagagucgccgcucgcugggggggaagggggggacacagcuacacgcccauuaaagcacagcacguccugggggaggggggcauuuuuuauguuacaaaaaaaaauuacgaaagaaaagaaaucucuaugcaaaaugacgaacaugguccuguggacuccucuggccuguuuuguuggcucuuucucuguaauuccguguuuucgcuuuuuccucccugccccucucucccucugccccucucuccucuccgcuucucucccccucugucucugucucucuccgucucugucgcucuugucugucugucucugcucuuuccucggccucucuccccagaccuggcccggccgcccugucuccgcaggcuagauccgagguggcagcuccagcccccgggcucgcccccucgcgggcgugccccgcgcgccccgggcggccgaaggccgggccgccccgucccgccccguaguugcucuuucgguaguggcgaugcgcccugcaugucuccucacccguggaucgugacgacucgaaauaacagaaacaaagucaauaaagugaaaauaaauaaaaauccuugaacaaauccgaaaaggcuuggaguccucgcccagaucucucuccccugcgagcccuuuuuauuugagaaggaaaaagagaaaagagaaucguuuaagggaacccggcgcccagccaggcuccaguggcccgaacggggcggcgagggcggcgagggcgccgagguccggcccaucccaguccuguggggcuggccgggcagagaccccggacccaggcccaggccuaaccugcuaaauguccccggacgguucuggucuccucggccacuuucagugcgucgguucguuuugauucuuuuucuuuugugcacauaagaaauaaauaauaauaauaaauaaagaauaaaauuuuguauguca

SEQ ID NO: 140016 - RNA, 84231 nt, Homo sapiens; identical to SEQ ID NO: 140015

SEQ ID NO: 140017 - RNA, 84231 nt, Homo sapiens; identical to SEQ ID NO: 140015

SEQ ID NO: 140018 - RNA, 84231 nt, Homo sapiens; identical to SEQ ID NO: 140015

SEQ ID NO: 140019 - RNA, 84231 nt, Homo sapiens; identical to SEQ ID NO: 140015

SEQ ID NO: 140020 - RNA, 26636 nt, Homo sapiens; identical to SEQ ID NO: 34849

SEQ ID NO: 140021 - RNA, 26636 nt, Homo sapiens; identical to SEQ ID NO: 34849

SEQ ID NO: 140022 - RNA, 20529 nt, Homo sapiens
gacaggaggaaacgcagcgccagcagcaucucaucuacccuccuugacaccuccccguggcuccagccagacccuagaggucagccuugcggaccaacaggaggacucccagcuuucccuuuucaagagguccccagacaccggccacccucuuccagccccugcggccagugcaaggaggcaccaaugcucugaggcugucgcguggugcagcgucgagcauccucgccgagguccuuucugcugccugucccgccucaccccgcuccaucacaccagcuggcccucuuugcuuccuuuucccagaaucguuaagccccgacucccacuagcaccucguaccaaccucgccccaccccauccuccugccuucccgcgcuccggugucccccgcugccaugagcucccccaucagcaagagccgcucgcuugccgccuuccugcagcagcugcgcaguccgaggcagcccccgagacuggugacaucuacggcguacacguccccucagccgcgagaggugccagucugcccgcugacagcugguggcgagacucagaacgcggccgcccugccgggccccaccagcuggccacugcugggcagccugcugcagauucucuggaaagggggucucaagaaacagcacgacacccugguaaaccccuuuucgcgccccugacucucuccucccucuuccgcccucccaguggcgcuccaaacccuccccgacaugcgcgccucgggcgcauggugcgcuucggcgucugggcagggaggguccccgguccccuaggaggaaggaggcgggaggagggaaagcgcuucgggcacggcggaggaugcgcgcugacaccgcgcugugcccggccggcugcagguggaguaccacaagaaguauggcaagauuuuccgcaugaaguuggguuccuuugagucggugcaccugggcucgccaugccugcuggaagcgcuguaccgcaccgagagcgcguacccgcagcggcuggagaucaaaccguggaaggccuaucgcgacuaccgcaaagaaggcuacgggcugcugauccugugaguccaauccgagggaccugggcaugcggccagaccugaugagccugacggcgccuggaaauugugaagaggcggaguuagaguucccugggguuggaagcuucuuacguagggcggauaccaaagccccucucccgugccaucgcaacccugagcucuuguacagauuagagucgguccacggaaaagccgugcugugcacccagcaccugcguucucucuggcaacagggcagggccacacccucccaucaaagaaacgccaaaacaggguuguaccaacugugguguucagacucuugggcaggaugagguucugaagucagcguaccaggcaaacaucuuauacaaacaaaauuaucccuuaaaacucccugaaacaccuuguaagcucaaaagcgaggaguuagccucuuuggcuuuuuacagugacauuuucugcagaggauugggggacaugccuuauuucuacuuguaaagguggaauaaggagggauaucaaaguuguguuuuaggucgacaaaugcuacuaugggaugugauucuucugcuuuuuaguuguuagcauuuaacaaguuagcaccuuuauuuacccccaaacuguaaugccuaaucguuauauuuuccaggauauaaugacuggaauuaaaaacccuauuaauucacggugcuucacaggcuguauggucugcuauggggcaggugccuacaagugcacgaucgcaaaaggcuuuuuauuacuccagugacucucugacuguauguuauuauuuggaggcgauggcaaaauucuaaaucugagauauuuuguaaauaugaagcccacaccaaugaguugaaagaagacaagauucuucccucaaacagaucugaguugcuggugaugggguguucacaugcccccuuuuaccgcuaggaauuguccccaggccucccagccccacucccugcaaggacaccucaaaaucccugaacccaaauuaucuggacuucaacuuuuuggugcaaucuuugacuaggaggaaaggugcuuuuucauccuauugucaaacuauugucaaaagaugaucacuauuuuaucccaaauauucugaugcuaauauucucuggcuauuucuuggcaugauucucaguguuuguuugauuuuaugguuccugaaguugcagcuggaguauuucugcaucuccuucuuuucuuuucagugugcucuaaauguauuccugcuucucucacagggaaggggaagacuggcagcggguccggagugccuuucaaaagaaacuaaugaaaccaggggaagugaugaagcuggacaacaaaaucaaugaggucugcaggcuggggccagcuuuccuggggcucguggggacauagggauauugguggagcuucaagucacagcuacaaagaacaaaggaaaaaagaaugcaauucgggugauucaaagugggggucuucucuuucucuccauuccuuccuacagccuccuccccaccaaacccuuauuucucccuccuccacccucuuuuaaagucauaucacaaugagggagcaauggagaguguggacuuugguauucuacagcccuggauuugaaccccagcuuuccacucccuggcuaugagaccuggcuauauaccacuuaccuucccuaagccucaguuuccccaucuacaaaaugggaguaacaguucccaccccacggguuugcugugagaauuaaaugagauaacauuguaaaguucuuaaguagugauauuugagcuggguuuugcaggaggagucugaaagcagagaaagugggggaaggcauuaaggcagacagaguagccuucugaaaacagggaggcaugaaaugacgugguguguucagagaaucggucauuuaguguagcugaugugaggcuuucucugaaaugauacuggauaggucuuaacaauauuuuuguauuauacuaagguauuuggacauuaucccuuagccagcacggagucaaagggaguuuuaagcauaaaguaaucucuuuuuacuucuguucacuuuggauguuuauuuugaacuggaugcguccccagaugggaucauauaggugaaggauugcaaacucagaagcuuccagggcucacaugacuaauauaaaauaauaaggcagacccaguaaaaauuucaggaaacgugauagugcaugccccucccaggagggacagcagccccaguuccagcaaacgaaugccaugucagaaugcagaccucaugucaccaagucucauaauuauuauuuacauuuuuaaacuaguagugguaaauccauauguucauaugaaaccucuuguuuuuuuuaaugguaacaaauucaaagaacuuuuaaaugcgcuaugcgggcaaauuaaacuugcaaacuaaauccacacaugugggcuguauggccacaccagcucacggcaggguccaggauggcaacuuaucagcucugugugcauaagugagugacuuggccucuuuaagccucagcuuucucaucuacuacaugggaaaugaguagagacgguaccuacuacuacuugguugucagaggaucaaccaauacacuucguacaguguuugguaccauauggaccucauuaaaugugaggcauuaguuauugaaaacucugguuuaugaaacuggcauccaaaggucuuaugugacuaucccaaggucauagacuacuuagggaaggagcuguguccagaauugguagaucuucugguuccaaguucaacaugcuuaacauaaccaccaaccaauaaagagacguuugcuugcccagauguggaagggcacaccucaggauagcugcugcaacacaauccuugagaugcugggccaacagggacaguuagcugauuccuuugugguuuuauucccccauucugauuagaaaaaaaaaauguuuuccuuuucuuaaauugccagaauuauuuuuagaucaaaagcugaaacuuaagcuucaggguggcuucaggaaaagcucaggaaauaacccaggacgaggucauuaggggauaagguggguucccagggagaauauauaauuagugugacuucaggaugaauaacauuauggccagugaauaugcgauguagcaagaccugaaguuagcucagugagcuuuaaaguuuuguuuuccuucaacggcuuuaaaaugugucuuuugcgguuguuuucuuugaaggucuuggccgauuuuaugggcagaauagaugagcucugugaugaaagaggccacguugaagacuuguacagcgaacugaacaaauggucguuugaaaguaaguugucgucacagacuugcucacugauuuugcaggugauuuugcggauaaaacauggcucuuuugacaacucuuuuguaaacaggcauuauugcugccuagggaaaggccagagcagcccuuuuaaugcuucuuuuaggugcuuaaguuaugccuugaacuauggauuguuaaugagucauacaacaaacauuuguugaauacuugcugugugucuggcacugugcuagguacuagggauaugacaaugaaugaaacgcauaaccccuguacccuuggggagcuuauaugcuagacaaggugacagucaacaaguaaacacauuuuaaaauauacucuuccaaggaguaaaggaaaagagaaagggaguuaagaaagaacaugaaaggcaggcaugguggcacaugccuauaaucccaggacuuugggaggcugaggugggcagaucgcuugaggccagcccaggaaucugagaacagcuugggcaacacagcaaaaccuugucucuacaaaaaauacaaaaauuagucaggguugguggcacaugccuguagucccaucuacuugggaggcugaggugggaggauugcuugaccccgggacgcugaagcuaaagugagccgugauuguaccacugcauugcagucugggugacagugugagaccccgucucaagaaagagagagagacagagaaaggaaggaaggaaggaaggaaggaaggaaggaaggaaggaaggaagaagggagggagggagggaaggaaggaaggagggagggagggagggagggaaggcagaagggagggagggaaggaaggaaggagggagagaaggaaggaaggaaggagggaaggaaaagaaaaagagaaaggaaagaaaaaagaaaagaaauaaagaagaaaagagagagagagaaagaaauaacaugaaagaaugaaagaggggcaagucuuuuuuaguaagaagacauuugagguaaguccuaaaggaagggaaggagcaaaucaugaggguaccuguggaggauuguuccaggcagcagagaagaaagugcaaaugccaggagguggaagcaugagcgccgaguuugaggaacuucaagcugcuggugugaguggaucacgaugaacaagcugggaggaaggggagccugugaaaggagaugaggucaaaaagaaggcagguguccaacagggcacagcucauagguccuggcaagacuuuaccucucaucugacucagauggggcaaguaagggagggaggacaugaccgcuuucuucaaagauuacucuggaaauaaagggcagagcucacugcccaugggggugcaagaggagagcaggcagcugugaucaggugggacagcgccuggcugaggacauucagggcugugggagaaucugagagggccaccuaagccggacauggccaggggucgcuucacagagauggugccccucagcuaaguccugaugguugaguaggaguucaccaggugaaaagggaggaaggagagugucccugcagaagaagugcggaaugacaagcauauccuguaacagaggcuggcagagggccagcagccagcucauggagggcuguaugagcgggaguuugaauuuuagccuguaaguaaccgggagcugcgggaauguauucagcagcagugugauauaugggcagauuuacugggaggaucacuguggcugcugaugggagggauagaaggaaaaccuauaacacuuccauaaauucaaggucagaaauauugccauaaauagauaaauauaaguaacuuuuuuuaauuacuuauuugagacagacucucacucugccccaggcuggagugcagcggcgugaucucggcucacugcaaccuccaccuccuggguucaagcgauucuccugccucagcauccugagcagcugggacuacaggugcacaccaccaugccuggcugauuuuuguguuuuuuaguacagaugggguuucaccauguugcccaggcuggucucgaacugcugaccucaggugauccacuuaccucagccucccaaagugcugguauugcaggcgugcgauaccacgccugacuaacuuuuguguuuuuuaaguagagaugggguuuugccaccgguuggucucaaacuccugaccucagaugaugcucccaccuccaccucugagagugcugggauuacaagcaugagccauugugcccagcagaguaacuaauuauuuuuaaaguucauguaccauccagagcuaucucacauauucccagugguguaccugccaaccacuguggaacacaaauacggggaaaccuugaaaggcugggaagaaauaaguagaguuuggaaaacauggagguaguuggaaaagcugugggugggugcugacuaagcuaauugacucucacuccucagguuuaugauuuuaggccauuuguuuaccuuuuuaaugcuagucuccuacuuuauaagucaagagccaauuauccaccacuaaaaaguugguugcaguaauccuguauaauuuuuuuuuuccagacugugucacucaggcuagggugcaguggccagugguaugaucucggcccacugcaaccucggccuccugggcccaagagaucuucccaccucagccuccagaguagcuggaacuacaggcacauguagccaugccugaauaauuuuuuuauuuuuauuuuuuuguagagacagcguuuugccauguugcccaggcuauucucgaacuccugggcucaagcagucugccugcccgagccuccugaaguguugggauuacaggugugaaccaccacgcucggcccuguguccuuuuuuuaaaaaaaaaagguuacaagagauaauuuuuaggacaauggggaacauuuuaaaaugggacacaguagauuuuuuauggaauggucgcuaagguucuuagggauguuaaugacauugugguuauguuggagaaugcuuuauucuuaggacauuacugcuaaaguauuuaacggugaagugaccugagagcucaaaauuauuuucagaugcuucagcacacacaaccacguauacacuuguaugcauacauacacacaaagagaaagaaauggcagcaagauguugaugaguucgggggauucagguauucauuuuaccauuccuucaacuuuucucuagguaaaaaguuuugaaaugaagaguugagaauuuuauuuguaaaaagguuccuucuaaauaaaaugaugaaauggaaggaaaaaaaacccuauaugaagugcuagcccaguaccuggcguguaauggguguuuagaacauaauuauucccuucccuucucuuccucuggugaauggcuuccaauucauuaugucaggagauagaauccaauaagugacucuaaaaacacagcuggguuagaggcagagugcagacccgacccugcagcaccuuugcuagggccccuggaucuccugugugacuugaucaggacaguggaucucugaucaugacacucugaggugaugagucauuggaccuggagauaauuucuagaaaaagaaagugaugguguccccuuucucucagacucugcuuuuccucaauauucuuggacuguugccuuuucucagaaaaucccacacuuuuaagaggcauagaauugagucuuuaauaaccagcuaaacauagacuccaacuccagcauugcuguuuguguaaagugaugauuauuuuaaaugacagguaucugccucguguuguaugagaagagauuugggcuucuccagaagaaugcaggggaugaagcugugaacuucaucauggccaucaaaacaguaagcagccucuuuaagaaagcaguuuucuugauugauguuuuacagaucgauuuuuacagaacuucacagugauucccaaaaaauggcauacacacauauuuuauuucaauaguuaaguguucauuuuaaugugcauuauauauuuuaguauauuuaugugcauauaugcggcugucuccaaccuuuuuggcaccagggaccaguuucguggaagacaauuuuuccauggacagggcagggugguggggcaggggagggaggaucauuuaagugcauuacguuuacugugcacuuuauuucuguuauuauuauauacucaccauaauguagaaucagugggagcccugagcuuguuuucgugcaacacgaaagucccaucugggggugaugggagacagugacagaucaucaggcauuagauucucauaaggaguguggaacauagauuccucgcauaggcaauucacaauaggguucacacuccuguaagaaucuaaugcagccauugaucugagaggaggcagagcucaggugguaacaccugcuggcccgcugaucaccuccugcugcgcggccccguuccuaacaggccacugaccaguacugguucacggccuggggguuggggaccccuggauauaugcacguaacauaaagaagcacauuaaauccauuauuucuuuguuuaggcaagguuaaaauagcuauuuuaauuaaagaucaguugauuaaaaauacuuuuuaaaaagagcccaaaauuuuucagauuuuaucuuuuugaauaguuuggguggcguguagauaggauaaacgcugugaaauugguuuggaaaucacugaaguuuggaaauuauuagaaauugaagugaauaugaaaguuaucguuuuuccucuuuuuuuuuuuuuuuuuacaauuaggucauaagauuacaauuuuuaucaaacacauccaguggaaaaucaucccccacauuaccuucaauauugaaaggagguggaggugggguacgggcauugcucccaggaccggugcagagagagccggggguguccuuguaauuccagccuuuuaaaaagugcagggugcugcgguuuagaauguuccucuuccagaacgaacauugucuuugagagaaggagaauucagaauaaaaaggcauuugcauuucucucagaugaugagcacguuugggaggaugauggucacuccagucgagcugcacaagagccucaacaccaaggucuggcaggaccacacucuggccugggacaccauuuucaaaucagguaaagggccgcccuucacaaccagccagaaccagcccagcacccccgugucuggagcuucagagaggaggucuggagugaucuccugagccucaucaccacauuuagguuuugcaaacacagguguuuuggggauugccccagcauacacaaauucuaaguaacaagcuuucuguagucuucuuugggaauuaagagugguuaaaaguaaaaucuggccaggugcaguggcucaccccuguaaucccagcacuuuggguggcccaggcgagcagaucacuugaggccaggaguuugagaucagcccggucaacacggugaaacccagucucuacuacaaauacaaaaauuagcugggcgugguggugggcaccuguaaucccagcuacucaggaggcugaggcaggagaauugcuugaaccugggaggcggagguugcagugagccaagacugagccacugcacuccaucuugggaggcagagugagacuccaucucaaaauaaaaaaguaaaauuuauagagucagggacuccugaguucaaguucagcucugucacugguugugguggcuuggccaaaugugcaaucaccuuuucauccucaguugccuugucucuaaaauggacuaauaauuaauaauaauaauaagagaaccuaccucaauguaacuguuucugggucuacuacagauuacaguuaacauaaaaaccuggcauaucacaguaucuccguggacuagaucuauuucugccacaugacgaaggggaauauuugaugcuaggcauuguucacuuacacauuuaguuaauccucacaacacaccuauaagguagguccuuuuauuagcccugagagggguaccugagacacauagaaguuagccaacguucccaagauugcaugcuaggugauggcaaagccaagguuugaagccagacaaggagcuuccaggacucgaacucuaacugcugugccauaugugaucagcaugauuauuaccauauaaugagccuggugguuguuugcuuaauagugagggagguacacgccuagauuuuauguuauaaauauuagaaauuuuuaccauuauugucaacauggauggacacucuacuugugcguauguaugugggguaugugugcuuaguaauaucuggguccaaguuggauucugaaagugaacccaaauccuaccuucuuuuacacuuuuuucucccaagaucuaaacucuuacuacucaaaacuaugaccugcagcccaguggcaucagcaucaccuagaagcuuauuaggaaugcagaguuccaggccuacccaagcccugauucagauucugcauuuugagaagaugccuaggugacuccuauccacauuaaaguuugagaagccuugcucaugucgguauugaaaaauccuugccgacuugacaagaaggcaauaauauaauuaguguguguagcaaauugucaguguuccugaaaagacuauuuagauauugcaagaaggaguuuggacugagguuuucuucugugauuuuccucaucccaauuuucagcugacuuccucucuuucuucucugcucuaauagucaaagcuuguaucgacaaccgguuagagaaguauucucagcagccuagugcagauuuccuuugugacauuuaucaccagaaucggcuuucaaagaaagaauuguaugcugcugucacagagcuccagcuggcugcgguggaaacgguaagggugggcuggauuugaguuugcuaaaugaacggucuguaccauuuuuagaugacagauuuuaaauaguaauucaucucauucauuucacugggauucacuagcaucaacuccacaaaaaugaaaagucucauacuagaugccacggugccuccgcgcacagcaucuaugccacggugccucagcgcacggccucauaccagacgccacggugccuccaugcacgggcuucugugcuuaaacucuggguaggaggagacuucaugugccccagugacaaaaagccagaguaggaugugaugagugccaugauguccaugcaaacugcuacgggaguucaggagcaguaaaguucucugcccuggcaagauacagaauccagauuuuucaaaauuggaaguauuuuguucaguugcacauguuaccccaaagugccuaacuguggcuguuacuuacuguaaaaaaaaaaaaaaaaaaaaaaaaaaaaaaaaaaggcauacucucuuucaagccaauaauauuuuuaucugcuuagaauuguaaacaaagucccaaagagucugggacaaguggauuuuaacugaagcaaaacagcucauuguaaagaccaaaauucugucucugauguggccgauacucccuaggagauagcagauacuaagugagaccaaccccaaacaaauccugccauaggcauucagguagguuuaauugacuuggauacuaguucgagcugugaugggaguggcgcacgcuaaccuccuccuaaguccaacauuucaugcaccuuaaagucucuaagcaaaauguaaagcaguuguuuauuuuccaugugcuuccccuucugugcuguuucuugccugaaguaaagguaggguuuucucuaucaggagauagcgagguucucauuucuccuccugcuccacaaggcgguugaaagugggaauccauccucgcucacuuuccuguugaacugcuuacccuggguggcuccuuccagugaucaaaguacagugucacccauuauucuuuuauuuuuucaacuggaacgugaccucucugagggcaauggcuuagaguuguccacugcuguguuuccaggacauagaacaguacuuggcaucuaguagcggcugauagauacuuguugaauaaaugaaggaauucaggaacuauugagugccuacuguaugccugggacuguuccagguucuugagagaccaccaugaaccagagacaaggguucccacucucauggaacuuguaugcaaguggggaagacagacaguagccauguaaacaaacaaauguggucacuuuagauagugguguggauuguggaggacgccaucaggaugguguaauauagagagauggagaugauuaaagggaagcccucucugagaaagcaguacuggagcugacucuggaauaaugagaagagccagccacagaaagaccucguggaagagcgcugcagguagaggaaacggcccaugcaaaggcccuggggcagaaagagggauggagcuacagaacuaguaaauguggucagagcugagacuggagaauuggaugggccauguuagccagagccuugugagcccagccuggguaaggcauuagauuugauugcaccugugaugggaagcucuugcagcauuuuaagcaagggaaucaccugaucauuuauguuuuuaaaagugggcucuggcugguggauggagaauagacuuagccaagagaguggguacagcaggccagucaaugagcuuggucuguuccauggaggucaaucaaggauaguuugugccccugagguuuuccaggccacuuccccucaaaucagcugcugcagcuuagccccugcaguuuucccuacaggcucagacugccuuacguggcuuugguaaaagcuacagucaucugcccuuuggaaacucuauuugguacuugcggugagggacucacugauaugguuaaaucuguuucuuuuuugguccuggcuauucugaaagucacauuuggaaaaucagaaccauuugaaaguguaucuaauuugauggcuacacccucuuccuguuuuguaaauuagacucuuauaauaauggcaucuacaguuuauuugcagccgaggcugccaguccucugacaugaagaagacugccuuggaggcaucuucuuccaaaaauaauaaaauaaccaucaucucugaauggucuugcacuuggugcucauuugugugaguggcacauggcacuuagcaacagcgucuucaugucugcggagguggacacaaugaucauuuucaggaaauauuuggcuuaaauuagcaaaguacggccuaaaaaauaaauacauaugacuacuaguggugaauauuauguagcuuaaagcuacauuggcuguuuccaccaauauuuuuucucuagucauugccugugcagaggaaauaaaagaugccacuuaaaagggugugggccuuugucagaaacuguagcuggaguacucagcucaauguuugaauuucuuauuuuugguguuggcacccucguaugagggcuguuuacaugugguuguaacccucaguguagguagugccuguuuauuuuuguggugacuuuuuaggguguggccaaaggaacuuuuaaauuucagaaaugccauuuauuguccauuuccacuauaacauucucuuaaagccucucauuagcaacacccugaggaucaccaucccucucuguuuacuccauuuuuauaugaauguuuuuuauaucaagcaacuuuuaauuaaauguuuauuuugagaucauuguagauucacauucaguucuaagaaaaaauagaaagggaucccuugcauccguuacccaguuuuccacuaauaguaauguccugucuaacgagaaaacguugucacaaucugaaaauuggcauugauuuaacccacuaauauucucauuucaccaauuuuacauguacucauuuguguucgaacaauuauugcgucaaacuguauuuuaggucaggcacaguuggcucaugccuguaaucccagcacuuuuggaggcaggcagaucaccugaggucaagagucuaagaccagccuagccaacauggugaaaccccaucucuacuaaaaauacaaaaauuagccaggcauggugguggaugccuguagucccagcuacucaggaggcugaggcaggagaaucgcuugaacccaggagguggagguugcagugagccgagauagugccacugcacuccagucugggugacagagugagacuccaucucaaaaaaaaaaaaaaacuguauuuaaauguucuaaagcagcugauuaaaggauuauacuuugauucccucaguaaauaauuuaaaauauauccuuaauugauauguuuuaugaaauaagucugcuuuuuuauauauuggauuugucuaaaggcguagcuauaaggacgcgugaaagagcuucacugauacauuugcagaauaagguggugggcaucaccuuuuuuucagcuaauagugguuuaaugcaguuauuuacaaaaacucaaguuuauguccauuuggcuugcagacagcaaacagucuaauguggauucucuacaauuuaucccguaauccccaagugcaacaaaagcuucuuaaggaaauucaaaguguauuaccugagaaucaggugccacgggcagaagauuugaggaauaugccguauuuaaaagccugucugaaagaaucuaugagguaagagccuaucucugagccaauauaaauguguuagaacacuguucucguaaacacaaaacaagugguccccuacucaugggcggcuuccccuagcuaauuagaaacaauuaucacacugcaaaaaaaucuuuggagccauauuucuuuucuggcacucauuuccuaaaucauuugggcaaauucuauuaaaucuuggaaagccagugcccuccccuuuaauucaauaaucuugcuacucuaaugaacgcuguaagcacuaauuaagauaggggcaugauugaagguuaugagauggaggcucacaaaagagcuauauuauuauauaauaggacacagagaaagcuuugcuuuugagccucugguauaaaacauuuuuuggaaauucuuuuuacauccuuuugggaaaacaaaacucacaacauuuuaggauuagaaggauacugucaacuuugugaagaguagauuggagaaacauagaacaaacaucacgcuucaagggcuagcacggaaacauacacauuuuagucuggaaugaagggggaaaaccaacguuaacaguuuacuaaacagccuugcacugggguuuuaacuaacucaagaagaugagaggaacaagagauacaauuauugagaagaaaaaaacaacuucuuuaggaagaucugugaucaugcugccucuuugaguaugcacuugggcagcauuuauuuaauccaaucugcauucccauugacacuucagagagaacuuagacugugcucaccuuuacaucuuugauuuuaucuuuucaggcuuacgccgaguguaccauuuacaacucggacucuugacaaggcaacaguucugggugaauaugcuuuacccaaaggaguaaguagaauuuguauauucuauaccuuacaaaaccuuggaagauacacuuugcaaauauucaccagaucucccuagacuuuguacuggaaaauauucauuuugggaaugcagagaugguagagaauaguugacauguugcauaguauagaauuagaauucacggcuauggagacagagaccugcauucaguuucaucuuuuaucuguguugucuugagugaguuacauaaucucugugagccucaacuucgucuguaaaagggguuuaauaacagaaucugcugcgcagggugguugugaguauggugcacaauucuaaagcccuuuaccuauuuauuaccuggcacauuuuaagcacucagcgcauguuggcaaccaucauuauuauaaauuuguggauuuggcuuuugauuuguaaggugacaacuugugucaauuuugccauucaaaggucucuucugguuauuuuaaauacuaugugucucugcauguguuuagacagugcucaugcuaaauacccagguguugggauccagugaagacaauuuugaagauucaagucaguuuagaccugaacguuggcuucaggagaaggaaaaaauuaauccuuuugcgcaucuuccauuuggcguuggaaaaagaaugugcauuggucgccgauuagcagagcuucaacugcauuuggcucuuuguuggguaaaaccuuuaccgguuucugcaauuauguucugugcuguuucacaaggcagaagaagagagggguaauucuguuuuugugugcgugugcauuacagauuguccgcaaauacgacauccaggccacagacaaugagccuguugagaugcuacacucaggcacccuggugcccagccgggaacuccccaucgcguuuugccagcgauaauacgccucaggugagcaucuaggcgguucauuauccucugcaagguagugagaaugacgagggaugagcuaugcugggaagucagccagacugggguuugaaucccagcucaccucuaacuugcugggugaccuugagcaguucccuaaacucucuacuuccuuuuuuuuuuucauuuguaaaaugaugacccaaagagaguguaucacaaaaauuuaauaugaauaccaaguaguuauuccugagccuggcaucaauuaaguguucaguaaaugcuagcagcuguucaugguuuuugcaugugaauaguaaggguuggcaaacuuuuuccguaaagggccaguuggcaaauauuuuagguuuuauggaccauacagucuuugucacauccucuuaauacuaccuuggaacaugaaagcagccacaggcaauuuguaaacuaaugagugagcugauguccuagcuuucuauugcugccaccgcaaauuacuaaaacuuagugaguuacacgacacacaucuauuaucuuacaguucuauaggucagaagucugaugaggcucuuccaggcuaaaauuaucguguugucggggcucuuucuggagguucuagaggaggaucuauucucuugcuaguuugguuguuggcagaauuuaguucuucaugguuacaggacugaagucuuuauuuuuuugcugcugucagcugaaggcgauccucaacuuugagagauuucccauauuccuuggcucaugaaaccuuccccaacugaaagccaguaacaaugguugguugagucccucucacacuuugaaucucucuuucuucuuacauugcuucugucugacaagauauuauccaggaucaugucucccaucuccaaguucauaaauuuaauuucaucuggaaagcccuuuuuuucauauaagguaguauauucacguguuccagggauuagggcauucacauuuuaggagaucuguuauucugccuacaaaggcuguguucugauaaauuuuauaaaaaacaagcgguggacuguauuuagcccuagggucuagguuuguguuaugcaaccacauguaauauaaauguauauauuuaucagccuguauugaacacaauagaauauuuuuucugcaguaugccauucaauacuuuuucugacaauagaggaguucucauguucccuccacaacuuuugccauguccauauaccaaccaggugcuauuuauuucaauacuacugaguuauuuccuuuaaauaacauaagccaaauagcauauguuggccucguccugaguaauaauuuccuuaaugaaauuaagaguuaguaagucuaguuauguucuccuaauagacauuacaaugaauucaaaacuauugaagugaucaaaaguuagccuaagaaggcccuaauuuuuuuuuuuuuuuuuuuuuuugagacagugucucacacugucaccugggcuggagugcaauggugcaaucucagcucacugcaaccuccgccuccuggguucaugcgauucuucugccucagccucccgaguagcugggauuacaggcaggugcacaccaccacacccagcuaauuuuuuguauuuuuaguagagaugggguuucauuauguuggccagacuggucuugaacuccugaccucgugauccacccgccucggccucccaaagugcugggauugcaagugugagccaccaccccuggugguggaaauaagacauuuguaacauauggcuuuauaggcugacaugucgguguuuaaacccggauucuaucauuguguucuuuuagcagcaccuucuaggauuuuccuagaaaaaaaugcuguuugccaauggcaaguuaaggagcauuugcuuauugguagauuauuuagagaaacaugcaauuacagaugaaauuucugaacaaggcccaaaugaauacauuauuauuccuccaccaagugucugaugcuauuaugaaauuugucaaauucugagcaucccaaccaacagaacugaaucaaguaggguaaggaaaguauucuagcugcauugugacaccccagccuucagcaaagagcaugcauguuuaucacaguaagccacaccuuuuaaguuuuagcauuuuuucuuuggcuaauaauuugucuuguuuaaauacacuucuuugauauacaauuaggguauaccuuuuuuuuuuuuuuuuuuuuuuuuuuuuuuuuuuuuuuuuuuuuaccaagaccaaaacagccauuucaacuuuucugcaagaauggugcuuauggcuucuacguuaccggaaagcaaacuucaaacaccacaccauacaacagcuuauaaagaauauuuaggcccagguguugauacuuuuucuucugcaaaauuguuccagaagcuguacugucuuucuagauggugguauuugcuaacaucauauccaacucagggaagcggacugagugcugggauccaaggcauucuacaggguucacugcugguuuacacuucaccugugucagcaccaucuucaggugcuuagaauggccugggagccuguucugucuugcaucuuccaugacaugaaagggaggcuggcacuugucagucagguagagguuacaaaccguuucaggcccugccuaccacauucacuguuugaaucuuuaauucccaagaauaaguuuacauuucacaaugaaugaccuacaacagcuaaauuuucuggggcugggaguaauacugacaauccauuuacuguagcucugcuuaauguacuacuuaggaaaaugucccugcuuaauaauguaagccaagcuaaaugaugguuaaaguuaucaggccucccaugaaauugcguucuuccugcauugaaauaaaaacauuauugggaaacuagagaacaccucuauuuuuaaaaggacuuuaacgaagucaaacaacuuauaagacuagugauucacuggggcauuauuuuguuagaggaccuuaaaauuguuuauuuuuuaaaugugauuccuuuauggcauuaggguaaagaugaagcaauaauuuuuaaauuguguaugugcauaugaagcacagacaugcaugugugugugugucuguguguguguguccguguauguguguguggguucuaaugguaauuugccucagucauuuuuuuaauauuugcaguacuugauuuaggaucuguggugcagggcaauguuucaaaguuuagucacagcuuaaaaacauucagugugacuuuaauauuauaaaaugauuucccaugccauaauuuuucugucuauuaaaugggacaaguguaaagcaugcaaaaguuagagaucuguuauauaacauuuguuuugugauuugaacuccuaggaaaaauaugauuucauaaauguaaaaugcacagaaaugcaugcaauacuuauaagacuuaaaaauuguguuuacagaugguuuauuugugcauauuuuuacuacugcuuuuccuaaaugcauacuguauauaauucuguguauuugauaaauauuucuuccuacauuauauuuuuagaauauuucagaaauauacauuuaugucuuuauauuguaauaaauauguacauaucuagguauaugcuuucucucugcugugaaauuauuuuuagaauuauaaauucacgucuugucagauuucaucuguauaccuucaaauucucugaaaguaaaaauaaaaguuuuuaaauauu

SEQ ID NO: 140023 - RNA, 20529 nt, Homo sapiens; identical to SEQ ID NO: 140022

SEQ ID NO: 140024 - RNA, 18 nt, Artificial Sequence
  Description of Artificial Sequence: Synthetic oligonucleotide
uacagggugguucccauc

SEQ ID NO: 140025 - RNA, 18 nt, Artificial Sequence
  Description of Artificial Sequence: Synthetic oligonucleotide
accucuacagggugguuc

SEQ ID NO: 140026 - RNA, 18 nt, Artificial Sequence
  Description of Artificial Sequence: Synthetic oligonucleotide
gauggaccucuacagggu

SEQ ID NO: 140027 - RNA, 18 nt, Artificial Sequence
  Description of Artificial Sequence: Synthetic oligonucleotide
acgcagauggaccucuac

SEQ ID NO: 140028 - RNA, 18 nt, Artificial Sequence
  Description of Artificial Sequence: Synthetic oligonucleotide
ucugaacgcagauggacc

SEQ ID NO: 140029 - RNA, 18 nt, Artificial Sequence
  Description of Artificial Sequence: Synthetic oligonucleotide
cugggucugaacgcagau

SEQ ID NO: 140030 - RNA, 18 nt, Artificial Sequence
  Description of Artificial Sequence: Synthetic oligonucleotide
aucgucugggucugaacg

SEQ ID NO: 140031 - RNA, 18 nt, Artificial Sequence
  Description of Artificial Sequence: Synthetic oligonucleotide
cuggcaucgucugggucu

SEQ ID NO: 140032 - RNA, 18 nt, Artificial Sequence
  Description of Artificial Sequence: Synthetic oligonucleotide
uagcucuggcaucgucug

SEQ ID NO: 140033 - RNA, 18 nt, Artificial Sequence
  Description of Artificial Sequence: Synthetic oligonucleotide
agucauagcucuggcauc

SEQ ID NO: 140034 - RNA, 18 nt, Artificial Sequence
  Description of Artificial Sequence: Synthetic oligonucleotide
ggcccagucauagcucug

SEQ ID NO: 140035 - RNA, 18 nt, Artificial Sequence
  Description of Artificial Sequence: Synthetic oligonucleotide
cugcaggcccagucauag

SEQ ID NO: 140036 - RNA, 18 nt, Artificial Sequence
  Description of Artificial Sequence: Synthetic oligonucleotide
cacaccugcaggcccagu

SEQ ID NO: 140037 - RNA, 18 nt, Artificial Sequence
  Description of Artificial Sequence: Synthetic oligonucleotide
ggcgccacaccugcaggc

SEQ ID NO: 140038 - RNA, 18 nt, Artificial Sequence
  Description of Artificial Sequence: Synthetic oligonucleotide
cccucggcgccacaccug

SEQ ID NO: 140039 - RNA, 18 nt, Artificial Sequence
  Description of Artificial Sequence: Synthetic oligonucleotide
aucuccccucggcgccac

SEQ ID NO: 140040 - RNA, 18 nt, Artificial Sequence
  Description of Artificial Sequence: Synthetic oligonucleotide
ggcugaucuccccucggc

SEQ ID NO: 140041 - RNA, 18 nt, Artificial Sequence
  Description of Artificial Sequence: Synthetic oligonucleotide
uccauggcugaucucccc

SEQ ID NO: 140042 - RNA, 18 nt, Artificial Sequence
  Description of Artificial Sequence: Synthetic oligonucleotide
gcugcuccauggcugauc

SEQ ID NO: 140043 - RNA, 18 nt, Artificial Sequence
  Description of Artificial Sequence: Synthetic oligonucleotide
cuguggcugcuccauggc

SEQ ID NO: 140044 - RNA, 18 nt, Artificial Sequence
  Description of Artificial Sequence: Synthetic oligonucleotide
uccuccuguggcugcucc

SEQ ID NO: 140045 - RNA, 18 nt, Artificial Sequence
  Description of Artificial Sequence: Synthetic oligonucleotide
gggcuuccuccuguggcu

SEQ ID NO: 140046 - RNA, 18 nt, Artificial Sequence
  Description of Artificial Sequence: Synthetic oligonucleotide
ucuucccggaccucaggg

SEQ ID NO: 140047 - RNA, 18 nt, Artificial Sequence
  Description of Artificial Sequence: Synthetic oligonucleotide
uccucuucccggaccuca

SEQ ID NO: 140048 - RNA, 18 nt, Artificial Sequence
  Description of Artificial Sequence: Synthetic oligonucleotide
ucuccuccucuucccgga

SEQ ID NO: 140049 - RNA, 18 nt, Artificial Sequence
  Description of Artificial Sequence: Synthetic oligonucleotide
cucuuucuccuccucuuc

SEQ ID NO: 140050 - RNA, 18 nt, Artificial Sequence
  Description of Artificial Sequence: Synthetic oligonucleotide
acuuccucuuucuccucc

SEQ ID NO: 140051 - RNA, 18 nt, Artificial Sequence
  Description of Artificial Sequence: Synthetic oligonucleotide
cugccacuuccucuuucu

SEQ ID NO: 140052 - RNA, 18 nt, Artificial Sequence
  Description of Artificial Sequence: Synthetic oligonucleotide
ugccucugccacuuccuc

SEQ ID NO: 140053 - RNA, 18 nt, Artificial Sequence
  Description of Artificial Sequence: Synthetic oligonucleotide
ccuucugccucugccacu

SEQ ID NO: 140054 - RNA, 18 nt, Artificial Sequence
  Description of Artificial Sequence: Synthetic oligonucleotide
gggcuccuucugccucug

SEQ ID NO: 140055 - RNA, 18 nt, Artificial Sequence
  Description of Artificial Sequence: Synthetic oligonucleotide
cccccauugagcucuggg

SEQ ID NO: 140056 - RNA, 18 nt, Artificial Sequence
  Description of Artificial Sequence: Synthetic oligonucleotide
gucccccauugagcucug

SEQ ID NO: 140057 - RNA, 18 nt, Artificial Sequence
  Description of Artificial Sequence: Synthetic oligonucleotide
cuguggucccccauugag

SEQ ID NO: 140058 - RNA, 18 nt, Artificial Sequence
  Description of Artificial Sequence: Synthetic oligonucleotide
gcaugcugugguccccca

SEQ ID NO: 140059 - RNA, 18 nt, Artificial Sequence
  Description of Artificial Sequence: Synthetic oligonucleotide
gaagugcaugcugugguc

SEQ ID NO: 140060 - RNA, 18 nt, Artificial Sequence
  Description of Artificial Sequence: Synthetic oligonucleotide
ggaaggaagugcaugcug

SEQ ID NO: 140061 - RNA, 18 nt, Artificial Sequence
  Description of Artificial Sequence: Synthetic oligonucleotide
cugcuggaaggaagugca

SEQ ID NO: 140062 - RNA, 18 nt, Artificial Sequence
  Description of Artificial Sequence: Synthetic oligonucleotide
uguagcugcuggaaggaa

SEQ ID NO: 140063 - RNA, 18 nt, Artificial Sequence
  Description of Artificial Sequence: Synthetic oligonucleotide
uccccugccaguccucuc

SEQ ID NO: 140064 - RNA, 18 nt, Artificial Sequence
  Description of Artificial Sequence: Synthetic oligonucleotide
ccguguccccugccaguc

SEQ ID NO: 140065 - RNA, 18 nt, Artificial Sequence
  Description of Artificial Sequence: Synthetic oligonucleotide
cugccccguguccccugc

SEQ ID NO: 140066 - RNA, 18 nt, Artificial Sequence
  Description of Artificial Sequence: Synthetic oligonucleotide
cuccucugccccgugucc

SEQ ID NO: 140067 - RNA, 18 nt, Artificial Sequence
  Description of Artificial Sequence: Synthetic oligonucleotide
ugugccuccucugccccg

SEQ ID NO: 140068 - RNA, 18 nt, Artificial Sequence
  Description of Artificial Sequence: Synthetic oligonucleotide
ugggcugugccuccucug

SEQ ID NO: 140069 - RNA, 18 nt, Artificial Sequence
  Description of Artificial Sequence: Synthetic oligonucleotide
ugcacugggcugugccuc

SEQ ID NO: 140070 - RNA, 18 nt, Artificial Sequence
  Description of Artificial Sequence: Synthetic oligonucleotide
cccacugcacugggcugu

SEQ ID NO: 140071 - RNA, 18 nt, Artificial Sequence
  Description of Artificial Sequence: Synthetic oligonucleotide
ggauccccacugcacugg

SEQ ID NO: 140072 - RNA, 18 nt, Artificial Sequence
  Description of Artificial Sequence: Synthetic oligonucleotide
ggccaggauccccacugc

SEQ ID NO: 140073 - RNA, 18 nt, Artificial Sequence
  Description of Artificial Sequence: Synthetic oligonucleotide
cagagggccaggaucccc

SEQ ID NO: 140074 - RNA, 18 nt, Artificial Sequence
  Description of Artificial Sequence: Synthetic oligonucleotide
guuugcagagggccagga

SEQ ID NO: 140075 - RNA, 18 nt, Artificial Sequence
  Description of Artificial Sequence: Synthetic oligonucleotide
auggcguuugcagagggc

SEQ ID NO: 140076 - RNA, 18 nt, Artificial Sequence
  Description of Artificial Sequence: Synthetic oligonucleotide
acaugauggcguuugcag

SEQ ID NO: 140077 - RNA, 18 nt, Artificial Sequence
  Description of Artificial Sequence: Synthetic oligonucleotide
gccccacaugauggcguu

SEQ ID NO: 140078 - RNA, 18 nt, Artificial Sequence
  Description of Artificial Sequence: Synthetic oligonucleotide
ucugcgccccacaugaug

SEQ ID NO: 140079 - RNA, 18 nt, Artificial Sequence
  Description of Artificial Sequence: Synthetic oligonucleotide
gcuacucugcgccccaca

SEQ ID NO: 140080 - RNA, 18 nt, Artificial Sequence
  Description of Artificial Sequence: Synthetic oligonucleotide
acucugcuacucugcgcc

SEQ ID NO: 140081 - RNA, 18 nt, Artificial Sequence
  Description of Artificial Sequence: Synthetic oligonucleotide
ucagcacucugcuacucu

SEQ ID NO: 140082 - RNA, 18 nt, Artificial Sequence
  Description of Artificial Sequence: Synthetic oligonucleotide
guccuucagcacucugcu

SEQ ID NO: 140083 - RNA, 18 nt, Artificial Sequence
  Description of Artificial Sequence: Synthetic oligonucleotide
cuccaguccuucagcacu

SEQ ID NO: 140084 - RNA, 18 nt, Artificial Sequence
  Description of Artificial Sequence: Synthetic oligonucleotide
uccggcuccaguccuuca

SEQ ID NO: 140085 - RNA, 18 nt, Artificial Sequence
  Description of Artificial Sequence: Synthetic oligonucleotide
aggcuuccggcuccaguc

SEQ ID NO: 140086 - RNA, 18 nt, Artificial Sequence
  Description of Artificial Sequence: Synthetic oligonucleotide
aacccaggcuuccggcuc

SEQ ID NO: 140087 - RNA, 18 nt, Artificial Sequence
  Description of Artificial Sequence: Synthetic oligonucleotide
gcgugaacccaggcuucc

SEQ ID NO: 140088 - RNA, 18 nt, Artificial Sequence
  Description of Artificial Sequence: Synthetic oligonucleotide
acugggcgugaacccagg

SEQ ID NO: 140089 - RNA, 18 nt, Artificial Sequence
  Description of Artificial Sequence: Synthetic oligonucleotide
accgcacugggcgugaac

SEQ ID NO: 140090 - RNA, 18 nt, Artificial Sequence
  Description of Artificial Sequence: Synthetic oligonucleotide
uccccaccgcacugggcg

SEQ ID NO: 140091 - RNA, 18 nt, Artificial Sequence
  Description of Artificial Sequence: Synthetic oligonucleotide
gcagauccccaccgcacu

SEQ ID NO: 140092 - RNA, 18 nt, Artificial Sequence
  Description of Artificial Sequence: Synthetic oligonucleotide
gcagagcagauccccacc

SEQ ID NO: 140093 - RNA, 18 nt, Artificial Sequence
  Description of Artificial Sequence: Synthetic oligonucleotide
gaguggcagagcagaucc

SEQ ID NO: 140094 - RNA, 18 nt, Artificial Sequence
  Description of Artificial Sequence: Synthetic oligonucleotide
cuggugaguggcagagca

SEQ ID NO: 140095 - RNA, 18 nt, Artificial Sequence
  Description of Artificial Sequence: Synthetic oligonucleotide
cacugcuggugaguggca

SEQ ID NO: 140096 - RNA, 18 nt, Artificial Sequence
  Description of Artificial Sequence: Synthetic oligonucleotide
ggccccacugcuggugag

SEQ ID NO: 140097 - RNA, 18 nt, Artificial Sequence
  Description of Artificial Sequence: Synthetic oligonucleotide
cuccaggccccacugcug

SEQ ID NO: 140098 - RNA, 18 nt, Artificial Sequence
  Description of Artificial Sequence: Synthetic oligonucleotide
gcuugcuccaggccccac

SEQ ID NO: 140099 - RNA, 18 nt, Artificial Sequence
  Description of Artificial Sequence: Synthetic oligonucleotide
gugcagcuugcuccaggc

SEQ ID NO: 140100 - RNA, 18 nt, Artificial Sequence
  Description of Artificial Sequence: Synthetic oligonucleotide
aaguggugcagcuugcuc

SEQ ID NO: 140101 - RNA, 18 nt, Artificial Sequence
  Description of Artificial Sequence: Synthetic oligonucleotide
gaaggaaguggugcagcu

SEQ ID NO: 140102 - RNA, 18 nt, Artificial Sequence
  Description of Artificial Sequence: Synthetic oligonucleotide
uuacagaaggaaguggug

SEQ ID NO: 140103 - RNA, 18 nt, Artificial Sequence
  Description of Artificial Sequence: Synthetic oligonucleotide
cuguuuuacagaaggaag

SEQ ID NO: 140104 - RNA, 18 nt, Artificial Sequence
  Description of Artificial Sequence: Synthetic oligonucleotide
uuggccuguuuuacagaa

SEQ ID NO: 140105 - RNA, 18 nt, Artificial Sequence
  Description of Artificial Sequence: Synthetic oligonucleotide
auccuuuggccuguuuua

SEQ ID NO: 140106 - RNA, 18 nt, Artificial Sequence
  Description of Artificial Sequence: Synthetic oligonucleotide
cuaccauccuuuggccug

SEQ ID NO: 140107 - RNA, 18 nt, Artificial Sequence
  Description of Artificial Sequence: Synthetic oligonucleotide
aucaccuaccauccuuug

SEQ ID NO: 140108 - RNA, 18 nt, Artificial Sequence
  Description of Artificial Sequence: Synthetic oligonucleotide
uccacaucaccuaccauc

SEQ ID NO: 140109 - RNA, 18 nt, Artificial Sequence
  Description of Artificial Sequence: Synthetic oligonucleotide
ccauauccacaucaccua

SEQ ID NO: 140110 - RNA, 18 nt, Artificial Sequence
  Description of Artificial Sequence: Synthetic oligonucleotide
aaagcccauauccacauc

SEQ ID NO: 140111 - RNA, 18 nt, Artificial Sequence
  Description of Artificial Sequence: Synthetic oligonucleotide
ucacgaaagcccauaucc

SEQ ID NO: 140112 - RNA, 18 nt, Artificial Sequence
  Description of Artificial Sequence: Synthetic oligonucleotide
aauucucacgaaagccca

SEQ ID NO: 140113 - RNA, 18 nt, Artificial Sequence
  Description of Artificial Sequence: Synthetic oligonucleotide
cauuuaauucucacgaaa

SEQ ID NO: 140114 - RNA, 18 nt, Artificial Sequence
  Description of Artificial Sequence: Synthetic oligonucleotide
ccacucauuuaauucuca

SEQ ID NO: 140115 - RNA, 18 nt, Artificial Sequence
  Description of Artificial Sequence: Synthetic oligonucleotide
gaugcccacucauuuaau

SEQ ID NO: 140116 - RNA, 18 nt, Artificial Sequence
  Description of Artificial Sequence: Synthetic oligonucleotide
uuacagaugcccacucau

SEQ ID NO: 140117 - RNA, 18 nt, Artificial Sequence
  Description of Artificial Sequence: Synthetic oligonucleotide
auguguuacagaugccca

SEQ ID NO: 140118 - RNA, 18 nt, Artificial Sequence
  Description of Artificial Sequence: Synthetic oligonucleotide
augacauguguuacagau

SEQ ID NO: 140119 - RNA, 18 nt, Artificial Sequence
  Description of Artificial Sequence: Synthetic oligonucleotide
ugaugaugacauguguua

SEQ ID NO: 140120 - RNA, 18 nt, Artificial Sequence
  Description of Artificial Sequence: Synthetic oligonucleotide
aauaaugaugaugacaug

SEQ ID NO: 140121 - RNA, 18 nt, Artificial Sequence
  Description of Artificial Sequence: Synthetic oligonucleotide
auacuaauaaugaugaug

SEQ ID NO: 140122 - RNA, 18 nt, Artificial Sequence
  Description of Artificial Sequence: Synthetic oligonucleotide
ugggaauacuaauaauga

SEQ ID NO: 140123 - RNA, 18 nt, Artificial Sequence
  Description of Artificial Sequence: Synthetic oligonucleotide
aguggugggaauacuaau

SEQ ID NO: 140124 - RNA, 18 nt, Artificial Sequence
  Description of Artificial Sequence: Synthetic oligonucleotide
uuaacaguggugggaaua

SEQ ID NO: 140125 - RNA, 18 nt, Artificial Sequence
  Description of Artificial Sequence: Synthetic oligonucleotide
uuguguuaacaguggugg

SEQ ID NO: 140126 - RNA, 18 nt, Artificial Sequence
  Description of Artificial Sequence: Synthetic oligonucleotide
augccuuguguuaacagu

SEQ ID NO: 140127 - RNA, 18 nt, Artificial Sequence
  Description of Artificial Sequence: Synthetic oligonucleotide
cucagaugccuuguguua

SEQ ID NO: 140128 - RNA, 18 nt, Artificial Sequence
  Description of Artificial Sequence: Synthetic oligonucleotide
uuggucucagaugccuug

SEQ ID NO: 140129 - RNA, 18 nt, Artificial Sequence
  Description of Artificial Sequence: Synthetic oligonucleotide
ggagauuggucucagaug

SEQ ID NO: 140130 - RNA, 18 nt, Artificial Sequence
  Description of Artificial Sequence: Synthetic oligonucleotide
uuaguggagauuggucuc

SEQ ID NO: 140131 - RNA, 18 nt, Artificial Sequence
  Description of Artificial Sequence: Synthetic oligonucleotide
ugcuguuaguggagauug

SEQ ID NO: 140132 - RNA, 18 nt, Artificial Sequence
  Description of Artificial Sequence: Synthetic oligonucleotide
uagugugcuguuagugga

SEQ ID NO: 140133 - RNA, 18 nt, Artificial Sequence
  Description of Artificial Sequence: Synthetic oligonucleotide
cuuucuagugugcuguua

SEQ ID NO: 140134 - RNA, 18 nt, Artificial Sequence
  Description of Artificial Sequence: Synthetic oligonucleotide
cugaucuuucuagugugc

SEQ ID NO: 140135 - RNA, 18 nt, Artificial Sequence
  Description of Artificial Sequence: Synthetic oligonucleotide
uacagcugaucuuucuag

SEQ ID NO: 140136 - RNA, 18 nt, Artificial Sequence
  Description of Artificial Sequence: Synthetic oligonucleotide
ccagguacagcugaucuu

SEQ ID NO: 140137 - RNA, 18 nt, Artificial Sequence
  Description of Artificial Sequence: Synthetic oligonucleotide
caaucccagguacagcug

SEQ ID NO: 140138 - RNA, 18 nt, Artificial Sequence
  Description of Artificial Sequence: Synthetic oligonucleotide
cauaacaaucccagguac

SEQ ID NO: 140139 - RNA, 18 nt, Artificial Sequence
  Description of Artificial Sequence: Synthetic oligonucleotide
cugaucauaacaauccca

SEQ ID NO: 140140 - RNA, 18 nt, Artificial Sequence
  Description of Artificial Sequence: Synthetic oligonucleotide
uucgacugaucauaacaa

SEQ ID NO: 140141 - RNA, 18 nt, Artificial Sequence
  Description of Artificial Sequence: Synthetic oligonucleotide
uguguuucgacugaucau

SEQ ID NO: 140142 - RNA, 18 nt, Artificial Sequence
  Description of Artificial Sequence: Synthetic oligonucleotide
aacuguguguuucgacug

SEQ ID NO: 140143 - RNA, 18 nt, Artificial Sequence
  Description of Artificial Sequence: Synthetic oligonucleotide
aauugaacuguguguuuc

SEQ ID NO: 140144 - RNA, 18 nt, Artificial Sequence
  Description of Artificial Sequence: Synthetic oligonucleotide
agaccaauugaacugugu

SEQ ID NO: 140145 - RNA, 18 nt, Artificial Sequence
  Description of Artificial Sequence: Synthetic oligonucleotide
uuaccagaccaauugaac

SEQ ID NO: 140146 - RNA, 18 nt, Artificial Sequence
  Description of Artificial Sequence: Synthetic oligonucleotide
aauuauuaccagaccaau

SEQ ID NO: 140147 - RNA, 18 nt, Artificial Sequence
  Description of Artificial Sequence: Synthetic oligonucleotide
uguauaauuauuaccaga

SEQ ID NO: 140148 - RNA, 18 nt, Artificial Sequence
  Description of Artificial Sequence: Synthetic oligonucleotide
ugauguguauaauuauua

SEQ ID NO: 140149 - RNA, 18 nt, Artificial Sequence
  Description of Artificial Sequence: Synthetic oligonucleotide
aaugaugauguguauaau

SEQ ID NO: 140150 - RNA, 18 nt, Artificial Sequence
  Description of Artificial Sequence: Synthetic oligonucleotide
ggcucaaugaugaugugu

SEQ ID NO: 140151 - RNA, 18 nt, Artificial Sequence
  Description of Artificial Sequence: Synthetic oligonucleotide
gauacggcucaaugauga

SEQ ID NO: 140152 - RNA, 18 nt, Artificial Sequence
  Description of Artificial Sequence: Synthetic oligonucleotide
auuaugauacggcucaau

SEQ ID NO: 140153 - RNA, 18 nt, Artificial Sequence
  Description of Artificial Sequence: Synthetic oligonucleotide
aucuaauuaugauacggc

SEQ ID NO: 140154 - RNA, 18 nt, Artificial Sequence
  Description of Artificial Sequence: Synthetic oligonucleotide
uuuuuaucuaauuaugau

SEQ ID NO: 140155 - RNA, 18 nt, Artificial Sequence
  Description of Artificial Sequence: Synthetic oligonucleotide
uagcauuuuuaucuaauu

SEQ ID NO: 140156 - RNA, 18 nt, Artificial Sequence
  Description of Artificial Sequence: Synthetic oligonucleotide
cugcuuagcauuuuuauc

SEQ ID NO: 140157 - RNA, 18 nt, Artificial Sequence
  Description of Artificial Sequence: Synthetic oligonucleotide
acuaacugcuuagcauuu

SEQ ID NO: 140158 - RNA, 18 nt, Artificial Sequence
  Description of Artificial Sequence: Synthetic oligonucleotide
uucauacuaacugcuuag

SEQ ID NO: 140159 - RNA, 18 nt, Artificial Sequence
  Description of Artificial Sequence: Synthetic oligonucleotide
aguuauucauacuaacug

SEQ ID NO: 140160 - RNA, 18 nt, Artificial Sequence
  Description of Artificial Sequence: Synthetic oligonucleotide
aguugaguuauucauacu

SEQ ID NO: 140161 - RNA, 18 nt, Artificial Sequence
  Description of Artificial Sequence: Synthetic oligonucleotide
auauuaguugaguuauuc

SEQ ID NO: 140162 - RNA, 18 nt, Artificial Sequence
  Description of Artificial Sequence: Synthetic oligonucleotide
cacaggaaguucuauucu

SEQ ID NO: 140163 - RNA, 18 nt, Artificial Sequence
  Description of Artificial Sequence: Synthetic oligonucleotide
ucccccacaggaaguucu

SEQ ID NO: 140164 - RNA, 18 nt, Artificial Sequence
  Description of Artificial Sequence: Synthetic oligonucleotide
caccaucccccacaggaa

SEQ ID NO: 140165 - RNA, 18 nt, Artificial Sequence
  Description of Artificial Sequence: Synthetic oligonucleotide
cuccccaccaucccccac

SEQ ID NO: 140166 - RNA, 18 nt, Artificial Sequence
  Description of Artificial Sequence: Synthetic oligonucleotide
cuagccuccccaccaucc

SEQ ID NO: 140167 - RNA, 18 nt, Artificial Sequence
  Description of Artificial Sequence: Synthetic oligonucleotide
cagagcuagccuccccac

SEQ ID NO: 140168 - RNA, 18 nt, Artificial Sequence
  Description of Artificial Sequence: Synthetic oligonucleotide
cucugcagagcuagccuc

SEQ ID NO: 140169 - RNA, 18 nt, Artificial Sequence
  Description of Artificial Sequence: Synthetic oligonucleotide
uagaccucugcagagcua

SEQ ID NO: 140170 - RNA, 18 nt, Artificial Sequence
  Description of Artificial Sequence: Synthetic oligonucleotide
gacuguagaccucugcag

SEQ ID NO: 140171 - RNA, 18 nt, Artificial Sequence
  Description of Artificial Sequence: Synthetic oligonucleotide
ugcaggacuguagaccuc

SEQ ID NO: 140172 - RNA, 18 nt, Artificial Sequence
  Description of Artificial Sequence: Synthetic oligonucleotide
gaaacugcaggacuguag

SEQ ID NO: 140173 - RNA, 18 nt, Artificial Sequence
  Description of Artificial Sequence: Synthetic oligonucleotide
uugcagaaacugcaggac

SEQ ID NO: 140174 - RNA, 18 nt, Artificial Sequence
  Description of Artificial Sequence: Synthetic oligonucleotide
guguuuugcagaaacugc

SEQ ID NO: 140175 - RNA, 18 nt, Artificial Sequence
  Description of Artificial Sequence: Synthetic oligonucleotide
gcaacguguuuugcagaa

SEQ ID NO: 140176 - RNA, 18 nt, Artificial Sequence
  Description of Artificial Sequence: Synthetic oligonucleotide
ugugugcaacguguuuug

SEQ ID NO: 140177 - RNA, 18 nt, Artificial Sequence
  Description of Artificial Sequence: Synthetic oligonucleotide
ggagaugugugcaacgug

SEQ ID NO: 140178 - RNA, 18 nt, Artificial Sequence
  Description of Artificial Sequence: Synthetic oligonucleotide
cauauggagaugugugca

SEQ ID NO: 140179 - RNA, 18 nt, Artificial Sequence
  Description of Artificial Sequence: Synthetic oligonucleotide
uggcccauauggagaugu

SEQ ID NO: 140180 - RNA, 18 nt, Artificial Sequence
  Description of Artificial Sequence: Synthetic oligonucleotide
ccguguggcccauaugga

SEQ ID NO: 140181 - RNA, 18 nt, Artificial Sequence
  Description of Artificial Sequence: Synthetic oligonucleotide
ugccaccguguggcccau

SEQ ID NO: 140182 - RNA, 18 nt, Artificial Sequence
  Description of Artificial Sequence: Synthetic oligonucleotide
gagguugccaccgugugg

SEQ ID NO: 140183 - RNA, 18 nt, Artificial Sequence
  Description of Artificial Sequence: Synthetic oligonucleotide
guucagagguugccaccg

SEQ ID NO: 140184 - RNA, 18 nt, Artificial Sequence
  Description of Artificial Sequence: Synthetic oligonucleotide
uccugguucagagguugc

SEQ ID NO: 140185 - RNA, 18 nt, Artificial Sequence
  Description of Artificial Sequence: Synthetic oligonucleotide
agcucuccugguucagag

SEQ ID NO: 140186 - RNA, 18 nt, Artificial Sequence
  Description of Artificial Sequence: Synthetic oligonucleotide
gaagcagcucuccugguu

SEQ ID NO: 140187 - RNA, 18 nt, Artificial Sequence
  Description of Artificial Sequence: Synthetic oligonucleotide
cuuaggaagcagcucucc

SEQ ID NO: 140188 - RNA, 18 nt, Artificial Sequence
  Description of Artificial Sequence: Synthetic oligonucleotide
uagcccuuaggaagcagc

SEQ ID NO: 140189 - RNA, 18 nt, Artificial Sequence
  Description of Artificial Sequence: Synthetic oligonucleotide
ggucuuagcccuuaggaa

SEQ ID NO: 140190 - RNA, 18 nt, Artificial Sequence
  Description of Artificial Sequence: Synthetic oligonucleotide
cagagggucuuagcccuu

SEQ ID NO: 140191 - RNA, 18 nt, Artificial Sequence
  Description of Artificial Sequence: Synthetic oligonucleotide
gcagacagagggucuuag

SEQ ID NO: 140192 - RNA, 18 nt, Artificial Sequence
  Description of Artificial Sequence: Synthetic oligonucleotide
agaaagcagacagagggu

SEQ ID NO: 140193 - RNA, 18 nt, Artificial Sequence
  Description of Artificial Sequence: Synthetic oligonucleotide
gagagagaaagcagacag

SEQ ID NO: 140194 - RNA, 18 nt, Artificial Sequence
  Description of Artificial Sequence: Synthetic oligonucleotide
agcaagagagagaaagca

SEQ ID NO: 140195 - RNA, 18 nt, Artificial Sequence
  Description of Artificial Sequence: Synthetic oligonucleotide
aggaaagcaagagagaga

SEQ ID NO: 140196 - RNA, 18 nt, Artificial Sequence
  Description of Artificial Sequence: Synthetic oligonucleotide
uugggaggaaagcaagag

SEQ ID NO: 140197 - RNA, 18 nt, Artificial Sequence
  Description of Artificial Sequence: Synthetic oligonucleotide
guguuuugggaggaaagc

SEQ ID NO: 140198 - RNA, 18 nt, Artificial Sequence
  Description of Artificial Sequence: Synthetic oligonucleotide
uggcuguguuuugggagg

SEQ ID NO: 140199 - RNA, 18 nt, Artificial Sequence
  Description of Artificial Sequence: Synthetic oligonucleotide
gaggauggcuguguuuug

SEQ ID NO: 140200 - RNA, 18 nt, Artificial Sequence
  Description of Artificial Sequence: Synthetic oligonucleotide
gggaggaggauggcugug

SEQ ID NO: 140201 - RNA, 18 nt, Artificial Sequence
  Description of Artificial Sequence: Synthetic oligonucleotide
ggcugaacucaccauggg

SEQ ID NO: 140202 - RNA, 18 nt, Artificial Sequence
  Description of Artificial Sequence: Synthetic oligonucleotide
ugggcugaacucaccaug

SEQ ID NO: 140203 - RNA, 18 nt, Artificial Sequence
  Description of Artificial Sequence: Synthetic oligonucleotide
cuuccugggcugaacuca

SEQ ID NO: 140204 - RNA, 18 nt, Artificial Sequence
  Description of Artificial Sequence: Synthetic oligonucleotide
agaggcuuccugggcuga

SEQ ID NO: 140205 - RNA, 18 nt, Artificial Sequence
  Description of Artificial Sequence: Synthetic oligonucleotide
gggucagaggcuuccugg

SEQ ID NO: 140206 - RNA, 18 nt, Artificial Sequence
  Description of Artificial Sequence: Synthetic oligonucleotide
gggcugggucagaggcuu

SEQ ID NO: 140207 - RNA, 18 nt, Artificial Sequence
  Description of Artificial Sequence: Synthetic oligonucleotide
caucagggcugggucaga

SEQ ID NO: 140208 - RNA, 18 nt, Artificial Sequence
  Description of Artificial Sequence: Synthetic oligonucleotide
auuaccaucagggcuggg

SEQ ID NO: 140209 - RNA, 18 nt, Artificial Sequence
  Description of Artificial Sequence: Synthetic oligonucleotide
cagcuauuaccaucaggg

SEQ ID NO: 140210 - RNA, 18 nt, Artificial Sequence
  Description of Artificial Sequence: Synthetic oligonucleotide
cacagcagcuauuaccau

SEQ ID NO: 140211 - RNA, 18 nt, Artificial Sequence
  Description of Artificial Sequence: Synthetic oligonucleotide
caguacacagcagcuauu

SEQ ID NO: 140212 - RNA, 18 nt, Artificial Sequence
  Description of Artificial Sequence: Synthetic oligonucleotide
auguccaguacacagcag

SEQ ID NO: 140213 - RNA, 18 nt, Artificial Sequence
  Description of Artificial Sequence: Synthetic oligonucleotide
agaagauguccaguacac

SEQ ID NO: 140214 - RNA, 18 nt, Artificial Sequence
  Description of Artificial Sequence: Synthetic oligonucleotide
cauacagaagauguccag

SEQ ID NO: 140215 - RNA, 18 nt, Artificial Sequence
  Description of Artificial Sequence: Synthetic oligonucleotide
ccuaacauacagaagaug

SEQ ID NO: 140216 - RNA, 18 nt, Artificial Sequence
  Description of Artificial Sequence: Synthetic oligonucleotide
cagagccuaacauacaga

SEQ ID NO: 140217 - RNA, 18 nt, Artificial Sequence
  Description of Artificial Sequence: Synthetic oligonucleotide
ucucccagagccuaacau

SEQ ID NO: 140218 - RNA, 18 nt, Artificial Sequence
  Description of Artificial Sequence: Synthetic oligonucleotide
gcauuucucccagagccu

SEQ ID NO: 140219 - RNA, 18 nt, Artificial Sequence
  Description of Artificial Sequence: Synthetic oligonucleotide
ccacagcauuucucccag

SEQ ID NO: 140220 - RNA, 18 nt, Artificial Sequence
  Description of Artificial Sequence: Synthetic oligonucleotide
agucuccacagcauuucu

SEQ ID NO: 140221 - RNA, 18 nt, Artificial Sequence
  Description of Artificial Sequence: Synthetic oligonucleotide
caaaaagucuccacagca

SEQ ID NO: 140222 - RNA, 18 nt, Artificial Sequence
  Description of Artificial Sequence: Synthetic oligonucleotide
augggcaaaaagucucca

SEQ ID NO: 140223 - RNA, 18 nt, Artificial Sequence
  Description of Artificial Sequence: Synthetic oligonucleotide
ggaggaugggcaaaaagu

SEQ ID NO: 140224 - RNA, 18 nt, Artificial Sequence
  Description of Artificial Sequence: Synthetic oligonucleotide
cucugggaggaugggcaa

SEQ ID NO: 140225 - RNA, 18 nt, Artificial Sequence
  Description of Artificial Sequence: Synthetic oligonucleotide
agcuucucugggaggaug

SEQ ID NO: 140226 - RNA, 18 nt, Artificial Sequence
  Description of Artificial Sequence: Synthetic oligonucleotide
cugacagcuucucuggga

SEQ ID NO: 140227 - RNA, 18 nt, Artificial Sequence
  Description of Artificial Sequence: Synthetic oligonucleotide
ggguacugacagcuucuc

SEQ ID NO: 140228 - RNA, 18 nt, Artificial Sequence
  Description of Artificial Sequence: Synthetic oligonucleotide
ucuucaccuagaacaggg

SEQ ID NO: 140229 - RNA, 18 nt, Artificial Sequence
  Description of Artificial Sequence: Synthetic oligonucleotide
guuucuucaccuagaaca

SEQ ID NO: 140230 - RNA, 18 nt, Artificial Sequence
  Description of Artificial Sequence: Synthetic oligonucleotide
gaccaguuucuucaccua

SEQ ID NO: 140231 - RNA, 18 nt, Artificial Sequence
  Description of Artificial Sequence: Synthetic oligonucleotide
cugaggaccaguuucuuc

SEQ ID NO: 140232 - RNA, 18 nt, Artificial Sequence
  Description of Artificial Sequence: Synthetic oligonucleotide
ccuuucugaggaccaguu

SEQ ID NO: 140233 - RNA, 18 nt, Artificial Sequence
  Description of Artificial Sequence: Synthetic oligonucleotide
gucaaccuuucugaggac

SEQ ID NO: 140234 - RNA, 18 nt, Artificial Sequence
  Description of Artificial Sequence: Synthetic oligonucleotide
agggagucaaccuuucug

SEQ ID NO: 140235 - RNA, 18 nt, Artificial Sequence
  Description of Artificial Sequence: Synthetic oligonucleotide
gccucagggagucaaccu

SEQ ID NO: 140236 - RNA, 18 nt, Artificial Sequence
  Description of Artificial Sequence: Synthetic oligonucleotide
guguggccucagggaguc

SEQ ID NO: 140237 - RNA, 18 nt, Artificial Sequence
  Description of Artificial Sequence: Synthetic oligonucleotide
cagcuguguggccucagg

SEQ ID NO: 140238 - RNA, 18 nt, Artificial Sequence
  Description of Artificial Sequence: Synthetic oligonucleotide
cuuaacagcuguguggcc

SEQ ID NO: 140239 - RNA, 18 nt, Artificial Sequence
  Description of Artificial Sequence: Synthetic oligonucleotide
agccacuuaacagcugug

SEQ ID NO: 140240 - RNA, 18 nt, Artificial Sequence
  Description of Artificial Sequence: Synthetic oligonucleotide
gccucagccacuuaacag

SEQ ID NO: 140241 - RNA, 18 nt, Artificial Sequence
  Description of Artificial Sequence: Synthetic oligonucleotide
cccucgccucagccacuu

SEQ ID NO: 140242 - RNA, 18 nt, Artificial Sequence
  Description of Artificial Sequence: Synthetic oligonucleotide
cacagcccucgccucagc

SEQ ID NO: 140243 - RNA, 18 nt, Artificial Sequence
  Description of Artificial Sequence: Synthetic oligonucleotide
agccccacagcccucgcc

SEQ ID NO: 140244 - RNA, 18 nt, Artificial Sequence
  Description of Artificial Sequence: Synthetic oligonucleotide
ggaacagccccacagccc

SEQ ID NO: 140245 - RNA, 18 nt, Artificial Sequence
  Description of Artificial Sequence: Synthetic oligonucleotide
gcgugggaacagccccac

SEQ ID NO: 140246 - RNA, 18 nt, Artificial Sequence
  Description of Artificial Sequence: Synthetic oligonucleotide
ccagggcgugggaacagc

SEQ ID NO: 140247 - RNA, 18 nt, Artificial Sequence
  Description of Artificial Sequence: Synthetic oligonucleotide
ggaagccagggcguggga

SEQ ID NO: 140248 - RNA, 18 nt, Artificial Sequence
  Description of Artificial Sequence: Synthetic oligonucleotide
ggccuggaagccagggcg

SEQ ID NO: 140249 - RNA, 18 nt, Artificial Sequence
  Description of Artificial Sequence: Synthetic oligonucleotide
ugccaggccuggaagcca

SEQ ID NO: 140250 - RNA, 18 nt, Artificial Sequence
  Description of Artificial Sequence: Synthetic oligonucleotide
caugcugccaggccugga

SEQ ID NO: 140251 - RNA, 18 nt, Artificial Sequence
  Description of Artificial Sequence: Synthetic oligonucleotide
cuccacaugcugccaggc

SEQ ID NO: 140252 - RNA, 18 nt, Artificial Sequence
  Description of Artificial Sequence: Synthetic oligonucleotide
ggcagcuccacaugcugc

SEQ ID NO: 140253 - RNA, 18 nt, Artificial Sequence
  Description of Artificial Sequence: Synthetic oligonucleotide
gaggagcuccgggagagg

SEQ ID NO: 140254 - RNA, 18 nt, Artificial Sequence
  Description of Artificial Sequence: Synthetic oligonucleotide
guggcgaggagcuccggg

SEQ ID NO: 140255 - RNA, 18 nt, Artificial Sequence
  Description of Artificial Sequence: Synthetic oligonucleotide
ugaggguggcgaggagcu

SEQ ID NO: 140256 - RNA, 18 nt, Artificial Sequence
  Description of Artificial Sequence: Synthetic oligonucleotide
agcagugaggguggcgag

SEQ ID NO: 140257 - RNA, 18 nt, Artificial Sequence
  Description of Artificial Sequence: Synthetic oligonucleotide
gguccagcagugagggug

SEQ ID NO: 140258 - RNA, 18 nt, Artificial Sequence
  Description of Artificial Sequence: Synthetic oligonucleotide
caguugguccagcaguga

SEQ ID NO: 140259 - RNA, 18 nt, Artificial Sequence
  Description of Artificial Sequence: Synthetic oligonucleotide
aucugcaguugguccagc

SEQ ID NO: 140260 - RNA, 18 nt, Artificial Sequence
  Description of Artificial Sequence: Synthetic oligonucleotide
agcccaucugcaguuggu

SEQ ID NO: 140261 - RNA, 18 nt, Artificial Sequence
  Description of Artificial Sequence: Synthetic oligonucleotide
gucacagcccaucugcag

SEQ ID NO: 140262 - RNA, 18 nt, Artificial Sequence
  Description of Artificial Sequence: Synthetic oligonucleotide
gccccgucacagcccauc

SEQ ID NO: 140263 - RNA, 18 nt, Artificial Sequence
  Description of Artificial Sequence: Synthetic oligonucleotide
augaggccccgucacagc

SEQ ID NO: 140264 - RNA, 18 nt, Artificial Sequence
  Description of Artificial Sequence: Synthetic oligonucleotide
gccgcaugaggccccguc

SEQ ID NO: 140265 - RNA, 18 nt, Artificial Sequence
  Description of Artificial Sequence: Synthetic oligonucleotide
aggcugccgcaugaggcc

SEQ ID NO: 140266 - RNA, 18 nt, Artificial Sequence
  Description of Artificial Sequence: Synthetic oligonucleotide
uguugaggcugccgcaug

SEQ ID NO: 140267 - RNA, 18 nt, Artificial Sequence
  Description of Artificial Sequence: Synthetic oligonucleotide
cuccauguugaggcugcc

SEQ ID NO: 140268 - RNA, 18 nt, Artificial Sequence
  Description of Artificial Sequence: Synthetic oligonucleotide
cggcacuccauguugagg

SEQ ID NO: 140269 - RNA, 18 nt, Artificial Sequence
  Description of Artificial Sequence: Synthetic oligonucleotide
acacccggcacuccaugu

SEQ ID NO: 140270 - RNA, 18 nt, Artificial Sequence
  Description of Artificial Sequence: Synthetic oligonucleotide
cccgcacacccggcacuc

SEQ ID NO: 140271 - RNA, 18 nt, Artificial Sequence
  Description of Artificial Sequence: Synthetic oligonucleotide
uuguccccgcacacccgg

SEQ ID NO: 140272 - RNA, 18 nt, Artificial Sequence
  Description of Artificial Sequence: Synthetic oligonucleotide
augccuuguccccgcaca

SEQ ID NO: 140273 - RNA, 18 nt, Artificial Sequence
  Description of Artificial Sequence: Synthetic oligonucleotide
gcccgaugccuugucccc

SEQ ID NO: 140274 - RNA, 18 nt, Artificial Sequence
  Description of Artificial Sequence: Synthetic oligonucleotide
uggaagcccgaugccuug

SEQ ID NO: 140275 - RNA, 18 nt, Artificial Sequence
  Description of Artificial Sequence: Synthetic oligonucleotide
cguaguggaagcccgaug

SEQ ID NO: 140276 - RNA, 18 nt, Artificial Sequence
  Description of Artificial Sequence: Synthetic oligonucleotide
aacaccguaguggaagcc

SEQ ID NO: 140277 - RNA, 18 nt, Artificial Sequence
  Description of Artificial Sequence: Synthetic oligonucleotide
gcaugaacaccguagugg

SEQ ID NO: 140278 - RNA, 18 nt, Artificial Sequence
  Description of Artificial Sequence: Synthetic oligonucleotide
cacaugcaugaacaccgu

SEQ ID NO: 140279 - RNA, 18 nt, Artificial Sequence
  Description of Artificial Sequence: Synthetic oligonucleotide
ccccucacaugcaugaac

SEQ ID NO: 140280 - RNA, 18 nt, Artificial Sequence
  Description of Artificial Sequence: Synthetic oligonucleotide
uugcaccccucacaugca

SEQ ID NO: 140281 - RNA, 18 nt, Artificial Sequence
  Description of Artificial Sequence: Synthetic oligonucleotide
ggcgaggagcuccgggag

SEQ ID NO: 140282 - RNA, 18 nt, Artificial Sequence
  Description of Artificial Sequence: Synthetic oligonucleotide
aggguggcgaggagcucc

SEQ ID NO: 140283 - RNA, 18 nt, Artificial Sequence
  Description of Artificial Sequence: Synthetic oligonucleotide
cagugaggguggcgagga

SEQ ID NO: 140284 - RNA, 18 nt, Artificial Sequence
  Description of Artificial Sequence: Synthetic oligonucleotide
uccagcagugaggguggc

SEQ ID NO: 140285 - RNA, 18 nt, Artificial Sequence
  Description of Artificial Sequence: Synthetic oligonucleotide
guugguccagcagugagg

SEQ ID NO: 140286 - RNA, 18 nt, Artificial Sequence
  Description of Artificial Sequence: Synthetic oligonucleotide
cugcaguugguccagcag

SEQ ID NO: 140287 - RNA, 18 nt, Artificial Sequence
  Description of Artificial Sequence: Synthetic oligonucleotide
cccaucugcaguuggucc

SEQ ID NO: 140288 - RNA, 18 nt, Artificial Sequence
  Description of Artificial Sequence: Synthetic oligonucleotide
cacagcccaucugcaguu

SEQ ID NO: 140289 - RNA, 18 nt, Artificial Sequence
  Description of Artificial Sequence: Synthetic oligonucleotide
cccgucacagcccaucug

SEQ ID NO: 140290 - RNA, 18 nt, Artificial Sequence
  Description of Artificial Sequence: Synthetic oligonucleotide
gaggccccgucacagccc

SEQ ID NO: 140291 - RNA, 18 nt, Artificial Sequence
  Description of Artificial Sequence: Synthetic oligonucleotide
cgcaugaggccccgucac

SEQ ID NO: 140292 - RNA, 18 nt, Artificial Sequence
  Description of Artificial Sequence: Synthetic oligonucleotide
gcugccgcaugaggcccc

SEQ ID NO: 140293 - RNA, 18 nt, Artificial Sequence
  Description of Artificial Sequence: Synthetic oligonucleotide
uugaggcugccgcaugag

SEQ ID NO: 140294 - RNA, 18 nt, Artificial Sequence
  Description of Artificial Sequence: Synthetic oligonucleotide
ccauguugaggcugccgc

SEQ ID NO: 140295 - RNA, 18 nt, Artificial Sequence
  Description of Artificial Sequence: Synthetic oligonucleotide
gcacuccauguugaggcu

SEQ ID NO: 140296 - RNA, 18 nt, Artificial Sequence
  Description of Artificial Sequence: Synthetic oligonucleotide
acccggcacuccauguug

SEQ ID NO: 140297 - RNA, 18 nt, Artificial Sequence
  Description of Artificial Sequence: Synthetic oligonucleotide
cgcacacccggcacucca

SEQ ID NO: 140298 - RNA, 18 nt, Artificial Sequence
  Description of Artificial Sequence: Synthetic oligonucleotide
guccccgcacacccggca

SEQ ID NO: 140299 - RNA, 18 nt, Artificial Sequence
  Description of Artificial Sequence: Synthetic oligonucleotide
gccuuguccccgcacacc

SEQ ID NO: 140300 - RNA, 18 nt, Artificial Sequence
  Description of Artificial Sequence: Synthetic oligonucleotide
ccgaugccuuguccccgc

SEQ ID NO: 140301 - RNA, 18 nt, Artificial Sequence
  Description of Artificial Sequence: Synthetic oligonucleotide
gaagcccgaugccuuguc

SEQ ID NO: 140302 - RNA, 18 nt, Artificial Sequence
  Description of Artificial Sequence: Synthetic oligonucleotide
uaguggaagcccgaugcc

SEQ ID NO: 140303 - RNA, 18 nt, Artificial Sequence
  Description of Artificial Sequence: Synthetic oligonucleotide
caccguaguggaagcccg

SEQ ID NO: 140304 - RNA, 18 nt, Artificial Sequence
  Description of Artificial Sequence: Synthetic oligonucleotide
augaacaccguaguggaa

SEQ ID NO: 140305 - RNA, 18 nt, Artificial Sequence
  Description of Artificial Sequence: Synthetic oligonucleotide
caugcaugaacaccguag

SEQ ID NO: 140306 - RNA, 18 nt, Artificial Sequence
  Description of Artificial Sequence: Synthetic oligonucleotide
ccucacaugcaugaacac

SEQ ID NO: 140307 - RNA, 18 nt, Artificial Sequence
  Description of Artificial Sequence: Synthetic oligonucleotide
gcaccccucacaugcaug

SEQ ID NO: 140308 - RNA, 18 nt, Artificial Sequence
  Description of Artificial Sequence: Synthetic oligonucleotide
ccaccgcuccccccaguc

SEQ ID NO: 140309 - RNA, 18 nt, Artificial Sequence
  Description of Artificial Sequence: Synthetic oligonucleotide
gccagccaccgcuccccc

SEQ ID NO: 140310 - RNA, 18 nt, Artificial Sequence
  Description of Artificial Sequence: Synthetic oligonucleotide
caguggccagccaccgcu

SEQ ID NO: 140311 - RNA, 18 nt, Artificial Sequence
  Description of Artificial Sequence: Synthetic oligonucleotide
agccucaguggccagcca

SEQ ID NO: 140312 - RNA, 18 nt, Artificial Sequence
  Description of Artificial Sequence: Synthetic oligonucleotide
accacagccucaguggcc

SEQ ID NO: 140313 - RNA, 18 nt, Artificial Sequence
  Description of Artificial Sequence: Synthetic oligonucleotide
augugaccacagccucag

SEQ ID NO: 140314 - RNA, 18 nt, Artificial Sequence
  Description of Artificial Sequence: Synthetic oligonucleotide
ucaccaugugaccacagc

SEQ ID NO: 140315 - RNA, 18 nt, Artificial Sequence
  Description of Artificial Sequence: Synthetic oligonucleotide
ucaauucaccaugugacc

SEQ ID NO: 140316 - RNA, 18 nt, Artificial Sequence
  Description of Artificial Sequence: Synthetic oligonucleotide
gagggucaauucaccaug

SEQ ID NO: 140317 - RNA, 18 nt, Artificial Sequence
  Description of Artificial Sequence: Synthetic oligonucleotide
uuguggagggucaauuca

SEQ ID NO: 140318 - RNA, 18 nt, Artificial Sequence
  Description of Artificial Sequence: Synthetic oligonucleotide
aagcuuuguggaggguca

SEQ ID NO: 140319 - RNA, 18 nt, Artificial Sequence
  Description of Artificial Sequence: Synthetic oligonucleotide
aaggaaagcuuuguggag

SEQ ID NO: 140320 - RNA, 18 nt, Artificial Sequence
  Description of Artificial Sequence: Synthetic oligonucleotide
aaggcaaggaaagcuuug

SEQ ID NO: 140321 - RNA, 18 nt, Artificial Sequence
  Description of Artificial Sequence: Synthetic oligonucleotide
accccaaggcaaggaaag

SEQ ID NO: 140322 - RNA, 18 nt, Artificial Sequence
  Description of Artificial Sequence: Synthetic oligonucleotide
gccccaccccaaggcaag

SEQ ID NO: 140323 - RNA, 18 nt, Artificial Sequence
  Description of Artificial Sequence: Synthetic oligonucleotide
ucagggccccaccccaag

SEQ ID NO: 140324 - RNA, 18 nt, Artificial Sequence
  Description of Artificial Sequence: Synthetic oligonucleotide
uacagucagggccccacc

SEQ ID NO: 140325 - RNA, 18 nt, Artificial Sequence
  Description of Artificial Sequence: Synthetic oligonucleotide
auagguacagucagggcc

SEQ ID NO: 140326 - RNA, 18 nt, Artificial Sequence
  Description of Artificial Sequence: Synthetic oligonucleotide
cugcaauagguacaguca

SEQ ID NO: 140327 - RNA, 18 nt, Artificial Sequence
  Description of Artificial Sequence: Synthetic oligonucleotide
gaauucugcaauagguac

SEQ ID NO: 140328 - RNA, 18 nt, Artificial Sequence
  Description of Artificial Sequence: Synthetic oligonucleotide
ggcaggaauucugcaaua

SEQ ID NO: 140329 - RNA, 18 nt, Artificial Sequence
  Description of Artificial Sequence: Synthetic oligonucleotide
uccugggcaggaauucug

SEQ ID NO: 140330 - RNA, 18 nt, Artificial Sequence
  Description of Artificial Sequence: Synthetic oligonucleotide
cugccuccugggcaggaa

SEQ ID NO: 140331 - RNA, 18 nt, Artificial Sequence
  Description of Artificial Sequence: Synthetic oligonucleotide
ccuggcugccuccugggc

SEQ ID NO: 140332 - RNA, 18 nt, Artificial Sequence
  Description of Artificial Sequence: Synthetic oligonucleotide
aagggccuggcugccucc

SEQ ID NO: 140333 - RNA, 18 nt, Artificial Sequence
  Description of Artificial Sequence: Synthetic oligonucleotide
agcacaagggccuggcug

SEQ ID NO: 140334 - RNA, 18 nt, Artificial Sequence
  Description of Artificial Sequence: Synthetic oligonucleotide
ucuggagcacaagggccu

SEQ ID NO: 140335 - RNA, 18 nt, Artificial Sequence
  Description of Artificial Sequence: Synthetic oligonucleotide
ugaggucuggagcacaag

SEQ ID NO: 140336 - RNA, 18 nt, Artificial Sequence
  Description of Artificial Sequence: Synthetic oligonucleotide
agagcugaggucuggagc

SEQ ID NO: 140337 - RNA, 18 nt, Artificial Sequence
  Description of Artificial Sequence: Synthetic oligonucleotide
ugcccagagcugaggucu

SEQ ID NO: 140338 - RNA, 18 nt, Artificial Sequence
  Description of Artificial Sequence: Synthetic oligonucleotide
ugcagugcccagagcuga

SEQ ID NO: 140339 - RNA, 18 nt, Artificial Sequence
  Description of Artificial Sequence: Synthetic oligonucleotide
ucuccugcagugcccaga

SEQ ID NO: 140340 - RNA, 18 nt, Artificial Sequence
  Description of Artificial Sequence: Synthetic oligonucleotide
ccucuucuccugcagugc

SEQ ID NO: 140341 - RNA, 18 nt, Artificial Sequence
  Description of Artificial Sequence: Synthetic oligonucleotide
aacccccucuucuccugc

SEQ ID NO: 140342 - RNA, 18 nt, Artificial Sequence
  Description of Artificial Sequence: Synthetic oligonucleotide
aagggaacccccucuucu

SEQ ID NO: 140343 - RNA, 18 nt, Artificial Sequence
  Description of Artificial Sequence: Synthetic oligonucleotide
uugacaagggaacccccu

SEQ ID NO: 140344 - RNA, 18 nt, Artificial Sequence
  Description of Artificial Sequence: Synthetic oligonucleotide
uaggcuugacaagggaac

SEQ ID NO: 140345 - RNA, 18 nt, Artificial Sequence
  Description of Artificial Sequence: Synthetic oligonucleotide
caggguaggcuugacaag

SEQ ID NO: 140346 - RNA, 18 nt, Artificial Sequence
  Description of Artificial Sequence: Synthetic oligonucleotide
cccagcaggguaggcuug

SEQ ID NO: 140347 - RNA, 18 nt, Artificial Sequence
  Description of Artificial Sequence: Synthetic oligonucleotide
aggugcccagcaggguag

SEQ ID NO: 140348 - RNA, 18 nt, Artificial Sequence
  Description of Artificial Sequence: Synthetic oligonucleotide
aacacaggugcccagcag

SEQ ID NO: 140349 - RNA, 18 nt, Artificial Sequence
  Description of Artificial Sequence: Synthetic oligonucleotide
gggucaacacaggugccc

SEQ ID NO: 140350 - RNA, 18 nt, Artificial Sequence
  Description of Artificial Sequence: Synthetic oligonucleotide
gagcugggucaacacagg

SEQ ID NO: 140351 - RNA, 18 nt, Artificial Sequence
  Description of Artificial Sequence: Synthetic oligonucleotide
ccacagagcugggucaac

SEQ ID NO: 140352 - RNA, 18 nt, Artificial Sequence
  Description of Artificial Sequence: Synthetic oligonucleotide
aucacccacagagcuggg

SEQ ID NO: 140353 - RNA, 18 nt, Artificial Sequence
  Description of Artificial Sequence: Synthetic oligonucleotide
acacaaucacccacagag

SEQ ID NO: 140354 - RNA, 18 nt, Artificial Sequence
  Description of Artificial Sequence: Synthetic oligonucleotide
gggacacaaucacccaca

SEQ ID NO: 140355 - RNA, 18 nt, Artificial Sequence
  Description of Artificial Sequence: Synthetic oligonucleotide
gcugccugguccccaggg

SEQ ID NO: 140356 - RNA, 18 nt, Artificial Sequence
  Description of Artificial Sequence: Synthetic oligonucleotide
cccuagcugccugguccc

SEQ ID NO: 140357 - RNA, 18 nt, Artificial Sequence
  Description of Artificial Sequence: Synthetic oligonucleotide
uucugcccuagcugccug

SEQ ID NO: 140358 - RNA, 18 nt, Artificial Sequence
  Description of Artificial Sequence: Synthetic oligonucleotide
ccucauucugcccuagcu

SEQ ID NO: 140359 - RNA, 18 nt, Artificial Sequence
  Description of Artificial Sequence: Synthetic oligonucleotide
aagacccucauucugccc

SEQ ID NO: 140360 - RNA, 18 nt, Artificial Sequence
  Description of Artificial Sequence: Synthetic oligonucleotide
agcccaagacccucauuc

SEQ ID NO: 140361 - RNA, 18 nt, Artificial Sequence
  Description of Artificial Sequence: Synthetic oligonucleotide
ggcucagcccaagacccu

SEQ ID NO: 140362 - RNA, 18 nt, Artificial Sequence
  Description of Artificial Sequence: Synthetic oligonucleotide
acgauggcucagcccaag

SEQ ID NO: 140363 - RNA, 18 nt, Artificial Sequence
  Description of Artificial Sequence: Synthetic oligonucleotide
guaagacgauggcucagc

SEQ ID NO: 140364 - RNA, 18 nt, Artificial Sequence
  Description of Artificial Sequence: Synthetic oligonucleotide
cucagguaagacgauggc

SEQ ID NO: 140365 - RNA, 18 nt, Artificial Sequence
  Description of Artificial Sequence: Synthetic oligonucleotide
cagaccucagguaagacg

SEQ ID NO: 140366 - RNA, 18 nt, Artificial Sequence
  Description of Artificial Sequence: Synthetic oligonucleotide
aaacccagaccucaggua

SEQ ID NO: 140367 - RNA, 18 nt, Artificial Sequence
  Description of Artificial Sequence: Synthetic oligonucleotide
acaagaaacccagaccuc

SEQ ID NO: 140368 - RNA, 18 nt, Artificial Sequence
  Description of Artificial Sequence: Synthetic oligonucleotide
gagaaacaagaaacccag

SEQ ID NO: 140369 - RNA, 18 nt, Artificial Sequence
  Description of Artificial Sequence: Synthetic oligonucleotide
gccuugagaaacaagaaa

SEQ ID NO: 140370 - RNA, 18 nt, Artificial Sequence
  Description of Artificial Sequence: Synthetic oligonucleotide
uuugagccuugagaaaca

SEQ ID NO: 140371 - RNA, 18 nt, Artificial Sequence
  Description of Artificial Sequence: Synthetic oligonucleotide
cccgcuuugagccuugag

SEQ ID NO: 140372 - RNA, 18 nt, Artificial Sequence
  Description of Artificial Sequence: Synthetic oligonucleotide
cagagcccgcuuugagcc

SEQ ID NO: 140373 - RNA, 18 nt, Artificial Sequence
  Description of Artificial Sequence: Synthetic oligonucleotide
uuucucagagcccgcuuu

SEQ ID NO: 140374 - RNA, 18 nt, Artificial Sequence
  Description of Artificial Sequence: Synthetic oligonucleotide
ccuuuuuucucagagccc

SEQ ID NO: 140375 - RNA, 18 nt, Artificial Sequence
  Description of Artificial Sequence: Synthetic oligonucleotide
ucuguccuuuuuucucag

SEQ ID NO: 140376 - RNA, 18 nt, Artificial Sequence
  Description of Artificial Sequence: Synthetic oligonucleotide
aaaugucuguccuuuuuu

SEQ ID NO: 140377 - RNA, 18 nt, Artificial Sequence
  Description of Artificial Sequence: Synthetic oligonucleotide
aaaacaaaugucuguccu

SEQ ID NO: 140378 - RNA, 18 nt, Artificial Sequence
  Description of Artificial Sequence: Synthetic oligonucleotide
cuggaaaaacaaaugucu

SEQ ID NO: 140379 - RNA, 18 nt, Artificial Sequence
  Description of Artificial Sequence: Synthetic oligonucleotide
uaucacuggaaaaacaaa

SEQ ID NO: 140380 - RNA, 18 nt, Artificial Sequence
  Description of Artificial Sequence: Synthetic oligonucleotide
acaaauaucacuggaaaa

SEQ ID NO: 140381 - RNA, 18 nt, Artificial Sequence
  Description of Artificial Sequence: Synthetic oligonucleotide
gacccacaaauaucacug

SEQ ID NO: 140382 - RNA, 18 nt, Artificial Sequence
  Description of Artificial Sequence: Synthetic oligonucleotide
ggaaggacccacaaauau

SEQ ID NO: 140383 - RNA, 18 nt, Artificial Sequence
  Description of Artificial Sequence: Synthetic oligonucleotide
aguuaggaaggacccaca

SEQ ID NO: 140384 - RNA, 18 nt, Artificial Sequence
  Description of Artificial Sequence: Synthetic oligonucleotide
ugugaaguuaggaaggac

SEQ ID NO: 140385 - RNA, 18 nt, Artificial Sequence
  Description of Artificial Sequence: Synthetic oligonucleotide
augggugugaaguuagga

SEQ ID NO: 140386 - RNA, 18 nt, Artificial Sequence
  Description of Artificial Sequence: Synthetic oligonucleotide
uuuugaugggugugaagu

SEQ ID NO: 140387 - RNA, 18 nt, Artificial Sequence
  Description of Artificial Sequence: Synthetic oligonucleotide
ugagauuuugaugggugu

SEQ ID NO: 140388 - RNA, 18 nt, Artificial Sequence
  Description of Artificial Sequence: Synthetic oligonucleotide
aucugugagauuuugaug

SEQ ID NO: 140389 - RNA, 18 nt, Artificial Sequence
  Description of Artificial Sequence: Synthetic oligonucleotide
aaauaaucugugagauuu

SEQ ID NO: 140390 - RNA, 18 nt, Artificial Sequence
  Description of Artificial Sequence: Synthetic oligonucleotide
caauaaaauaaucuguga

SEQ ID NO: 140391 - RNA, 18 nt, Artificial Sequence
  Description of Artificial Sequence: Synthetic oligonucleotide
ugauucaauaaaauaauc

SEQ ID NO: 140392 - RNA, 18 nt, Artificial Sequence
  Description of Artificial Sequence: Synthetic oligonucleotide
gguggugauucaauaaaa

SEQ ID NO: 140393 - RNA, 18 nt, Artificial Sequence
  Description of Artificial Sequence: Synthetic oligonucleotide
ugugagguggugauucaa

SEQ ID NO: 140394 - RNA, 18 nt, Artificial Sequence
  Description of Artificial Sequence: Synthetic oligonucleotide
guauuugugaggugguga

SEQ ID NO: 140395 - RNA, 18 nt, Artificial Sequence
  Description of Artificial Sequence: Synthetic oligonucleotide
ucuguguauuugugaggu

SEQ ID NO: 140396 - RNA, 18 nt, Artificial Sequence
  Description of Artificial Sequence: Synthetic oligonucleotide
cugguucuguguauuugu

SEQ ID NO: 140397 - RNA, 18 nt, Artificial Sequence
  Description of Artificial Sequence: Synthetic oligonucleotide
uguaucugguucugugua

SEQ ID NO: 140398 - RNA, 18 nt, Artificial Sequence
  Description of Artificial Sequence: Synthetic oligonucleotide
auaaauguaucugguucu

SEQ ID NO: 140399 - RNA, 18 nt, Artificial Sequence
  Description of Artificial Sequence: Synthetic oligonucleotide
ucuucauaaauguaucug

SEQ ID NO: 140400 - RNA, 18 nt, Artificial Sequence
  Description of Artificial Sequence: Synthetic oligonucleotide
ugauuucuucauaaaugu

SEQ ID NO: 140401 - RNA, 18 nt, Artificial Sequence
  Description of Artificial Sequence: Synthetic oligonucleotide
uaacuugauuucuucaua

SEQ ID NO: 140402 - RNA, 18 nt, Artificial Sequence
  Description of Artificial Sequence: Synthetic oligonucleotide
acggcuaacuugauuucu

SEQ ID NO: 140403 - RNA, 18 nt, Artificial Sequence
  Description of Artificial Sequence: Synthetic oligonucleotide
gucucacggcuaacuuga

SEQ ID NO: 140404 - RNA, 18 nt, Artificial Sequence
  Description of Artificial Sequence: Synthetic oligonucleotide
agauugucucacggcuaa

SEQ ID NO: 140405 - RNA, 18 nt, Artificial Sequence
  Description of Artificial Sequence: Synthetic oligonucleotide
aacaaaaaaaaaacacaa

SEQ ID NO: 140406 - RNA, 18 nt, Artificial Sequence
  Description of Artificial Sequence: Synthetic oligonucleotide
aacaaaacaaaaaaaaaa

SEQ ID NO: 140407 - RNA, 18 nt, Artificial Sequence
  Description of Artificial Sequence: Synthetic oligonucleotide
aacaaaacaaaacaaaaa

SEQ ID NO: 140408 - RNA, 18 nt, Artificial Sequence
  Description of Artificial Sequence: Synthetic oligonucleotide
aauaaaacaaaacaaaac

SEQ ID NO: 140409 - RNA, 18 nt, Artificial Sequence
  Description of Artificial Sequence: Synthetic oligonucleotide
aacaaaauaaaacaaaac

SEQ ID NO: 140410 - RNA, 18 nt, Artificial Sequence
  Description of Artificial Sequence: Synthetic oligonucleotide
aacaaaacaaaauaaaac

SEQ ID NO: 140411 - RNA, 18 nt, Artificial Sequence
  Description of Artificial Sequence: Synthetic oligonucleotide
aacaaaacaaaacaaaau

SEQ ID NO: 140412 - RNA, 18 nt, Artificial Sequence
  Description of Artificial Sequence: Synthetic oligonucleotide
cucaaaacaaaacaaaac

SEQ ID NO: 140413 - RNA, 18 nt, Artificial Sequence
  Description of Artificial Sequence: Synthetic oligonucleotide
uccaucucaaaacaaaac

SEQ ID NO: 140414 - RNA, 18 nt, Artificial Sequence
  Description of Artificial Sequence: Synthetic oligonucleotide
gaaacuccaucucaaaac

SEQ ID NO: 140415 - RNA, 18 nt, Artificial Sequence
  Description of Artificial Sequence: Synthetic oligonucleotide
agagugaaacuccaucuc

SEQ ID NO: 140416 - RNA, 18 nt, Artificial Sequence
  Description of Artificial Sequence: Synthetic oligonucleotide
caacaagagugaaacucc

SEQ ID NO: 140417 - RNA, 18 nt, Artificial Sequence
  Description of Artificial Sequence: Synthetic oligonucleotide
cuggacaacaagagugaa

SEQ ID NO: 140418 - RNA, 18 nt, Artificial Sequence
  Description of Artificial Sequence: Synthetic oligonucleotide
ccagccuggacaacaaga

SEQ ID NO: 140419 - RNA, 18 nt, Artificial Sequence
  Description of Artificial Sequence: Synthetic oligonucleotide
acacuccagccuggacaa

SEQ ID NO: 140420 - RNA, 18 nt, Artificial Sequence
  Description of Artificial Sequence: Synthetic oligonucleotide
ccauuacacuccagccug

SEQ ID NO: 140421 - RNA, 18 nt, Artificial Sequence
  Description of Artificial Sequence: Synthetic oligonucleotide
ucgcgccauuacacucca

SEQ ID NO: 140422 - RNA, 18 nt, Artificial Sequence
  Description of Artificial Sequence: Synthetic oligonucleotide
caagaucgcgccauuaca

SEQ ID NO: 140423 - RNA, 18 nt, Artificial Sequence
  Description of Artificial Sequence: Synthetic oligonucleotide
ucagccaagaucgcgcca

SEQ ID NO: 140424 - RNA, 18 nt, Artificial Sequence
  Description of Artificial Sequence: Synthetic oligonucleotide
ugcagucagccaagaucg

SEQ ID NO: 140425 - RNA, 18 nt, Artificial Sequence
  Description of Artificial Sequence: Synthetic oligonucleotide
gagguugcagucagccaa

SEQ ID NO: 140426 - RNA, 18 nt, Artificial Sequence
  Description of Artificial Sequence: Synthetic oligonucleotide
agguggagguugcaguca

SEQ ID NO: 140427 - RNA, 18 nt, Artificial Sequence
  Description of Artificial Sequence: Synthetic oligonucleotide
ccgggagguggagguugc

SEQ ID NO: 140428 - RNA, 18 nt, Artificial Sequence
  Description of Artificial Sequence: Synthetic oligonucleotide
ugaacccgggagguggag

SEQ ID NO: 140429 - RNA, 18 nt, Artificial Sequence
  Description of Artificial Sequence: Synthetic oligonucleotide
ucgcuugaacccgggagg

SEQ ID NO: 140430 - RNA, 18 nt, Artificial Sequence
  Description of Artificial Sequence: Synthetic oligonucleotide
gggaaucgcuugaacccg

SEQ ID NO: 140431 - RNA, 18 nt, Artificial Sequence
  Description of Artificial Sequence: Synthetic oligonucleotide
caggaggcugaggcaggg

SEQ ID NO: 140432 - RNA, 18 nt, Artificial Sequence
  Description of Artificial Sequence: Synthetic oligonucleotide
ucaggaggcugaggcagg

SEQ ID NO: 140433 - RNA, 18 nt, Artificial Sequence
  Description of Artificial Sequence: Synthetic oligonucleotide
gcuacucaggaggcugag

SEQ ID NO: 140434 - RNA, 18 nt, Artificial Sequence
  Description of Artificial Sequence: Synthetic oligonucleotide
ucccagcuacucaggagg

SEQ ID NO: 140435 - RNA, 18 nt, Artificial Sequence
  Description of Artificial Sequence: Synthetic oligonucleotide
uguaaucccagcuacuca

SEQ ID NO: 140436 - RNA, 18 nt, Artificial Sequence
  Description of Artificial Sequence: Synthetic oligonucleotide
accccuguaaucccagcu

SEQ ID NO: 140437 - RNA, 18 nt, Artificial Sequence
  Description of Artificial Sequence: Synthetic oligonucleotide
ggcacaccccuguaaucc

SEQ ID NO: 140438 - RNA, 18 nt, Artificial Sequence
  Description of Artificial Sequence: Synthetic oligonucleotide
guaguggcacaccccugu

SEQ ID NO: 140439 - RNA, 18 nt, Artificial Sequence
  Description of Artificial Sequence: Synthetic oligonucleotide
uggguguaguggcacacc

SEQ ID NO: 140440 - RNA, 18 nt, Artificial Sequence
  Description of Artificial Sequence: Synthetic oligonucleotide
uuagcuggguguaguggc

SEQ ID NO: 140441 - RNA, 18 nt, Artificial Sequence
  Description of Artificial Sequence: Synthetic oligonucleotide
aaaaauuagcugggugua

SEQ ID NO: 140442 - RNA, 18 nt, Artificial Sequence
  Description of Artificial Sequence: Synthetic oligonucleotide
uacagaaaaauuagcugg

SEQ ID NO: 140443 - RNA, 18 nt, Artificial Sequence
  Description of Artificial Sequence: Synthetic oligonucleotide
aaaaauacagaaaaauua

SEQ ID NO: 140444 - RNA, 18 nt, Artificial Sequence
  Description of Artificial Sequence: Synthetic oligonucleotide
cuacuaaaaauacagaaa

SEQ ID NO: 140445 - RNA, 18 nt, Artificial Sequence
  Description of Artificial Sequence: Synthetic oligonucleotide
cgucucuacuaaaaauac

SEQ ID NO: 140446 - RNA, 18 nt, Artificial Sequence
  Description of Artificial Sequence: Synthetic oligonucleotide
aaccccgucucuacuaaa

SEQ ID NO: 140447 - RNA, 18 nt, Artificial Sequence
  Description of Artificial Sequence: Synthetic oligonucleotide
ggugaaaccccgucucua

SEQ ID NO: 140448 - RNA, 18 nt, Artificial Sequence
  Description of Artificial Sequence: Synthetic oligonucleotide
aacauggugaaaccccgu

SEQ ID NO: 140449 - RNA, 18 nt, Artificial Sequence
  Description of Artificial Sequence: Synthetic oligonucleotide
uggccaacauggugaaac

SEQ ID NO: 140450 - RNA, 18 nt, Artificial Sequence
  Description of Artificial Sequence: Synthetic oligonucleotide
cagccuggccaacauggu

SEQ ID NO: 140451 - RNA, 18 nt, Artificial Sequence
  Description of Artificial Sequence: Synthetic oligonucleotide
gagaccagccuggccaac

SEQ ID NO: 140452 - RNA, 18 nt, Artificial Sequence
  Description of Artificial Sequence: Synthetic oligonucleotide
aguuugagaccagccugg

SEQ ID NO: 140453 - RNA, 18 nt, Artificial Sequence
  Description of Artificial Sequence: Synthetic oligonucleotide
ucaggaguuugagaccag

SEQ ID NO: 140454 - RNA, 18 nt, Artificial Sequence
  Description of Artificial Sequence: Synthetic oligonucleotide
ugaggucaggaguuugag

SEQ ID NO: 140455 - RNA, 18 nt, Artificial Sequence
  Description of Artificial Sequence: Synthetic oligonucleotide
ucaccugaggucaggagu

SEQ ID NO: 140456 - RNA, 18 nt, Artificial Sequence
  Description of Artificial Sequence: Synthetic oligonucleotide
gcggaucaccugagguca

SEQ ID NO: 140457 - RNA, 18 nt, Artificial Sequence
  Description of Artificial Sequence: Synthetic oligonucleotide
ggugggcggaucaccuga

SEQ ID NO: 140458 - RNA, 18 nt, Artificial Sequence
  Description of Artificial Sequence: Synthetic oligonucleotide
gccgaggugggcggauca

SEQ ID NO: 140459 - RNA, 18 nt, Artificial Sequence
  Description of Artificial Sequence: Synthetic oligonucleotide
gagaggccgaggugggcg

SEQ ID NO: 140460 - RNA, 18 nt, Artificial Sequence
  Description of Artificial Sequence: Synthetic oligonucleotide
acuuugagaggccgaggu

SEQ ID NO: 140461 - RNA, 18 nt, Artificial Sequence
  Description of Artificial Sequence: Synthetic oligonucleotide
ccagcacuuugagaggcc

SEQ ID NO: 140462 - RNA, 18 nt, Artificial Sequence
  Description of Artificial Sequence: Synthetic oligonucleotide
uaaucccagcacuuugag

SEQ ID NO: 140463 - RNA, 18 nt, Artificial Sequence
  Description of Artificial Sequence: Synthetic oligonucleotide
gccuguaaucccagcacu

SEQ ID NO: 140464 - RNA, 18 nt, Artificial Sequence
  Description of Artificial Sequence: Synthetic oligonucleotide
cucacgccuguaauccca

SEQ ID NO: 140465 - RNA, 18 nt, Artificial Sequence
  Description of Artificial Sequence: Synthetic oligonucleotide
aguggcucacgccuguaa

SEQ ID NO: 140466 - RNA, 18 nt, Artificial Sequence
  Description of Artificial Sequence: Synthetic oligonucleotide
ggcacaguggcucacgcc

SEQ ID NO: 140467 - RNA, 18 nt, Artificial Sequence
  Description of Artificial Sequence: Synthetic oligonucleotide
guucaggcacaguggcuc

SEQ ID NO: 140468 - RNA, 18 nt, Artificial Sequence
  Description of Artificial Sequence: Synthetic oligonucleotide
uuuuaguucaggcacagu

SEQ ID NO: 140469 - RNA, 18 nt, Artificial Sequence
  Description of Artificial Sequence: Synthetic oligonucleotide
aacuauuuuaguucaggc

SEQ ID NO: 140470 - RNA, 18 nt, Artificial Sequence
  Description of Artificial Sequence: Synthetic oligonucleotide
auuaaaacuauuuuaguu

SEQ ID NO: 140471 - RNA, 18 nt, Artificial Sequence
  Description of Artificial Sequence: Synthetic oligonucleotide
cuuuaauuaaaacuauuu

SEQ ID NO: 140472 - RNA, 18 nt, Artificial Sequence
  Description of Artificial Sequence: Synthetic oligonucleotide
uaaaacuuuaauuaaaac

SEQ ID NO: 140473 - RNA, 18 nt, Artificial Sequence
  Description of Artificial Sequence: Synthetic oligonucleotide
aauucuaaaacuuuaauu

SEQ ID NO: 140474 - RNA, 18 nt, Artificial Sequence
  Description of Artificial Sequence: Synthetic oligonucleotide
aaaguaauucuaaaacuu

SEQ ID NO: 140475 - RNA, 18 nt, Artificial Sequence
  Description of Artificial Sequence: Synthetic oligonucleotide
gaaggaaaguaauucuaa

SEQ ID NO: 140476 - RNA, 18 nt, Artificial Sequence
  Description of Artificial Sequence: Synthetic oligonucleotide
auggagaaggaaaguaau

SEQ ID NO: 140477 - RNA, 18 nt, Artificial Sequence
  Description of Artificial Sequence: Synthetic oligonucleotide
gggagauggagaaggaaa

SEQ ID NO: 140478 - RNA, 18 nt, Artificial Sequence
  Description of Artificial Sequence: Synthetic oligonucleotide
agaaauuuuuuuggaggg

SEQ ID NO: 140479 - RNA, 18 nt, Artificial Sequence
  Description of Artificial Sequence: Synthetic oligonucleotide
gagaagaaauuuuuuugg

SEQ ID NO: 140480 - RNA, 18 nt, Artificial Sequence
  Description of Artificial Sequence: Synthetic oligonucleotide
guaacgagaagaaauuuu

SEQ ID NO: 140481 - RNA, 18 nt, Artificial Sequence
  Description of Artificial Sequence: Synthetic oligonucleotide
uggaaguaacgagaagaa

SEQ ID NO: 140482 - RNA, 18 nt, Artificial Sequence
  Description of Artificial Sequence: Synthetic oligonucleotide
acauuuggaaguaacgag

SEQ ID NO: 140483 - RNA, 18 nt, Artificial Sequence
  Description of Artificial Sequence: Synthetic oligonucleotide
uccugacauuuggaagua

SEQ ID NO: 140484 - RNA, 18 nt, Artificial Sequence
  Description of Artificial Sequence: Synthetic oligonucleotide
aacacuccugacauuugg

SEQ ID NO: 140485 - RNA, 18 nt, Artificial Sequence
  Description of Artificial Sequence: Synthetic oligonucleotide
guguaaacacuccugaca

SEQ ID NO: 140486 - RNA, 18 nt, Artificial Sequence
  Description of Artificial Sequence: Synthetic oligonucleotide
auaagguguaaacacucc

SEQ ID NO: 140487 - RNA, 18 nt, Artificial Sequence
  Description of Artificial Sequence: Synthetic oligonucleotide
uauguauaagguguaaac

SEQ ID NO: 140488 - RNA, 18 nt, Artificial Sequence
  Description of Artificial Sequence: Synthetic oligonucleotide
ccgauuauguauaaggug

SEQ ID NO: 140489 - RNA, 18 nt, Artificial Sequence
  Description of Artificial Sequence: Synthetic oligonucleotide
agggcccgauuauguaua

SEQ ID NO: 140490 - RNA, 18 nt, Artificial Sequence
  Description of Artificial Sequence: Synthetic oligonucleotide
gccaaagggcccgauuau

SEQ ID NO: 140491 - RNA, 18 nt, Artificial Sequence
  Description of Artificial Sequence: Synthetic oligonucleotide
gcugugccaaagggcccg

SEQ ID NO: 140492 - RNA, 18 nt, Artificial Sequence
  Description of Artificial Sequence: Synthetic oligonucleotide
gggaggcugugccaaagg

SEQ ID NO: 140493 - RNA, 18 nt, Artificial Sequence
  Description of Artificial Sequence: Synthetic oligonucleotide
ugggagggaggcugugcc

SEQ ID NO: 140494 - RNA, 18 nt, Artificial Sequence
  Description of Artificial Sequence: Synthetic oligonucleotide
ggaggugggagggaggcu

SEQ ID NO: 140495 - RNA, 18 nt, Artificial Sequence
  Description of Artificial Sequence: Synthetic oligonucleotide
caccaggaggugggaggg

SEQ ID NO: 140496 - RNA, 18 nt, Artificial Sequence
  Description of Artificial Sequence: Synthetic oligonucleotide
aaggccaccaggaggugg

SEQ ID NO: 140497 - RNA, 18 nt, Artificial Sequence
  Description of Artificial Sequence: Synthetic oligonucleotide
gaggaaaggccaccagga

SEQ ID NO: 140498 - RNA, 18 nt, Artificial Sequence
  Description of Artificial Sequence: Synthetic oligonucleotide
caggugaggaaaggccac

SEQ ID NO: 140499 - RNA, 18 nt, Artificial Sequence
  Description of Artificial Sequence: Synthetic oligonucleotide
ucguacgacggaagaagc

SEQ ID NO: 140500 - RNA, 18 nt, Artificial Sequence
  Description of Artificial Sequence: Synthetic oligonucleotide
gcggaucguacgacggaa

SEQ ID NO: 140501 - RNA, 18 nt, Artificial Sequence
  Description of Artificial Sequence: Synthetic oligonucleotide
uucaugcggaucguacga

SEQ ID NO: 140502 - RNA, 18 nt, Artificial Sequence
  Description of Artificial Sequence: Synthetic oligonucleotide
ccagcuucaugcggaucg

SEQ ID NO: 140503 - RNA, 18 nt, Artificial Sequence
  Description of Artificial Sequence: Synthetic oligonucleotide
guacuccagcuucaugcg

SEQ ID NO: 140504 - RNA, 18 nt, Artificial Sequence
  Description of Artificial Sequence: Synthetic oligonucleotide
uucucguacuccagcuuc

SEQ ID NO: 140505 - RNA, 18 nt, Artificial Sequence
  Description of Artificial Sequence: Synthetic oligonucleotide
cacacuucucguacucca

SEQ ID NO: 140506 - RNA, 18 nt, Artificial Sequence
  Description of Artificial Sequence: Synthetic oligonucleotide
gcgcucacacuucucgua

SEQ ID NO: 140507 - RNA, 18 nt, Artificial Sequence
  Description of Artificial Sequence: Synthetic oligonucleotide
cagcugcgcucacacuuc

SEQ ID NO: 140508 - RNA, 18 nt, Artificial Sequence
  Description of Artificial Sequence: Synthetic oligonucleotide
ucuugcagcugcgcucac

SEQ ID NO: 140509 - RNA, 18 nt, Artificial Sequence
  Description of Artificial Sequence: Synthetic oligonucleotide
cugaaucuugcagcugcg

SEQ ID NO: 140510 - RNA, 18 nt, Artificial Sequence
  Description of Artificial Sequence: Synthetic oligonucleotide
uucuucugaaucuugcag

SEQ ID NO: 140511 - RNA, 18 nt, Artificial Sequence
  Description of Artificial Sequence: Synthetic oligonucleotide
gguucuucuucugaaucu

SEQ ID NO: 140512 - RNA, 18 nt, Artificial Sequence
  Description of Artificial Sequence: Synthetic oligonucleotide
guugcgguucuucuucug

SEQ ID NO: 140513 - RNA, 18 nt, Artificial Sequence
  Description of Artificial Sequence: Synthetic oligonucleotide
cacuuguugcgguucuuc

SEQ ID NO: 140514 - RNA, 18 nt, Artificial Sequence
  Description of Artificial Sequence: Synthetic oligonucleotide
acuggcacuuguugcggu

SEQ ID NO: 140515 - RNA, 18 nt, Artificial Sequence
  Description of Artificial Sequence: Synthetic oligonucleotide
gcaguacuggcacuuguu

SEQ ID NO: 140516 - RNA, 18 nt, Artificial Sequence
  Description of Artificial Sequence: Synthetic oligonucleotide
aagcggcaguacuggcac

SEQ ID NO: 140517 - RNA, 18 nt, Artificial Sequence
  Description of Artificial Sequence: Synthetic oligonucleotide
ucuggaagcggcaguacu

SEQ ID NO: 140518 - RNA, 18 nt, Artificial Sequence
  Description of Artificial Sequence: Synthetic oligonucleotide
gcacuucuggaagcggca

SEQ ID NO: 140519 - RNA, 18 nt, Artificial Sequence
  Description of Artificial Sequence: Synthetic oligonucleotide
gccaggcacuucuggaag

SEQ ID NO: 140520 - RNA, 18 nt, Artificial Sequence
  Description of Artificial Sequence: Synthetic oligonucleotide
ccagugccaggcacuucu

SEQ ID NO: 140521 - RNA, 18 nt, Artificial Sequence
  Description of Artificial Sequence: Synthetic oligonucleotide
caugcccagugccaggca

SEQ ID NO: 140522 - RNA, 18 nt, Artificial Sequence
  Description of Artificial Sequence: Synthetic oligonucleotide
ugugacaugcccagugcc

SEQ ID NO: 140523 - RNA, 18 nt, Artificial Sequence
  Description of Artificial Sequence: Synthetic oligonucleotide
cguugugugacaugccca

SEQ ID NO: 140524 - RNA, 18 nt, Artificial Sequence
  Description of Artificial Sequence: Synthetic oligonucleotide
gaucguacgacggaagaa

SEQ ID NO: 140525 - RNA, 18 nt, Artificial Sequence
  Description of Artificial Sequence: Synthetic oligonucleotide
augcggaucguacgacgg

SEQ ID NO: 140526 - RNA, 18 nt, Artificial Sequence
  Description of Artificial Sequence: Synthetic oligonucleotide
gcuucaugcggaucguac

SEQ ID NO: 140527 - RNA, 18 nt, Artificial Sequence
  Description of Artificial Sequence: Synthetic oligonucleotide
cuccagcuucaugcggau

SEQ ID NO: 140528 - RNA, 18 nt, Artificial Sequence
  Description of Artificial Sequence: Synthetic oligonucleotide
ucguacuccagcuucaug

SEQ ID NO: 140529 - RNA, 18 nt, Artificial Sequence
  Description of Artificial Sequence: Synthetic oligonucleotide
acuucucguacuccagcu

SEQ ID NO: 140530 - RNA, 18 nt, Artificial Sequence
  Description of Artificial Sequence: Synthetic oligonucleotide
cucacacuucucguacuc

SEQ ID NO: 140531 - RNA, 18 nt, Artificial Sequence
  Description of Artificial Sequence: Synthetic oligonucleotide
cugcgcucacacuucucg

SEQ ID NO: 140532 - RNA, 18 nt, Artificial Sequence
  Description of Artificial Sequence: Synthetic oligonucleotide
ugcagcugcgcucacacu

SEQ ID NO: 140533 - RNA, 18 nt, Artificial Sequence
  Description of Artificial Sequence: Synthetic oligonucleotide
aaucuugcagcugcgcuc

SEQ ID NO: 140534 - RNA, 18 nt, Artificial Sequence
  Description of Artificial Sequence: Synthetic oligonucleotide
uucugaaucuugcagcug

SEQ ID NO: 140535 - RNA, 18 nt, Artificial Sequence
  Description of Artificial Sequence: Synthetic oligonucleotide
ucuucuucugaaucuugc

SEQ ID NO: 140536 - RNA, 18 nt, Artificial Sequence
  Description of Artificial Sequence: Synthetic oligonucleotide
gcgguucuucuucugaau

SEQ ID NO: 140537 - RNA, 18 nt, Artificial Sequence
  Description of Artificial Sequence: Synthetic oligonucleotide
uuguugcgguucuucuuc

SEQ ID NO: 140538 - RNA, 18 nt, Artificial Sequence
  Description of Artificial Sequence: Synthetic oligonucleotide
ggcacuuguugcgguucu

SEQ ID NO: 140539 - RNA, 18 nt, Artificial Sequence
  Description of Artificial Sequence: Synthetic oligonucleotide
guacuggcacuuguugcg

SEQ ID NO: 140540 - RNA, 18 nt, Artificial Sequence
  Description of Artificial Sequence: Synthetic oligonucleotide
cggcaguacuggcacuug

SEQ ID NO: 140541 - RNA, 18 nt, Artificial Sequence
  Description of Artificial Sequence: Synthetic oligonucleotide
ggaagcggcaguacuggc

SEQ ID NO: 140542 - RNA, 18 nt, Artificial Sequence
  Description of Artificial Sequence: Synthetic oligonucleotide
cuucuggaagcggcagua

SEQ ID NO: 140543 - RNA, 18 nt, Artificial Sequence
  Description of Artificial Sequence: Synthetic oligonucleotide
aggcacuucuggaagcgg

SEQ ID NO: 140544 - RNA, 18 nt, Artificial Sequence
  Description of Artificial Sequence: Synthetic oligonucleotide
gugccaggcacuucugga

SEQ ID NO: 140545 - RNA, 18 nt, Artificial Sequence
  Description of Artificial Sequence: Synthetic oligonucleotide
gcccagugccaggcacuu

SEQ ID NO: 140546 - RNA, 18 nt, Artificial Sequence
  Description of Artificial Sequence: Synthetic oligonucleotide
gacaugcccagugccagg

SEQ ID NO: 140547 - RNA, 18 nt, Artificial Sequence
  Description of Artificial Sequence: Synthetic oligonucleotide
ugugugacaugcccagug

SEQ ID NO: 140548 - RNA, 18 nt, Artificial Sequence
  Description of Artificial Sequence: Synthetic oligonucleotide
gaguugcccuggucagcu

SEQ ID NO: 140549 - RNA, 18 nt, Artificial Sequence
  Description of Artificial Sequence: Synthetic oligonucleotide
cccgugaguugcccuggu

SEQ ID NO: 140550 - RNA, 18 nt, Artificial Sequence
  Description of Artificial Sequence: Synthetic oligonucleotide
agcagcccgugaguugcc

SEQ ID NO: 140551 - RNA, 18 nt, Artificial Sequence
  Description of Artificial Sequence: Synthetic oligonucleotide
gagccagcagcccgugag

SEQ ID NO: 140552 - RNA, 18 nt, Artificial Sequence
  Description of Artificial Sequence: Synthetic oligonucleotide
guguggagccagcagccc

SEQ ID NO: 140553 - RNA, 18 nt, Artificial Sequence
  Description of Artificial Sequence: Synthetic oligonucleotide
aggcuguguggagccagc

SEQ ID NO: 140554 - RNA, 18 nt, Artificial Sequence
  Description of Artificial Sequence: Synthetic oligonucleotide
guuucaggcuguguggag

SEQ ID NO: 140555 - RNA, 18 nt, Artificial Sequence
  Description of Artificial Sequence: Synthetic oligonucleotide
ccuugguuucaggcugug

SEQ ID NO: 140556 - RNA, 18 nt, Artificial Sequence
  Description of Artificial Sequence: Synthetic oligonucleotide
cuggaccuugguuucagg

SEQ ID NO: 140557 - RNA, 18 nt, Artificial Sequence
  Description of Artificial Sequence: Synthetic oligonucleotide
gcucccuggaccuugguu

SEQ ID NO: 140558 - RNA, 18 nt, Artificial Sequence
  Description of Artificial Sequence: Synthetic oligonucleotide
caagggcucccuggaccu

SEQ ID NO: 140559 - RNA, 18 nt, Artificial Sequence
  Description of Artificial Sequence: Synthetic oligonucleotide
ugccccaagggcucccug

SEQ ID NO: 140560 - RNA, 18 nt, Artificial Sequence
  Description of Artificial Sequence: Synthetic oligonucleotide
uaggcugccccaagggcu

SEQ ID NO: 140561 - RNA, 18 nt, Artificial Sequence
  Description of Artificial Sequence: Synthetic oligonucleotide
cccucuaggcugccccaa

SEQ ID NO: 140562 - RNA, 18 nt, Artificial Sequence
  Description of Artificial Sequence: Synthetic oligonucleotide
gugcccccucuaggcugc

SEQ ID NO: 140563 - RNA, 18 nt, Artificial Sequence
  Description of Artificial Sequence: Synthetic oligonucleotide
uacaggugcccccucuag

SEQ ID NO: 140564 - RNA, 18 nt, Artificial Sequence
  Description of Artificial Sequence: Synthetic oligonucleotide
ugcucuacaggugccccc

SEQ ID NO: 140565 - RNA, 18 nt, Artificial Sequence
  Description of Artificial Sequence: Synthetic oligonucleotide
ggcacugcucuacaggug

SEQ ID NO: 140566 - RNA, 18 nt, Artificial Sequence
  Description of Artificial Sequence: Synthetic oligonucleotide
cgccaggcacugcucuac

SEQ ID NO: 140567 - RNA, 18 nt, Artificial Sequence
  Description of Artificial Sequence: Synthetic oligonucleotide
cugugcgccaggcacugc

SEQ ID NO: 140568 - RNA, 18 nt, Artificial Sequence
  Description of Artificial Sequence: Synthetic oligonucleotide
gcuuacugugcgccaggc

SEQ ID NO: 140569 - RNA, 18 nt, Artificial Sequence
  Description of Artificial Sequence: Synthetic oligonucleotide
auggugcuuacugugcgc

SEQ ID NO: 140570 - RNA, 18 nt, Artificial Sequence
  Description of Artificial Sequence: Synthetic oligonucleotide
cagccauggugcuuacug

SEQ ID NO: 140571 - RNA, 18 nt, Artificial Sequence
  Description of Artificial Sequence: Synthetic oligonucleotide
gccaacagccauggugcu

SEQ ID NO: 140572 - RNA, 18 nt, Artificial Sequence
  Description of Artificial Sequence: Synthetic oligonucleotide
caacagccaacagccaug

SEQ ID NO: 140573 - RNA, 18 nt, Artificial Sequence
  Description of Artificial Sequence: Synthetic oligonucleotide
aaagccaacagccaacag

SEQ ID NO: 140574 - RNA, 18 nt, Artificial Sequence
  Description of Artificial Sequence: Synthetic oligonucleotide
ucagcaaagccaacagcc

SEQ ID NO: 140575 - RNA, 18 nt, Artificial Sequence
  Description of Artificial Sequence: Synthetic oligonucleotide
ccagaucagcaaagccaa

SEQ ID NO: 140576 - RNA, 18 nt, Artificial Sequence
  Description of Artificial Sequence: Synthetic oligonucleotide
aagguccagaucagcaaa

SEQ ID NO: 140577 - RNA, 18 nt, Artificial Sequence
  Description of Artificial Sequence: Synthetic oligonucleotide
gauccaagguccagauca

SEQ ID NO: 140578 - RNA, 18 nt, Artificial Sequence
  Description of Artificial Sequence: Synthetic oligonucleotide
ucuaagauccaaggucca

SEQ ID NO: 140579 - RNA, 18 nt, Artificial Sequence
  Description of Artificial Sequence: Synthetic oligonucleotide
uaggcucuaagauccaag

SEQ ID NO: 140580 - RNA, 18 nt, Artificial Sequence
  Description of Artificial Sequence: Synthetic oligonucleotide
ggucuuaggcucuaagau

SEQ ID NO: 140581 - RNA, 18 nt, Artificial Sequence
  Description of Artificial Sequence: Synthetic oligonucleotide
uggcaggucuuaggcucu

SEQ ID NO: 140582 - RNA, 18 nt, Artificial Sequence
  Description of Artificial Sequence: Synthetic oligonucleotide
ggaaguggcaggucuuag

SEQ ID NO: 140583 - RNA, 18 nt, Artificial Sequence
  Description of Artificial Sequence: Synthetic oligonucleotide
ucugaggaaguggcaggu

SEQ ID NO: 140584 - RNA, 18 nt, Artificial Sequence
  Description of Artificial Sequence: Synthetic oligonucleotide
ggcagucugaggaagugg

SEQ ID NO: 140585 - RNA, 18 nt, Artificial Sequence
  Description of Artificial Sequence: Synthetic oligonucleotide
augcuggcagucugagga

SEQ ID NO: 140586 - RNA, 18 nt, Artificial Sequence
  Description of Artificial Sequence: Synthetic oligonucleotide
gguagaugcuggcagucu

SEQ ID NO: 140587 - RNA, 18 nt, Artificial Sequence
  Description of Artificial Sequence: Synthetic oligonucleotide
cccaugguagaugcuggc

SEQ ID NO: 140588 - RNA, 18 nt, Artificial Sequence
  Description of Artificial Sequence: Synthetic oligonucleotide
ugggacccaugguagaug

SEQ ID NO: 140589 - RNA, 18 nt, Artificial Sequence
  Description of Artificial Sequence: Synthetic oligonucleotide
acgccugggacccauggu

SEQ ID NO: 140590 - RNA, 18 nt, Artificial Sequence
  Description of Artificial Sequence: Synthetic oligonucleotide
accccacgccugggaccc

SEQ ID NO: 140591 - RNA, 18 nt, Artificial Sequence
  Description of Artificial Sequence: Synthetic oligonucleotide
acacuaccccacgccugg

SEQ ID NO: 140592 - RNA, 18 nt, Artificial Sequence
  Description of Artificial Sequence: Synthetic oligonucleotide
gguaaacacuaccccacg

SEQ ID NO: 140593 - RNA, 18 nt, Artificial Sequence
  Description of Artificial Sequence: Synthetic oligonucleotide
agggagguaaacacuacc

SEQ ID NO: 140594 - RNA, 18 nt, Artificial Sequence
  Description of Artificial Sequence: Synthetic oligonucleotide
gguauagggagguaaaca

SEQ ID NO: 140595 - RNA, 18 nt, Artificial Sequence
  Description of Artificial Sequence: Synthetic oligonucleotide
ccucagguauagggaggu

SEQ ID NO: 140596 - RNA, 18 nt, Artificial Sequence
  Description of Artificial Sequence: Synthetic oligonucleotide
guaaaccucagguauagg

SEQ ID NO: 140597 - RNA, 18 nt, Artificial Sequence
  Description of Artificial Sequence: Synthetic oligonucleotide
aaugcguaaaccucaggu

SEQ ID NO: 140598 - RNA, 18 nt, Artificial Sequence
  Description of Artificial Sequence: Synthetic oligonucleotide
gccagaaugcguaaaccu

SEQ ID NO: 140599 - RNA, 18 nt, Artificial Sequence
  Description of Artificial Sequence: Synthetic oligonucleotide
ucugggccagaaugcgua

SEQ ID NO: 140600 - RNA, 18 nt, Artificial Sequence
  Description of Artificial Sequence: Synthetic oligonucleotide
ucccuucugggccagaau

SEQ ID NO: 140601 - RNA, 18 nt, Artificial Sequence
  Description of Artificial Sequence: Synthetic oligonucleotide
ucaguucccuucugggcc

SEQ ID NO: 140602 - RNA, 18 nt, Artificial Sequence
  Description of Artificial Sequence: Synthetic oligonucleotide
aauuaucaguucccuucu

SEQ ID NO: 140603 - RNA, 18 nt, Artificial Sequence
  Description of Artificial Sequence: Synthetic oligonucleotide
guaucaauuaucaguucc

SEQ ID NO: 140604 - RNA, 18 nt, Artificial Sequence
  Description of Artificial Sequence: Synthetic oligonucleotide
agcugguaucaauuauca

SEQ ID NO: 140605 - RNA, 18 nt, Artificial Sequence
  Description of Artificial Sequence: Synthetic oligonucleotide
guucaagcugguaucaau

SEQ ID NO: 140606 - RNA, 18 nt, Artificial Sequence
  Description of Artificial Sequence: Synthetic oligonucleotide
aaauuguucaagcuggua

SEQ ID NO: 140607 - RNA, 18 nt, Artificial Sequence
  Description of Artificial Sequence: Synthetic oligonucleotide
uccccaaauuguucaagc

SEQ ID NO: 140608 - RNA, 18 nt, Artificial Sequence
  Description of Artificial Sequence: Synthetic oligonucleotide
gguguuccccaaauuguu

SEQ ID NO: 140609 - RNA, 18 nt, Artificial Sequence
  Description of Artificial Sequence: Synthetic oligonucleotide
ggacugguguuccccaaa

SEQ ID NO: 140610 - RNA, 18 nt, Artificial Sequence
  Description of Artificial Sequence: Synthetic oligonucleotide
uucugggacugguguucc

SEQ ID NO: 140611 - RNA, 18 nt, Artificial Sequence
  Description of Artificial Sequence: Synthetic oligonucleotide
ugaguuucugggacuggu

SEQ ID NO: 140612 - RNA, 18 nt, Artificial Sequence
  Description of Artificial Sequence: Synthetic oligonucleotide
aggcuugaguuucuggga

SEQ ID NO: 140613 - RNA, 18 nt, Artificial Sequence
  Description of Artificial Sequence: Synthetic oligonucleotide
gagacaggcuugaguuuc

SEQ ID NO: 140614 - RNA, 18 nt, Artificial Sequence
  Description of Artificial Sequence: Synthetic oligonucleotide
caucugagacaggcuuga

SEQ ID NO: 140615 - RNA, 18 nt, Artificial Sequence
  Description of Artificial Sequence: Synthetic oligonucleotide
caggucaucugagacagg

SEQ ID NO: 140616 - RNA, 18 nt, Artificial Sequence
  Description of Artificial Sequence: Synthetic oligonucleotide
ugugucaggucaucugag

SEQ ID NO: 140617 - RNA, 18 nt, Artificial Sequence
  Description of Artificial Sequence: Synthetic oligonucleotide
caugcugugucaggucau

SEQ ID NO: 140618 - RNA, 18 nt, Artificial Sequence
  Description of Artificial Sequence: Synthetic oligonucleotide
gcuuucaugcugugucag

SEQ ID NO: 140619 - RNA, 18 nt, Artificial Sequence
  Description of Artificial Sequence: Synthetic oligonucleotide
caguagcuuucaugcugu

SEQ ID NO: 140620 - RNA, 18 nt, Artificial Sequence
  Description of Artificial Sequence: Synthetic oligonucleotide
cuuggcaguagcuuucau

SEQ ID NO: 140621 - RNA, 18 nt, Artificial Sequence
  Description of Artificial Sequence: Synthetic oligonucleotide
cuggccuuggcaguagcu

SEQ ID NO: 140622 - RNA, 18 nt, Artificial Sequence
  Description of Artificial Sequence: Synthetic oligonucleotide
gccaccuggccuuggcag

SEQ ID NO: 140623 - RNA, 18 nt, Artificial Sequence
  Description of Artificial Sequence: Synthetic oligonucleotide
gaagggccaccuggccuu

SEQ ID NO: 140624 - RNA, 18 nt, Artificial Sequence
  Description of Artificial Sequence: Synthetic oligonucleotide
accaagaagggccaccug

SEQ ID NO: 140625 - RNA, 18 nt, Artificial Sequence
  Description of Artificial Sequence: Synthetic oligonucleotide
cuauaaccaagaagggcc

SEQ ID NO: 140626 - RNA, 18 nt, Artificial Sequence
  Description of Artificial Sequence: Synthetic oligonucleotide
gccuucuauaaccaagaa

SEQ ID NO: 140627 - RNA, 18 nt, Artificial Sequence
  Description of Artificial Sequence: Synthetic oligonucleotide
ugccugccuucuauaacc

SEQ ID NO: 140628 - RNA, 18 nt, Artificial Sequence
  Description of Artificial Sequence: Synthetic oligonucleotide
guuacugccugccuucua

SEQ ID NO: 140629 - RNA, 18 nt, Artificial Sequence
  Description of Artificial Sequence: Synthetic oligonucleotide
uacugguuacugccugcc

SEQ ID NO: 140630 - RNA, 18 nt, Artificial Sequence
  Description of Artificial Sequence: Synthetic oligonucleotide
uuacuuacugguuacugc

SEQ ID NO: 140631 - RNA, 18 nt, Artificial Sequence
  Description of Artificial Sequence: Synthetic oligonucleotide
ugugguuacuuacugguu

SEQ ID NO: 140632 - RNA, 18 nt, Artificial Sequence
  Description of Artificial Sequence: Synthetic oligonucleotide
acaaaugugguuacuuac

SEQ ID NO: 140633 - RNA, 18 nt, Artificial Sequence
  Description of Artificial Sequence: Synthetic oligonucleotide
aguugacaaaugugguua

SEQ ID NO: 140634 - RNA, 18 nt, Artificial Sequence
  Description of Artificial Sequence: Synthetic oligonucleotide
cuggcaguugacaaaugu

SEQ ID NO: 140635 - RNA, 18 nt, Artificial Sequence
  Description of Artificial Sequence: Synthetic oligonucleotide
ggcuccuggcaguugaca

SEQ ID NO: 140636 - RNA, 18 nt, Artificial Sequence
  Description of Artificial Sequence: Synthetic oligonucleotide
ugccuggcuccuggcagu

SEQ ID NO: 140637 - RNA, 18 nt, Artificial Sequence
  Description of Artificial Sequence: Synthetic oligonucleotide
acuucugccuggcuccug

SEQ ID NO: 140638 - RNA, 18 nt, Artificial Sequence
  Description of Artificial Sequence: Synthetic oligonucleotide
aagaaacuucugccuggc

SEQ ID NO: 140639 - RNA, 18 nt, Artificial Sequence
  Description of Artificial Sequence: Synthetic oligonucleotide
ccuccaagaaacuucugc

SEQ ID NO: 140640 - RNA, 18 nt, Artificial Sequence
  Description of Artificial Sequence: Synthetic oligonucleotide
ggugaccuccaagaaacu

SEQ ID NO: 140641 - RNA, 18 nt, Artificial Sequence
  Description of Artificial Sequence: Synthetic oligonucleotide
gagugggugaccuccaag

SEQ ID NO: 140642 - RNA, 18 nt, Artificial Sequence
  Description of Artificial Sequence: Synthetic oligonucleotide
ccugggagugggugaccu

SEQ ID NO: 140643 - RNA, 18 nt, Artificial Sequence
  Description of Artificial Sequence: Synthetic oligonucleotide
ugucuccugggagugggu

SEQ ID NO: 140644 - RNA, 18 nt, Artificial Sequence
  Description of Artificial Sequence: Synthetic oligonucleotide
ggcucugucuccugggag

SEQ ID NO: 140645 - RNA, 18 nt, Artificial Sequence
  Description of Artificial Sequence: Synthetic oligonucleotide
gagaaggcucugucuccu

SEQ ID NO: 140646 - RNA, 18 nt, Artificial Sequence
  Description of Artificial Sequence: Synthetic oligonucleotide
gggcagagaaggcucugu

SEQ ID NO: 140647 - RNA, 18 nt, Artificial Sequence
  Description of Artificial Sequence: Synthetic oligonucleotide
aauucucugucucagccu

SEQ ID NO: 140648 - RNA, 18 nt, Artificial Sequence
  Description of Artificial Sequence: Synthetic oligonucleotide
caagcaauucucugucuc

SEQ ID NO: 140649 - RNA, 18 nt, Artificial Sequence
  Description of Artificial Sequence: Synthetic oligonucleotide
ggguucaagcaauucucu

SEQ ID NO: 140650 - RNA, 18 nt, Artificial Sequence
  Description of Artificial Sequence: Synthetic oligonucleotide
cucccggguucaagcaau

SEQ ID NO: 140651 - RNA, 18 nt, Artificial Sequence
  Description of Artificial Sequence: Synthetic oligonucleotide
ucugccucccggguucaa

SEQ ID NO: 140652 - RNA, 18 nt, Artificial Sequence
  Description of Artificial Sequence: Synthetic oligonucleotide
caaccucugccucccggg

SEQ ID NO: 140653 - RNA, 18 nt, Artificial Sequence
  Description of Artificial Sequence: Synthetic oligonucleotide
cacugcaaccucugccuc

SEQ ID NO: 140654 - RNA, 18 nt, Artificial Sequence
  Description of Artificial Sequence: Synthetic oligonucleotide
cggcucacugcaaccucu

SEQ ID NO: 140655 - RNA, 18 nt, Artificial Sequence
  Description of Artificial Sequence: Synthetic oligonucleotide
gaucucggcucacugcaa

SEQ ID NO: 140656 - RNA, 18 nt, Artificial Sequence
  Description of Artificial Sequence: Synthetic oligonucleotide
ggcacgaucucggcucac

SEQ ID NO: 140657 - RNA, 18 nt, Artificial Sequence
  Description of Artificial Sequence: Synthetic oligonucleotide
gcaguggcacgaucucgg

SEQ ID NO: 140658 - RNA, 18 nt, Artificial Sequence
  Description of Artificial Sequence: Synthetic oligonucleotide
ggagugcaguggcacgau

SEQ ID NO: 140659 - RNA, 18 nt, Artificial Sequence
  Description of Artificial Sequence: Synthetic oligonucleotide
aggcuggagugcaguggc

SEQ ID NO: 140660 - RNA, 18 nt, Artificial Sequence
  Description of Artificial Sequence: Synthetic oligonucleotide
cucccaggcuggagugca

SEQ ID NO: 140661 - RNA, 18 nt, Artificial Sequence
  Description of Artificial Sequence: Synthetic oligonucleotide
ucugucucccaggcugga

SEQ ID NO: 140662 - RNA, 18 nt, Artificial Sequence
  Description of Artificial Sequence: Synthetic oligonucleotide
cucgcucugucucccagg

SEQ ID NO: 140663 - RNA, 18 nt, Artificial Sequence
  Description of Artificial Sequence: Synthetic oligonucleotide
agagucucgcucugucuc

SEQ ID NO: 140664 - RNA, 18 nt, Artificial Sequence
  Description of Artificial Sequence: Synthetic oligonucleotide
gagacagagucucgcucu

SEQ ID NO: 140665 - RNA, 18 nt, Artificial Sequence
  Description of Artificial Sequence: Synthetic oligonucleotide
uuuuugagacagagucuc

SEQ ID NO: 140666 - RNA, 18 nt, Artificial Sequence
  Description of Artificial Sequence: Synthetic oligonucleotide
uuuuuuuuuugagacaga

SEQ ID NO: 140667 - RNA, 18 nt, Artificial Sequence
  Description of Artificial Sequence: Synthetic oligonucleotide
ucuuuuuuuuuuuuugag

SEQ ID NO: 140668 - RNA, 18 nt, Artificial Sequence
  Description of Artificial Sequence: Synthetic oligonucleotide
ucuuuucuuuuuuuuuuu

SEQ ID NO: 140669 - RNA, 18 nt, Artificial Sequence
  Description of Artificial Sequence: Synthetic oligonucleotide
cuuuuucuuuucuuuuuu

SEQ ID NO: 140670 - RNA, 18 nt, Artificial Sequence
  Description of Artificial Sequence: Synthetic oligonucleotide
cuuuucuuuuucuuuucu

SEQ ID NO: 140671 - RNA, 18 nt, Artificial Sequence
  Description of Artificial Sequence: Synthetic oligonucleotide
cuucacuuuucuuuuucu

SEQ ID NO: 140672 - RNA, 18 nt, Artificial Sequence
  Description of Artificial Sequence: Synthetic oligonucleotide
gacuccuucacuuuucuu

SEQ ID NO: 140673 - RNA, 18 nt, Artificial Sequence
  Description of Artificial Sequence: Synthetic oligonucleotide
gggcagacuccuucacuu

SEQ ID NO: 140674 - RNA, 18 nt, Artificial Sequence
  Description of Artificial Sequence: Synthetic oligonucleotide
cuagcuuugugacuuggg

SEQ ID NO: 140675 - RNA, 18 nt, Artificial Sequence
  Description of Artificial Sequence: Synthetic oligonucleotide
uacuagcuuugugacuug

SEQ ID NO: 140676 - RNA, 18 nt, Artificial Sequence
  Description of Artificial Sequence: Synthetic oligonucleotide
caguuuacuagcuuugug

SEQ ID NO: 140677 - RNA, 18 nt, Artificial Sequence
  Description of Artificial Sequence: Synthetic oligonucleotide
cucagcaguuuacuagcu

SEQ ID NO: 140678 - RNA, 18 nt, Artificial Sequence
  Description of Artificial Sequence: Synthetic oligonucleotide
uccagcucagcaguuuac

SEQ ID NO: 140679 - RNA, 18 nt, Artificial Sequence
  Description of Artificial Sequence: Synthetic oligonucleotide
ugaguuccagcucagcag

SEQ ID NO: 140680 - RNA, 18 nt, Artificial Sequence
  Description of Artificial Sequence: Synthetic oligonucleotide
gggcuugaguuccagcuc

SEQ ID NO: 140681 - RNA, 18 nt, Artificial Sequence
  Description of Artificial Sequence: Synthetic oligonucleotide
ggccugggcuugaguucc

SEQ ID NO: 140682 - RNA, 18 nt, Artificial Sequence
  Description of Artificial Sequence: Synthetic oligonucleotide
acaaaggccugggcuuga

SEQ ID NO: 140683 - RNA, 18 nt, Artificial Sequence
  Description of Artificial Sequence: Synthetic oligonucleotide
uggugacaaaggccuggg

SEQ ID NO: 140684 - RNA, 18 nt, Artificial Sequence
  Description of Artificial Sequence: Synthetic oligonucleotide
gacuuuggugacaaaggc

SEQ ID NO: 140685 - RNA, 18 nt, Artificial Sequence
  Description of Artificial Sequence: Synthetic oligonucleotide
agacagacuuuggugaca

SEQ ID NO: 140686 - RNA, 18 nt, Artificial Sequence
  Description of Artificial Sequence: Synthetic oligonucleotide
ggguaagacagacuuugg

SEQ ID NO: 140687 - RNA, 18 nt, Artificial Sequence
  Description of Artificial Sequence: Synthetic oligonucleotide
ugagcuacgcuagcuggg

SEQ ID NO: 140688 - RNA, 18 nt, Artificial Sequence
  Description of Artificial Sequence: Synthetic oligonucleotide
ugacugagcuacgcuagc

SEQ ID NO: 140689 - RNA, 18 nt, Artificial Sequence
  Description of Artificial Sequence: Synthetic oligonucleotide
cugagugacugagcuacg

SEQ ID NO: 140690 - RNA, 18 nt, Artificial Sequence
  Description of Artificial Sequence: Synthetic oligonucleotide
acuuacugagugacugag

SEQ ID NO: 140691 - RNA, 18 nt, Artificial Sequence
  Description of Artificial Sequence: Synthetic oligonucleotide
cucuaacuuacugaguga

SEQ ID NO: 140692 - RNA, 18 nt, Artificial Sequence
  Description of Artificial Sequence: Synthetic oligonucleotide
aaggacucuaacuuacug

SEQ ID NO: 140693 - RNA, 18 nt, Artificial Sequence
  Description of Artificial Sequence: Synthetic oligonucleotide
cacacaaggacucuaacu

SEQ ID NO: 140694 - RNA, 18 nt, Artificial Sequence
  Description of Artificial Sequence: Synthetic oligonucleotide
cccagcacacaaggacuc

SEQ ID NO: 140695 - RNA, 18 nt, Artificial Sequence
  Description of Artificial Sequence: Synthetic oligonucleotide
cagugcccagcacacaag

SEQ ID NO: 140696 - RNA, 18 nt, Artificial Sequence
  Description of Artificial Sequence: Synthetic oligonucleotide
guucacagugcccagcac

SEQ ID NO: 140697 - RNA, 18 nt, Artificial Sequence
  Description of Artificial Sequence: Synthetic oligonucleotide
guuuuguucacagugccc

SEQ ID NO: 140698 - RNA, 18 nt, Artificial Sequence
  Description of Artificial Sequence: Synthetic oligonucleotide
ugucuguuuuguucacag

SEQ ID NO: 140699 - RNA, 18 nt, Artificial Sequence
  Description of Artificial Sequence: Synthetic oligonucleotide
gauuuugucuguuuuguu

SEQ ID NO: 140700 - RNA, 18 nt, Artificial Sequence
  Description of Artificial Sequence: Synthetic oligonucleotide
gcagugauuuugucuguu

SEQ ID NO: 140701 - RNA, 18 nt, Artificial Sequence
  Description of Artificial Sequence: Synthetic oligonucleotide
caagagcagugauuuugu

SEQ ID NO: 140702 - RNA, 18 nt, Artificial Sequence
  Description of Artificial Sequence: Synthetic oligonucleotide
cuuugcaagagcagugau

SEQ ID NO: 140703 - RNA, 18 nt, Artificial Sequence
  Description of Artificial Sequence: Synthetic oligonucleotide
uguaucuuugcaagagca

SEQ ID NO: 140704 - RNA, 18 nt, Artificial Sequence
  Description of Artificial Sequence: Synthetic oligonucleotide
uuugguguaucuuugcaa

SEQ ID NO: 140705 - RNA, 18 nt, Artificial Sequence
  Description of Artificial Sequence: Synthetic oligonucleotide
uuuuuuuugguguaucuu

SEQ ID NO: 140706 - RNA, 18 nt, Artificial Sequence
  Description of Artificial Sequence: Synthetic oligonucleotide
uuuuuuuuuuuuuggugu

SEQ ID NO: 140707 - RNA, 18 nt, Artificial Sequence
  Description of Artificial Sequence: Synthetic oligonucleotide
ugauuuuuuuuuuuuuuu

SEQ ID NO: 140708 - RNA, 18 nt, Artificial Sequence
  Description of Artificial Sequence: Synthetic oligonucleotide
agaugugauuuuuuuuuu

SEQ ID NO: 140709 - RNA, 18 nt, Artificial Sequence
  Description of Artificial Sequence: Synthetic oligonucleotide
ccacaagaugugauuuuu

SEQ ID NO: 140710 - RNA, 18 nt, Artificial Sequence
  Description of Artificial Sequence: Synthetic oligonucleotide
aagcuccacaagauguga

SEQ ID NO: 140711 - RNA, 18 nt, Artificial Sequence
  Description of Artificial Sequence: Synthetic oligonucleotide
aucgcaagcuccacaaga

SEQ ID NO: 140712 - RNA, 18 nt, Artificial Sequence
  Description of Artificial Sequence: Synthetic oligonucleotide
uccagaucgcaagcucca

SEQ ID NO: 140713 - RNA, 18 nt, Artificial Sequence
  Description of Artificial Sequence: Synthetic oligonucleotide
gccccuccagaucgcaag

SEQ ID NO: 140714 - RNA, 18 nt, Artificial Sequence
  Description of Artificial Sequence: Synthetic oligonucleotide
ggguggccccuccagauc

SEQ ID NO: 140715 - RNA, 18 nt, Artificial Sequence
  Description of Artificial Sequence: Synthetic oligonucleotide
caagguaggaaugauggg

SEQ ID NO: 140716 - RNA, 18 nt, Artificial Sequence
  Description of Artificial Sequence: Synthetic oligonucleotide
ucagcaagguaggaauga

SEQ ID NO: 140717 - RNA, 18 nt, Artificial Sequence
  Description of Artificial Sequence: Synthetic oligonucleotide
uagagucagcaagguagg

SEQ ID NO: 140718 - RNA, 18 nt, Artificial Sequence
  Description of Artificial Sequence: Synthetic oligonucleotide
agcucuagagucagcaag

SEQ ID NO: 140719 - RNA, 18 nt, Artificial Sequence
  Description of Artificial Sequence: Synthetic oligonucleotide
ccagaagcucuagaguca

SEQ ID NO: 140720 - RNA, 18 nt, Artificial Sequence
  Description of Artificial Sequence: Synthetic oligonucleotide
ggcccccagaagcucuag

SEQ ID NO: 140721 - RNA, 18 nt, Artificial Sequence
  Description of Artificial Sequence: Synthetic oligonucleotide
ccuaaggcccccagaagc

SEQ ID NO: 140722 - RNA, 18 nt, Artificial Sequence
  Description of Artificial Sequence: Synthetic oligonucleotide
uggagccuaaggccccca

SEQ ID NO: 140723 - RNA, 18 nt, Artificial Sequence
  Description of Artificial Sequence: Synthetic oligonucleotide
ccuuuuggagccuaaggc

SEQ ID NO: 140724 - RNA, 18 nt, Artificial Sequence
  Description of Artificial Sequence: Synthetic oligonucleotide
caaauccuuuuggagccu

SEQ ID NO: 140725 - RNA, 18 nt, Artificial Sequence
  Description of Artificial Sequence: Synthetic oligonucleotide
ugggccaaauccuuuugg

SEQ ID NO: 140726 - RNA, 18 nt, Artificial Sequence
  Description of Artificial Sequence: Synthetic oligonucleotide
gugcaugggccaaauccu

SEQ ID NO: 140727 - RNA, 18 nt, Artificial Sequence
  Description of Artificial Sequence: Synthetic oligonucleotide
uacaggugcaugggccaa

SEQ ID NO: 140728 - RNA, 18 nt, Artificial Sequence
  Description of Artificial Sequence: Synthetic oligonucleotide
cccuuuacaggugcaugg

SEQ ID NO: 140729 - RNA, 18 nt, Artificial Sequence
  Description of Artificial Sequence: Synthetic oligonucleotide
cccaucccuuuacaggug

SEQ ID NO: 140730 - RNA, 18 nt, Artificial Sequence
  Description of Artificial Sequence: Synthetic oligonucleotide
acauccccaucccuuuac

SEQ ID NO: 140731 - RNA, 18 nt, Artificial Sequence
  Description of Artificial Sequence: Synthetic oligonucleotide
cucugacauccccauccc

SEQ ID NO: 140732 - RNA, 18 nt, Artificial Sequence
  Description of Artificial Sequence: Synthetic oligonucleotide
agcaccucugacaucccc

SEQ ID NO: 140733 - RNA, 18 nt, Artificial Sequence
  Description of Artificial Sequence: Synthetic oligonucleotide
gccccagcaccucugaca

SEQ ID NO: 140734 - RNA, 18 nt, Artificial Sequence
  Description of Artificial Sequence: Synthetic oligonucleotide
ggcaggccccagcaccuc

SEQ ID NO: 140735 - RNA, 18 nt, Artificial Sequence
  Description of Artificial Sequence: Synthetic oligonucleotide
gcccaggcaggccccagc

SEQ ID NO: 140736 - RNA, 18 nt, Artificial Sequence
  Description of Artificial Sequence: Synthetic oligonucleotide
aaggagcccaggcaggcc

SEQ ID NO: 140737 - RNA, 18 nt, Artificial Sequence
  Description of Artificial Sequence: Synthetic oligonucleotide
ucagcaaggagcccaggc

SEQ ID NO: 140738 - RNA, 18 nt, Artificial Sequence
  Description of Artificial Sequence: Synthetic oligonucleotide
ggcagucagcaaggagcc

SEQ ID NO: 140739 - RNA, 18 nt, Artificial Sequence
  Description of Artificial Sequence: Synthetic oligonucleotide
auccgaccaaaacggaua

SEQ ID NO: 140740 - RNA, 18 nt, Artificial Sequence
  Description of Artificial Sequence: Synthetic oligonucleotide
ccggcauccgaccaaaac

SEQ ID NO: 140741 - RNA, 18 nt, Artificial Sequence
  Description of Artificial Sequence: Synthetic oligonucleotide
agccuccggcauccgacc

SEQ ID NO: 140742 - RNA, 18 nt, Artificial Sequence
  Description of Artificial Sequence: Synthetic oligonucleotide
uucucagccuccggcauc

SEQ ID NO: 140743 - RNA, 18 nt, Artificial Sequence
  Description of Artificial Sequence: Synthetic oligonucleotide
uccucuucucagccuccg

SEQ ID NO: 140744 - RNA, 18 nt, Artificial Sequence
  Description of Artificial Sequence: Synthetic oligonucleotide
cagcuuccucuucucagc

SEQ ID NO: 140745 - RNA, 18 nt, Artificial Sequence
  Description of Artificial Sequence: Synthetic oligonucleotide
gccaccagcuuccucuuc

SEQ ID NO: 140746 - RNA, 18 nt, Artificial Sequence
  Description of Artificial Sequence: Synthetic oligonucleotide
gcccugccaccagcuucc

SEQ ID NO: 140747 - RNA, 18 nt, Artificial Sequence
  Description of Artificial Sequence: Synthetic oligonucleotide
agucagcccugccaccag

SEQ ID NO: 140748 - RNA, 18 nt, Artificial Sequence
  Description of Artificial Sequence: Synthetic oligonucleotide
uuugcagucagcccugcc

SEQ ID NO: 140749 - RNA, 18 nt, Artificial Sequence
  Description of Artificial Sequence: Synthetic oligonucleotide
ccucguuugcagucagcc

SEQ ID NO: 140750 - RNA, 18 nt, Artificial Sequence
  Description of Artificial Sequence: Synthetic oligonucleotide
gcuccccucguuugcagu

SEQ ID NO: 140751 - RNA, 18 nt, Artificial Sequence
  Description of Artificial Sequence: Synthetic oligonucleotide
uacuggcuccccucguuu

SEQ ID NO: 140752 - RNA, 18 nt, Artificial Sequence
  Description of Artificial Sequence: Synthetic oligonucleotide
gguuguacuggcuccccu

SEQ ID NO: 140753 - RNA, 18 nt, Artificial Sequence
  Description of Artificial Sequence: Synthetic oligonucleotide
cuguggguuguacuggcu

SEQ ID NO: 140754 - RNA, 18 nt, Artificial Sequence
  Description of Artificial Sequence: Synthetic oligonucleotide
gccaccuguggguuguac

SEQ ID NO: 140755 - RNA, 18 nt, Artificial Sequence
  Description of Artificial Sequence: Synthetic oligonucleotide
ggucggccaccugugggu

SEQ ID NO: 140756 - RNA, 18 nt, Artificial Sequence
  Description of Artificial Sequence: Synthetic oligonucleotide
cuucaggucggccaccug

SEQ ID NO: 140757 - RNA, 18 nt, Artificial Sequence
  Description of Artificial Sequence: Synthetic oligonucleotide
aaggccuucaggucggcc

SEQ ID NO: 140758 - RNA, 18 nt, Artificial Sequence
  Description of Artificial Sequence: Synthetic oligonucleotide
uggagaaggccuucaggu

SEQ ID NO: 140759 - RNA, 18 nt, Artificial Sequence
  Description of Artificial Sequence: Synthetic oligonucleotide
gugcuuggagaaggccuu

SEQ ID NO: 140760 - RNA, 18 nt, Artificial Sequence
  Description of Artificial Sequence: Synthetic oligonucleotide
uagaugugcuuggagaag

SEQ ID NO: 140761 - RNA, 18 nt, Artificial Sequence
  Description of Artificial Sequence: Synthetic oligonucleotide
cauuguagaugugcuugg

SEQ ID NO: 140762 - RNA, 18 nt, Artificial Sequence
  Description of Artificial Sequence: Synthetic oligonucleotide
guaggcauuguagaugug

SEQ ID NO: 140763 - RNA, 18 nt, Artificial Sequence
  Description of Artificial Sequence: Synthetic oligonucleotide
uucagguaggcauuguag

SEQ ID NO: 140764 - RNA, 18 nt, Artificial Sequence
  Description of Artificial Sequence: Synthetic oligonucleotide
aguuuuucagguaggcau

SEQ ID NO: 140765 - RNA, 18 nt, Artificial Sequence
  Description of Artificial Sequence: Synthetic oligonucleotide
guugaaguuuuucaggua

SEQ ID NO: 140766 - RNA, 18 nt, Artificial Sequence
  Description of Artificial Sequence: Synthetic oligonucleotide
gucauguugaaguuuuuc

SEQ ID NO: 140767 - RNA, 18 nt, Artificial Sequence
  Description of Artificial Sequence: Synthetic oligonucleotide
uuuuggucauguugaagu

SEQ ID NO: 140768 - RNA, 18 nt, Artificial Sequence
  Description of Artificial Sequence: Synthetic oligonucleotide
cuucuuuuuggucauguu

SEQ ID NO: 140769 - RNA, 18 nt, Artificial Sequence
  Description of Artificial Sequence: Synthetic oligonucleotide
cgggccuucuuuuugguc

SEQ ID NO: 140770 - RNA, 18 nt, Artificial Sequence
  Description of Artificial Sequence: Synthetic oligonucleotide
ugcugcgggccuucuuuu

SEQ ID NO: 140771 - RNA, 18 nt, Artificial Sequence
  Description of Artificial Sequence: Synthetic oligonucleotide
gaggaugcugcgggccuu

SEQ ID NO: 140772 - RNA, 18 nt, Artificial Sequence
  Description of Artificial Sequence: Synthetic oligonucleotide
ccggugaggaugcugcgg

SEQ ID NO: 140773 - RNA, 18 nt, Artificial Sequence
  Description of Artificial Sequence: Synthetic oligonucleotide
cuuugccggugaggaugc

SEQ ID NO: 140774 - RNA, 18 nt, Artificial Sequence
  Description of Artificial Sequence: Synthetic oligonucleotide
gcuggcuuugccggugag

SEQ ID NO: 140775 - RNA, 18 nt, Artificial Sequence
  Description of Artificial Sequence: Synthetic oligonucleotide
guguggcuggcuuugccg

SEQ ID NO: 140776 - RNA, 18 nt, Artificial Sequence
  Description of Artificial Sequence: Synthetic oligonucleotide
cauccgaccaaaacggau

SEQ ID NO: 140777 - RNA, 18 nt, Artificial Sequence
  Description of Artificial Sequence: Synthetic oligonucleotide
uccggcauccgaccaaaa

SEQ ID NO: 140778 - RNA, 18 nt, Artificial Sequence
  Description of Artificial Sequence: Synthetic oligonucleotide
cagccuccggcauccgac

SEQ ID NO: 140779 - RNA, 18 nt, Artificial Sequence
  Description of Artificial Sequence: Synthetic oligonucleotide
cuucucagccuccggcau

SEQ ID NO: 140780 - RNA, 18 nt, Artificial Sequence
  Description of Artificial Sequence: Synthetic oligonucleotide
uuccucuucucagccucc

SEQ ID NO: 140781 - RNA, 18 nt, Artificial Sequence
  Description of Artificial Sequence: Synthetic oligonucleotide
ccagcuuccucuucucag

SEQ ID NO: 140782 - RNA, 18 nt, Artificial Sequence
  Description of Artificial Sequence: Synthetic oligonucleotide
ugccaccagcuuccucuu

SEQ ID NO: 140783 - RNA, 18 nt, Artificial Sequence
  Description of Artificial Sequence: Synthetic oligonucleotide
agcccugccaccagcuuc

SEQ ID NO: 140784 - RNA, 18 nt, Artificial Sequence
  Description of Artificial Sequence: Synthetic oligonucleotide
cagucagcccugccacca

SEQ ID NO: 140785 - RNA, 18 nt, Artificial Sequence
  Description of Artificial Sequence: Synthetic oligonucleotide
guuugcagucagcccugc

SEQ ID NO: 140786 - RNA, 18 nt, Artificial Sequence
  Description of Artificial Sequence: Synthetic oligonucleotide
cccucguuugcagucagc

SEQ ID NO: 140787 - RNA, 18 nt, Artificial Sequence
  Description of Artificial Sequence: Synthetic oligonucleotide
ggcuccccucguuugcag

SEQ ID NO: 140788 - RNA, 18 nt, Artificial Sequence
  Description of Artificial Sequence: Synthetic oligonucleotide
guacuggcuccccucguu

SEQ ID NO: 140789 - RNA, 18 nt, Artificial Sequence
  Description of Artificial Sequence: Synthetic oligonucleotide
ggguuguacuggcucccc

SEQ ID NO: 140790 - RNA, 18 nt, Artificial Sequence
  Description of Artificial Sequence: Synthetic oligonucleotide
ccuguggguuguacuggc

SEQ ID NO: 140791 - RNA, 18 nt, Artificial Sequence
  Description of Artificial Sequence: Synthetic oligonucleotide
ggccaccuguggguugua

SEQ ID NO: 140792 - RNA, 18 nt, Artificial Sequence
  Description of Artificial Sequence: Synthetic oligonucleotide
aggucggccaccuguggg

SEQ ID NO: 140793 - RNA, 18 nt, Artificial Sequence
  Description of Artificial Sequence: Synthetic oligonucleotide
ccuucaggucggccaccu

SEQ ID NO: 140794 - RNA, 18 nt, Artificial Sequence
  Description of Artificial Sequence: Synthetic oligonucleotide
gaaggccuucaggucggc

SEQ ID NO: 140795 - RNA, 18 nt, Artificial Sequence
  Description of Artificial Sequence: Synthetic oligonucleotide
uuggagaaggccuucagg

SEQ ID NO: 140796 - RNA, 18 nt, Artificial Sequence
  Description of Artificial Sequence: Synthetic oligonucleotide
ugugcuuggagaaggccu

SEQ ID NO: 140797 - RNA, 18 nt, Artificial Sequence
  Description of Artificial Sequence: Synthetic oligonucleotide
guagaugugcuuggagaa

SEQ ID NO: 140798 - RNA, 18 nt, Artificial Sequence
  Description of Artificial Sequence: Synthetic oligonucleotide
gcauuguagaugugcuug

SEQ ID NO: 140799 - RNA, 18 nt, Artificial Sequence
  Description of Artificial Sequence: Synthetic oligonucleotide
gguaggcauuguagaugu

SEQ ID NO: 140800 - RNA, 18 nt, Artificial Sequence
  Description of Artificial Sequence: Synthetic oligonucleotide
uuucagguaggcauugua

SEQ ID NO: 140801 - RNA, 18 nt, Artificial Sequence
  Description of Artificial Sequence: Synthetic oligonucleotide
aaguuuuucagguaggca

SEQ ID NO: 140802 - RNA, 18 nt, Artificial Sequence
  Description of Artificial Sequence: Synthetic oligonucleotide
uguugaaguuuuucaggu

SEQ ID NO: 140803 - RNA, 18 nt, Artificial Sequence
  Description of Artificial Sequence: Synthetic oligonucleotide
ggucauguugaaguuuuu

SEQ ID NO: 140804 - RNA, 18 nt, Artificial Sequence
  Description of Artificial Sequence: Synthetic oligonucleotide
uuuuuggucauguugaag

SEQ ID NO: 140805 - RNA, 18 nt, Artificial Sequence
  Description of Artificial Sequence: Synthetic oligonucleotide
ccuucuuuuuggucaugu

SEQ ID NO: 140806 - RNA, 18 nt, Artificial Sequence
  Description of Artificial Sequence: Synthetic oligonucleotide
gcgggccuucuuuuuggu

SEQ ID NO: 140807 - RNA, 18 nt, Artificial Sequence
  Description of Artificial Sequence: Synthetic oligonucleotide
augcugcgggccuucuuu

SEQ ID NO: 140808 - RNA, 18 nt, Artificial Sequence
  Description of Artificial Sequence: Synthetic oligonucleotide
ugaggaugcugcgggccu

SEQ ID NO: 140809 - RNA, 18 nt, Artificial Sequence
  Description of Artificial Sequence: Synthetic oligonucleotide
gccggugaggaugcugcg

SEQ ID NO: 140810 - RNA, 18 nt, Artificial Sequence
  Description of Artificial Sequence: Synthetic oligonucleotide
gcuuugccggugaggaug

SEQ ID NO: 140811 - RNA, 18 nt, Artificial Sequence
  Description of Artificial Sequence: Synthetic oligonucleotide
ggcuggcuuugccgguga

SEQ ID NO: 140812 - RNA, 18 nt, Artificial Sequence
  Description of Artificial Sequence: Synthetic oligonucleotide
cguguggcuggcuuugcc

SEQ ID NO: 140813 - RNA, 18 nt, Artificial Sequence
  Description of Artificial Sequence: Synthetic oligonucleotide
ggccaagcagcagcaaca

SEQ ID NO: 140814 - RNA, 18 nt, Artificial Sequence
  Description of Artificial Sequence: Synthetic oligonucleotide
ugccaggccaagcagcag

SEQ ID NO: 140815 - RNA, 18 nt, Artificial Sequence
  Description of Artificial Sequence: Synthetic oligonucleotide
gaugcugccaggccaagc

SEQ ID NO: 140816 - RNA, 18 nt, Artificial Sequence
  Description of Artificial Sequence: Synthetic oligonucleotide
cccaggaugcugccaggc

SEQ ID NO: 140817 - RNA, 18 nt, Artificial Sequence
  Description of Artificial Sequence: Synthetic oligonucleotide
cagagcccaggaugcugc

SEQ ID NO: 140818 - RNA, 18 nt, Artificial Sequence
  Description of Artificial Sequence: Synthetic oligonucleotide
ggacccagagcccaggau

SEQ ID NO: 140819 - RNA, 18 nt, Artificial Sequence
  Description of Artificial Sequence: Synthetic oligonucleotide
cagugggacccagagccc

SEQ ID NO: 140820 - RNA, 18 nt, Artificial Sequence
  Description of Artificial Sequence: Synthetic oligonucleotide
ggcggcagugggacccag

SEQ ID NO: 140821 - RNA, 18 nt, Artificial Sequence
  Description of Artificial Sequence: Synthetic oligonucleotide
aggcaggcggcaguggga

SEQ ID NO: 140822 - RNA, 18 nt, Artificial Sequence
  Description of Artificial Sequence: Synthetic oligonucleotide
gagucaggcaggcggcag

SEQ ID NO: 140823 - RNA, 18 nt, Artificial Sequence
  Description of Artificial Sequence: Synthetic oligonucleotide
ucccggagucaggcaggc

SEQ ID NO: 140824 - RNA, 18 nt, Artificial Sequence
  Description of Artificial Sequence: Synthetic oligonucleotide
ggcucucccggagucagg

SEQ ID NO: 140825 - RNA, 18 nt, Artificial Sequence
  Description of Artificial Sequence: Synthetic oligonucleotide
ggccuggcucucccggag

SEQ ID NO: 140826 - RNA, 18 nt, Artificial Sequence
  Description of Artificial Sequence: Synthetic oligonucleotide
gagaaggccuggcucucc

SEQ ID NO: 140827 - RNA, 18 nt, Artificial Sequence
  Description of Artificial Sequence: Synthetic oligonucleotide
ggagggagaaggccuggc

SEQ ID NO: 140828 - RNA, 18 nt, Artificial Sequence
  Description of Artificial Sequence: Synthetic oligonucleotide
uugagggagggagaaggc

SEQ ID NO: 140829 - RNA, 18 nt, Artificial Sequence
  Description of Artificial Sequence: Synthetic oligonucleotide
ugaaguugagggagggag

SEQ ID NO: 140830 - RNA, 18 nt, Artificial Sequence
  Description of Artificial Sequence: Synthetic oligonucleotide
caccaugaaguugaggga

SEQ ID NO: 140831 - RNA, 18 nt, Artificial Sequence
  Description of Artificial Sequence: Synthetic oligonucleotide
gccugcaccaugaaguug

SEQ ID NO: 140832 - RNA, 18 nt, Artificial Sequence
  Description of Artificial Sequence: Synthetic oligonucleotide
cccuugccugcaccauga

SEQ ID NO: 140833 - RNA, 18 nt, Artificial Sequence
  Description of Artificial Sequence: Synthetic oligonucleotide
cuggcucucccggaguca

SEQ ID NO: 140834 - RNA, 18 nt, Artificial Sequence
  Description of Artificial Sequence: Synthetic oligonucleotide
aaggccuggcucucccgg

SEQ ID NO: 140835 - RNA, 18 nt, Artificial Sequence
  Description of Artificial Sequence: Synthetic oligonucleotide
gggagaaggccuggcucu

SEQ ID NO: 140836 - RNA, 18 nt, Artificial Sequence
  Description of Artificial Sequence: Synthetic oligonucleotide
agggagggagaaggccug

SEQ ID NO: 140837 - RNA, 18 nt, Artificial Sequence
  Description of Artificial Sequence: Synthetic oligonucleotide
aguugagggagggagaag

SEQ ID NO: 140838 - RNA, 18 nt, Artificial Sequence
  Description of Artificial Sequence: Synthetic oligonucleotide
caugaaguugagggaggg

SEQ ID NO: 140839 - RNA, 18 nt, Artificial Sequence
  Description of Artificial Sequence: Synthetic oligonucleotide
ugcaccaugaaguugagg

SEQ ID NO: 140840 - RNA, 18 nt, Artificial Sequence
  Description of Artificial Sequence: Synthetic oligonucleotide
uugccugcaccaugaagu

SEQ ID NO: 140841 - RNA, 18 nt, Artificial Sequence
  Description of Artificial Sequence: Synthetic oligonucleotide
gucccuugccugcaccau

SEQ ID NO: 140842 - RNA, 18 nt, Artificial Sequence
  Description of Artificial Sequence: Synthetic oligonucleotide
cccaugucccuugccugc

SEQ ID NO: 140843 - RNA, 18 nt, Artificial Sequence
  Description of Artificial Sequence: Synthetic oligonucleotide
ugcuccccaugucccuug

SEQ ID NO: 140844 - RNA, 18 nt, Artificial Sequence
  Description of Artificial Sequence: Synthetic oligonucleotide
cccugugcuccccauguc

SEQ ID NO: 140845 - RNA, 18 nt, Artificial Sequence
  Description of Artificial Sequence: Synthetic oligonucleotide
ccccacccugugcucccc

SEQ ID NO: 140846 - RNA, 18 nt, Artificial Sequence
  Description of Artificial Sequence: Synthetic oligonucleotide
gagacccccacccugugc

SEQ ID NO: 140847 - RNA, 18 nt, Artificial Sequence
  Description of Artificial Sequence: Synthetic oligonucleotide
cucgggagacccccaccc

SEQ ID NO: 140848 - RNA, 18 nt, Artificial Sequence
  Description of Artificial Sequence: Synthetic oligonucleotide
caggccucgggagacccc

SEQ ID NO: 140849 - RNA, 18 nt, Artificial Sequence
  Description of Artificial Sequence: Synthetic oligonucleotide
gagaucaggccucgggag

SEQ ID NO: 140850 - RNA, 18 nt, Artificial Sequence
  Description of Artificial Sequence: Synthetic oligonucleotide
cguuagagaucaggccuc

SEQ ID NO: 140851 - RNA, 18 nt, Artificial Sequence
  Description of Artificial Sequence: Synthetic oligonucleotide
ugucguggaucacaaagg

SEQ ID NO: 140852 - RNA, 18 nt, Artificial Sequence
  Description of Artificial Sequence: Synthetic oligonucleotide
cucgaugucguggaucac

SEQ ID NO: 140853 - RNA, 18 nt, Artificial Sequence
  Description of Artificial Sequence: Synthetic oligonucleotide
aaugucucgaugucgugg

SEQ ID NO: 140854 - RNA, 18 nt, Artificial Sequence
  Description of Artificial Sequence: Synthetic oligonucleotide
gccacaaugucucgaugu

SEQ ID NO: 140855 - RNA, 18 nt, Artificial Sequence
  Description of Artificial Sequence: Synthetic oligonucleotide
ugccugccacaaugucuc

SEQ ID NO: 140856 - RNA, 18 nt, Artificial Sequence
  Description of Artificial Sequence: Synthetic oligonucleotide
uucucugccugccacaau

SEQ ID NO: 140857 - RNA, 18 nt, Artificial Sequence
  Description of Artificial Sequence: Synthetic oligonucleotide
gccccuucucugccugcc

SEQ ID NO: 140858 - RNA, 18 nt, Artificial Sequence
  Description of Artificial Sequence: Synthetic oligonucleotide
caccagccccuucucugc

SEQ ID NO: 140859 - RNA, 18 nt, Artificial Sequence
  Description of Artificial Sequence: Synthetic oligonucleotide
uuccacaccagccccuuc

SEQ ID NO: 140860 - RNA, 18 nt, Artificial Sequence
  Description of Artificial Sequence: Synthetic oligonucleotide
acugcuuccacaccagcc

SEQ ID NO: 140861 - RNA, 18 nt, Artificial Sequence
  Description of Artificial Sequence: Synthetic oligonucleotide
caccaacugcuuccacac

SEQ ID NO: 140862 - RNA, 18 nt, Artificial Sequence
  Description of Artificial Sequence: Synthetic oligonucleotide
ccauucaccaacugcuuc

SEQ ID NO: 140863 - RNA, 18 nt, Artificial Sequence
  Description of Artificial Sequence: Synthetic oligonucleotide
gcaggccauucaccaacu

SEQ ID NO: 140864 - RNA, 18 nt, Artificial Sequence
  Description of Artificial Sequence: Synthetic oligonucleotide
gggaggcaggccauucac

SEQ ID NO: 140865 - RNA, 18 nt, Artificial Sequence
  Description of Artificial Sequence: Synthetic oligonucleotide
uuguagggaggcaggcca

SEQ ID NO: 140866 - RNA, 18 nt, Artificial Sequence
  Description of Artificial Sequence: Synthetic oligonucleotide
ucuccuuguagggaggca

SEQ ID NO: 140867 - RNA, 18 nt, Artificial Sequence
  Description of Artificial Sequence: Synthetic oligonucleotide
gcugaucuccuuguaggg

SEQ ID NO: 140868 - RNA, 18 nt, Artificial Sequence
  Description of Artificial Sequence: Synthetic oligonucleotide
ugcacgcugaucuccuug

SEQ ID NO: 140869 - RNA, 18 nt, Artificial Sequence
  Description of Artificial Sequence: Synthetic oligonucleotide
agacgugcacgcugaucu

SEQ ID NO: 140870 - RNA, 18 nt, Artificial Sequence
  Description of Artificial Sequence: Synthetic oligonucleotide
guagaagacgugcacgcu

SEQ ID NO: 140871 - RNA, 18 nt, Artificial Sequence
  Description of Artificial Sequence: Synthetic oligonucleotide
cagcgguagaagacgugc

SEQ ID NO: 140872 - RNA, 18 nt, Artificial Sequence
  Description of Artificial Sequence: Synthetic oligonucleotide
acuggcagcgguagaaga

SEQ ID NO: 140873 - RNA, 18 nt, Artificial Sequence
  Description of Artificial Sequence: Synthetic oligonucleotide
ggugcacuggcagcggua

SEQ ID NO: 140874 - RNA, 18 nt, Artificial Sequence
  Description of Artificial Sequence: Synthetic oligonucleotide
acuguggugcacuggcag

SEQ ID NO: 140875 - RNA, 18 nt, Artificial Sequence
  Description of Artificial Sequence: Synthetic oligonucleotide
ucuccacuguggugcacu

SEQ ID NO: 140876 - RNA, 18 nt, Artificial Sequence
  Description of Artificial Sequence: Synthetic oligonucleotide
cacggucuccacuguggu

SEQ ID NO: 140877 - RNA, 18 nt, Artificial Sequence
  Description of Artificial Sequence: Synthetic oligonucleotide
ucccgcacggucuccacu

SEQ ID NO: 140878 - RNA, 18 nt, Artificial Sequence
  Description of Artificial Sequence: Synthetic oligonucleotide
ugagcucccgcacggucu

SEQ ID NO: 140879 - RNA, 18 nt, Artificial Sequence
  Description of Artificial Sequence: Synthetic oligonucleotide
cucagugagcucccgcac

SEQ ID NO: 140880 - RNA, 18 nt, Artificial Sequence
  Description of Artificial Sequence: Synthetic oligonucleotide
gcgaacucagugagcucc

SEQ ID NO: 140881 - RNA, 18 nt, Artificial Sequence
  Description of Artificial Sequence: Synthetic oligonucleotide
ucuuggcgaacucaguga

SEQ ID NO: 140882 - RNA, 18 nt, Artificial Sequence
  Description of Artificial Sequence: Synthetic oligonucleotide
gaugcucuuggcgaacuc

SEQ ID NO: 140883 - RNA, 18 nt, Artificial Sequence
  Description of Artificial Sequence: Synthetic oligonucleotide
gggaugcucuuggcgaac

SEQ ID NO: 140884 - RNA, 18 nt, Artificial Sequence
  Description of Artificial Sequence: Synthetic oligonucleotide
gaggcugcugaagcuggg

SEQ ID NO: 140885 - RNA, 18 nt, Artificial Sequence
  Description of Artificial Sequence: Synthetic oligonucleotide
aggaagaggcugcugaag

SEQ ID NO: 140886 - RNA, 18 nt, Artificial Sequence
  Description of Artificial Sequence: Synthetic oligonucleotide
cguugaggaagaggcugc

SEQ ID NO: 140887 - RNA, 18 nt, Artificial Sequence
  Description of Artificial Sequence: Synthetic oligonucleotide
cuggucguugaggaagag

SEQ ID NO: 140888 - RNA, 18 nt, Artificial Sequence
  Description of Artificial Sequence: Synthetic oligonucleotide
guaaccuggucguugagg

SEQ ID NO: 140889 - RNA, 18 nt, Artificial Sequence
  Description of Artificial Sequence: Synthetic oligonucleotide
gaaggguaaccuggucgu

SEQ ID NO: 140890 - RNA, 18 nt, Artificial Sequence
  Description of Artificial Sequence: Synthetic oligonucleotide
cuugagaaggguaaccug

SEQ ID NO: 140891 - RNA, 18 nt, Artificial Sequence
  Description of Artificial Sequence: Synthetic oligonucleotide
ccauacuugagaagggua

SEQ ID NO: 140892 - RNA, 18 nt, Artificial Sequence
  Description of Artificial Sequence: Synthetic oligonucleotide
gcacgccauacuugagaa

SEQ ID NO: 140893 - RNA, 18 nt, Artificial Sequence
  Description of Artificial Sequence: Synthetic oligonucleotide
cucgugcacgccauacuu

SEQ ID NO: 140894 - RNA, 18 nt, Artificial Sequence
  Description of Artificial Sequence: Synthetic oligonucleotide
auggccucgugcacgcca

SEQ ID NO: 140895 - RNA, 18 nt, Artificial Sequence
  Description of Artificial Sequence: Synthetic oligonucleotide
cgaagauggccucgugca

SEQ ID NO: 140896 - RNA, 18 nt, Artificial Sequence
  Description of Artificial Sequence: Synthetic oligonucleotide
cauggcgaagauggccuc

SEQ ID NO: 140897 - RNA, 18 nt, Artificial Sequence
  Description of Artificial Sequence: Synthetic oligonucleotide
gccagcauggcgaagaug

SEQ ID NO: 140898 - RNA, 18 nt, Artificial Sequence
  Description of Artificial Sequence: Synthetic oligonucleotide
uagaggccagcauggcga

SEQ ID NO: 140899 - RNA, 18 nt, Artificial Sequence
  Description of Artificial Sequence: Synthetic oligonucleotide
gacgauagaggccagcau

SEQ ID NO: 140900 - RNA, 18 nt, Artificial Sequence
  Description of Artificial Sequence: Synthetic oligonucleotide
uuguugacgauagaggcc

SEQ ID NO: 140901 - RNA, 18 nt, Artificial Sequence
  Description of Artificial Sequence: Synthetic oligonucleotide
cguccuuguugacgauag

SEQ ID NO: 140902 - RNA, 18 nt, Artificial Sequence
  Description of Artificial Sequence: Synthetic oligonucleotide
cagcccguccuuguugac

SEQ ID NO: 140903 - RNA, 18 nt, Artificial Sequence
  Description of Artificial Sequence: Synthetic oligonucleotide
accagcagcccguccuug

SEQ ID NO: 140904 - RNA, 18 nt, Artificial Sequence
  Description of Artificial Sequence: Synthetic oligonucleotide
uggcuaccagcagcccgu

SEQ ID NO: 140905 - RNA, 18 nt, Artificial Sequence
  Description of Artificial Sequence: Synthetic oligonucleotide
gccguuggcuaccagcag

SEQ ID NO: 140906 - RNA, 18 nt, Artificial Sequence
  Description of Artificial Sequence: Synthetic oligonucleotide
ccacugccguuggcuacc

SEQ ID NO: 140907 - RNA, 18 nt, Artificial Sequence
  Description of Artificial Sequence: Synthetic oligonucleotide
caaagccacugccguugg

SEQ ID NO: 140908 - RNA, 18 nt, Artificial Sequence
  Description of Artificial Sequence: Synthetic oligonucleotide
ggugacaaagccacugcc

SEQ ID NO: 140909 - RNA, 18 nt, Artificial Sequence
  Description of Artificial Sequence: Synthetic oligonucleotide
ucacgggugacaaagcca

SEQ ID NO: 140910 - RNA, 18 nt, Artificial Sequence
  Description of Artificial Sequence: Synthetic oligonucleotide
ggaacucacgggugacaa

SEQ ID NO: 140911 - RNA, 18 nt, Artificial Sequence
  Description of Artificial Sequence: Synthetic oligonucleotide
gcgcaggaacucacgggu

SEQ ID NO: 140912 - RNA, 18 nt, Artificial Sequence
  Description of Artificial Sequence: Synthetic oligonucleotide
aggcugcgcaggaacuca

SEQ ID NO: 140913 - RNA, 18 nt, Artificial Sequence
  Description of Artificial Sequence: Synthetic oligonucleotide
ugcggaggcugcgcagga

SEQ ID NO: 140914 - RNA, 18 nt, Artificial Sequence
  Description of Artificial Sequence: Synthetic oligonucleotide
ggguuugcggaggcugcg

SEQ ID NO: 140915 - RNA, 18 nt, Artificial Sequence
  Description of Artificial Sequence: Synthetic oligonucleotide
cugaaggguuugcggagg

SEQ ID NO: 140916 - RNA, 18 nt, Artificial Sequence
  Description of Artificial Sequence: Synthetic oligonucleotide
uaucacugaaggguuugc

SEQ ID NO: 140917 - RNA, 18 nt, Artificial Sequence
  Description of Artificial Sequence: Synthetic oligonucleotide
aaugauaucacugaaggg

SEQ ID NO: 140918 - RNA, 18 nt, Artificial Sequence
  Description of Artificial Sequence: Synthetic oligonucleotide
ggcucaaugauaucacug

SEQ ID NO: 140919 - RNA, 18 nt, Artificial Sequence
  Description of Artificial Sequence: Synthetic oligonucleotide
acuuaggcucaaugauau

SEQ ID NO: 140920 - RNA, 18 nt, Artificial Sequence
  Description of Artificial Sequence: Synthetic oligonucleotide
uucaaacuuaggcucaau

SEQ ID NO: 140921 - RNA, 18 nt, Artificial Sequence
  Description of Artificial Sequence: Synthetic oligonucleotide
gcaaauucaaacuuaggc

SEQ ID NO: 140922 - RNA, 18 nt, Artificial Sequence
  Description of Artificial Sequence: Synthetic oligonucleotide
ugacagcaaauucaaacu

SEQ ID NO: 140923 - RNA, 18 nt, Artificial Sequence
  Description of Artificial Sequence: Synthetic oligonucleotide
gaacuugacagcaaauuc

SEQ ID NO: 140924 - RNA, 18 nt, Artificial Sequence
  Description of Artificial Sequence: Synthetic oligonucleotide
gcguugaacuugacagca

SEQ ID NO: 140925 - RNA, 18 nt, Artificial Sequence
  Description of Artificial Sequence: Synthetic oligonucleotide
ccagggcguugaacuuga

SEQ ID NO: 140926 - RNA, 18 nt, Artificial Sequence
  Description of Artificial Sequence: Synthetic oligonucleotide
aaguuccagggcguugaa

SEQ ID NO: 140927 - RNA, 18 nt, Artificial Sequence
  Description of Artificial Sequence: Synthetic oligonucleotide
ucaucaaguuccagggcg

SEQ ID NO: 140928 - RNA, 18 nt, Artificial Sequence
  Description of Artificial Sequence: Synthetic oligonucleotide
cacugucaucaaguucca

SEQ ID NO: 140929 - RNA, 18 nt, Artificial Sequence
  Description of Artificial Sequence: Synthetic oligonucleotide
caggucacugucaucaag

SEQ ID NO: 140930 - RNA, 18 nt, Artificial Sequence
  Description of Artificial Sequence: Synthetic oligonucleotide
agggccaggucacuguca

SEQ ID NO: 140931 - RNA, 18 nt, Artificial Sequence
  Description of Artificial Sequence: Synthetic oligonucleotide
ugaauagggccaggucac

SEQ ID NO: 140932 - RNA, 18 nt, Artificial Sequence
  Description of Artificial Sequence: Synthetic oligonucleotide
cgcaaugaauagggccag

SEQ ID NO: 140933 - RNA, 18 nt, Artificial Sequence
  Description of Artificial Sequence: Synthetic oligonucleotide
auggccgcaaugaauagg

SEQ ID NO: 140934 - RNA, 18 nt, Artificial Sequence
  Description of Artificial Sequence: Synthetic oligonucleotide
gaaugauggccgcaauga

SEQ ID NO: 140935 - RNA, 18 nt, Artificial Sequence
  Description of Artificial Sequence: Synthetic oligonucleotide
acacagaaugauggccgc

SEQ ID NO: 140936 - RNA, 18 nt, Artificial Sequence
  Description of Artificial Sequence: Synthetic oligonucleotide
gaugucguggaucacaaa

SEQ ID NO: 140937 - RNA, 18 nt, Artificial Sequence
  Description of Artificial Sequence: Synthetic oligonucleotide
gucucgaugucguggauc

SEQ ID NO: 140938 - RNA, 18 nt, Artificial Sequence
  Description of Artificial Sequence: Synthetic oligonucleotide
acaaugucucgaugucgu

SEQ ID NO: 140939 - RNA, 18 nt, Artificial Sequence
  Description of Artificial Sequence: Synthetic oligonucleotide
cugccacaaugucucgau

SEQ ID NO: 140940 - RNA, 18 nt, Artificial Sequence
  Description of Artificial Sequence: Synthetic oligonucleotide
ucugccugccacaauguc

SEQ ID NO: 140941 - RNA, 18 nt, Artificial Sequence
  Description of Artificial Sequence: Synthetic oligonucleotide
ccuucucugccugccaca

SEQ ID NO: 140942 - RNA, 18 nt, Artificial Sequence
  Description of Artificial Sequence: Synthetic oligonucleotide
cagccccuucucugccug

SEQ ID NO: 140943 - RNA, 18 nt, Artificial Sequence
  Description of Artificial Sequence: Synthetic oligonucleotide
cacaccagccccuucucu

SEQ ID NO: 140944 - RNA, 18 nt, Artificial Sequence
  Description of Artificial Sequence: Synthetic oligonucleotide
gcuuccacaccagccccu

SEQ ID NO: 140945 - RNA, 18 nt, Artificial Sequence
  Description of Artificial Sequence: Synthetic oligonucleotide
caacugcuuccacaccag

SEQ ID NO: 140946 - RNA, 18 nt, Artificial Sequence
  Description of Artificial Sequence: Synthetic oligonucleotide
uucaccaacugcuuccac

SEQ ID NO: 140947 - RNA, 18 nt, Artificial Sequence
  Description of Artificial Sequence: Synthetic oligonucleotide
ggccauucaccaacugcu

SEQ ID NO: 140948 - RNA, 18 nt, Artificial Sequence
  Description of Artificial Sequence: Synthetic oligonucleotide
aggcaggccauucaccaa

SEQ ID NO: 140949 - RNA, 18 nt, Artificial Sequence
  Description of Artificial Sequence: Synthetic oligonucleotide
uagggaggcaggccauuc

SEQ ID NO: 140950 - RNA, 18 nt, Artificial Sequence
  Description of Artificial Sequence: Synthetic oligonucleotide
ccuuguagggaggcaggc

SEQ ID NO: 140951 - RNA, 18 nt, Artificial Sequence
  Description of Artificial Sequence: Synthetic oligonucleotide
gaucuccuuguagggagg

SEQ ID NO: 140952 - RNA, 18 nt, Artificial Sequence
  Description of Artificial Sequence: Synthetic oligonucleotide
acgcugaucuccuuguag

SEQ ID NO: 140953 - RNA, 18 nt, Artificial Sequence
  Description of Artificial Sequence: Synthetic oligonucleotide
cgugcacgcugaucuccu

SEQ ID NO: 140954 - RNA, 18 nt, Artificial Sequence
  Description of Artificial Sequence: Synthetic oligonucleotide
gaagacgugcacgcugau

SEQ ID NO: 140955 - RNA, 18 nt, Artificial Sequence
  Description of Artificial Sequence: Synthetic oligonucleotide
cgguagaagacgugcacg

SEQ ID NO: 140956 - RNA, 18 nt, Artificial Sequence
  Description of Artificial Sequence: Synthetic oligonucleotide
ggcagcgguagaagacgu

SEQ ID NO: 140957 - RNA, 18 nt, Artificial Sequence
  Description of Artificial Sequence: Synthetic oligonucleotide
gcacuggcagcgguagaa

SEQ ID NO: 140958 - RNA, 18 nt, Artificial Sequence
  Description of Artificial Sequence: Synthetic oligonucleotide
guggugcacuggcagcgg

SEQ ID NO: 140959 - RNA, 18 nt, Artificial Sequence
  Description of Artificial Sequence: Synthetic oligonucleotide
ccacuguggugcacuggc

SEQ ID NO: 140960 - RNA, 18 nt, Artificial Sequence
  Description of Artificial Sequence: Synthetic oligonucleotide
ggucuccacuguggugca

SEQ ID NO: 140961 - RNA, 18 nt, Artificial Sequence
  Description of Artificial Sequence: Synthetic oligonucleotide
cgcacggucuccacugug

SEQ ID NO: 140962 - RNA, 18 nt, Artificial Sequence
  Description of Artificial Sequence: Synthetic oligonucleotide
gcucccgcacggucucca

SEQ ID NO: 140963 - RNA, 18 nt, Artificial Sequence
  Description of Artificial Sequence: Synthetic oligonucleotide
agugagcucccgcacggu

SEQ ID NO: 140964 - RNA, 18 nt, Artificial Sequence
  Description of Artificial Sequence: Synthetic oligonucleotide
aacucagugagcucccgc

SEQ ID NO: 140965 - RNA, 18 nt, Artificial Sequence
  Description of Artificial Sequence: Synthetic oligonucleotide
uggcgaacucagugagcu

SEQ ID NO: 140966 - RNA, 18 nt, Artificial Sequence
  Description of Artificial Sequence: Synthetic oligonucleotide
gcucuuggcgaacucagu

SEQ ID NO: 140967 - RNA, 18 nt, Artificial Sequence
  Description of Artificial Sequence: Synthetic oligonucleotide
gggaugcucuuggcgaac

SEQ ID NO: 140968 - RNA, 18 nt, Artificial Sequence
  Description of Artificial Sequence: Synthetic oligonucleotide
gaggcugcugaagcuggg

SEQ ID NO: 140969 - RNA, 18 nt, Artificial Sequence
  Description of Artificial Sequence: Synthetic oligonucleotide
agaggcugcugaagcugg

SEQ ID NO: 140970 - RNA, 18 nt, Artificial Sequence
  Description of Artificial Sequence: Synthetic oligonucleotide
gaggaagaggcugcugaa

SEQ ID NO: 140971 - RNA, 18 nt, Artificial Sequence
  Description of Artificial Sequence: Synthetic oligonucleotide
ucguugaggaagaggcug

SEQ ID NO: 140972 - RNA, 18 nt, Artificial Sequence
  Description of Artificial Sequence: Synthetic oligonucleotide
ccuggucguugaggaaga

SEQ ID NO: 140973 - RNA, 18 nt, Artificial Sequence
  Description of Artificial Sequence: Synthetic oligonucleotide
gguaaccuggucguugag

SEQ ID NO: 140974 - RNA, 18 nt, Artificial Sequence
  Description of Artificial Sequence: Synthetic oligonucleotide
agaaggguaaccuggucg

SEQ ID NO: 140975 - RNA, 18 nt, Artificial Sequence
  Description of Artificial Sequence: Synthetic oligonucleotide
acuugagaaggguaaccu

SEQ ID NO: 140976 - RNA, 18 nt, Artificial Sequence
  Description of Artificial Sequence: Synthetic oligonucleotide
gccauacuugagaagggu

SEQ ID NO: 140977 - RNA, 18 nt, Artificial Sequence
  Description of Artificial Sequence: Synthetic oligonucleotide
ugcacgccauacuugaga

SEQ ID NO: 140978 - RNA, 18 nt, Artificial Sequence
  Description of Artificial Sequence: Synthetic oligonucleotide
ccucgugcacgccauacu

SEQ ID NO: 140979 - RNA, 18 nt, Artificial Sequence
  Description of Artificial Sequence: Synthetic oligonucleotide
gauggccucgugcacgcc

SEQ ID NO: 140980 - RNA, 18 nt, Artificial Sequence
  Description of Artificial Sequence: Synthetic oligonucleotide
gcgaagauggccucgugc

SEQ ID NO: 140981 - RNA, 18 nt, Artificial Sequence
  Description of Artificial Sequence: Synthetic oligonucleotide
gcauggcgaagauggccu

SEQ ID NO: 140982 - RNA, 18 nt, Artificial Sequence
  Description of Artificial Sequence: Synthetic oligonucleotide
ggccagcauggcgaagau

SEQ ID NO: 140983 - RNA, 18 nt, Artificial Sequence
  Description of Artificial Sequence: Synthetic oligonucleotide
auagaggccagcauggcg

SEQ ID NO: 140984 - RNA, 18 nt, Artificial Sequence
  Description of Artificial Sequence: Synthetic oligonucleotide
ugacgauagaggccagca

SEQ ID NO: 140985 - RNA, 18 nt, Artificial Sequence
  Description of Artificial Sequence: Synthetic oligonucleotide
cuuguugacgauagaggc

SEQ ID NO: 140986 - RNA, 18 nt, Artificial Sequence
  Description of Artificial Sequence: Synthetic oligonucleotide
ccguccuuguugacgaua

SEQ ID NO: 140987 - RNA, 18 nt, Artificial Sequence
  Description of Artificial Sequence: Synthetic oligonucleotide
gcagcccguccuuguuga

SEQ ID NO: 140988 - RNA, 18 nt, Artificial Sequence
  Description of Artificial Sequence: Synthetic oligonucleotide
uaccagcagcccguccuu

SEQ ID NO: 140989 - RNA, 18 nt, Artificial Sequence
  Description of Artificial Sequence: Synthetic oligonucleotide
uuggcuaccagcagcccg

SEQ ID NO: 140990 - RNA, 18 nt, Artificial Sequence
  Description of Artificial Sequence: Synthetic oligonucleotide
ugccguuggcuaccagca

SEQ ID NO: 140991 - RNA, 18 nt, Artificial Sequence
  Description of Artificial Sequence: Synthetic oligonucleotide
gccacugccguuggcuac

SEQ ID NO: 140992 - RNA, 18 nt, Artificial Sequence
  Description of Artificial Sequence: Synthetic oligonucleotide
acaaagccacugccguug

SEQ ID NO: 140993 - RNA, 18 nt, Artificial Sequence
  Description of Artificial Sequence: Synthetic oligonucleotide
gggugacaaagccacugc

SEQ ID NO: 140994 - RNA, 18 nt, Artificial Sequence
  Description of Artificial Sequence: Synthetic oligonucleotide
cucacgggugacaaagcc

SEQ ID NO: 140995 - RNA, 18 nt, Artificial Sequence
  Description of Artificial Sequence: Synthetic oligonucleotide
aggaacucacgggugaca

SEQ ID NO: 140996 - RNA, 18 nt, Artificial Sequence
  Description of Artificial Sequence: Synthetic oligonucleotide
ugcgcaggaacucacggg

SEQ ID NO: 140997 - RNA, 18 nt, Artificial Sequence
  Description of Artificial Sequence: Synthetic oligonucleotide
gaggcugcgcaggaacuc

SEQ ID NO: 140998 - RNA, 18 nt, Artificial Sequence
  Description of Artificial Sequence: Synthetic oligonucleotide
uugcggaggcugcgcagg

SEQ ID NO: 140999 - RNA, 18 nt, Artificial Sequence
  Description of Artificial Sequence: Synthetic oligonucleotide
aggguuugcggaggcugc

SEQ ID NO: 141000 - RNA, 18 nt, Artificial Sequence
  Description of Artificial Sequence: Synthetic oligonucleotide
acugaaggguuugcggag

SEQ ID NO: 141001 - RNA, 18 nt, Artificial Sequence
  Description of Artificial Sequence: Synthetic oligonucleotide
auaucacugaaggguuug

SEQ ID NO: 141002 - RNA, 18 nt, Artificial Sequence
  Description of Artificial Sequence: Synthetic oligonucleotide
caaugauaucacugaagg

SEQ ID NO: 141003 - RNA, 18 nt, Artificial Sequence
  Description of Artificial Sequence: Synthetic oligonucleotide
aggcucaaugauaucacu

SEQ ID NO: 141004 - RNA, 18 nt, Artificial Sequence
  Description of Artificial Sequence: Synthetic oligonucleotide
aacuuaggcucaaugaua

SEQ ID NO: 141005 - RNA, 18 nt, Artificial Sequence
  Description of Artificial Sequence: Synthetic oligonucleotide
auucaaacuuaggcucaa

SEQ ID NO: 141006 - RNA, 18 nt, Artificial Sequence
  Description of Artificial Sequence: Synthetic oligonucleotide
agcaaauucaaacuuagg

SEQ ID NO: 141007 - RNA, 18 nt, Artificial Sequence
  Description of Artificial Sequence: Synthetic oligonucleotide
uugacagcaaauucaaac

SEQ ID NO: 141008 - RNA, 18 nt, Artificial Sequence
  Description of Artificial Sequence: Synthetic oligonucleotide
ugaacuugacagcaaauu

SEQ ID NO: 141009 - RNA, 18 nt, Artificial Sequence
  Description of Artificial Sequence: Synthetic oligonucleotide
ggcguugaacuugacagc

SEQ ID NO: 141010 - RNA, 18 nt, Artificial Sequence
  Description of Artificial Sequence: Synthetic oligonucleotide
uccagggcguugaacuug

SEQ ID NO: 141011 - RNA, 18 nt, Artificial Sequence
  Description of Artificial Sequence: Synthetic oligonucleotide
caaguuccagggcguuga

SEQ ID NO: 141012 - RNA, 18 nt, Artificial Sequence
  Description of Artificial Sequence: Synthetic oligonucleotide
gucaucaaguuccagggc

SEQ ID NO: 141013 - RNA, 18 nt, Artificial Sequence
  Description of Artificial Sequence: Synthetic oligonucleotide
ucacugucaucaaguucc

SEQ ID NO: 141014 - RNA, 18 nt, Artificial Sequence
  Description of Artificial Sequence: Synthetic oligonucleotide
ccaggucacugucaucaa

SEQ ID NO: 141015 - RNA, 18 nt, Artificial Sequence
  Description of Artificial Sequence: Synthetic oligonucleotide
uagggccaggucacuguc

SEQ ID NO: 141016 - RNA, 18 nt, Artificial Sequence
  Description of Artificial Sequence: Synthetic oligonucleotide
augaauagggccagguca

SEQ ID NO: 141017 - RNA, 18 nt, Artificial Sequence
  Description of Artificial Sequence: Synthetic oligonucleotide
ccgcaaugaauagggcca

SEQ ID NO: 141018 - RNA, 18 nt, Artificial Sequence
  Description of Artificial Sequence: Synthetic oligonucleotide
gauggccgcaaugaauag

SEQ ID NO: 141019 - RNA, 18 nt, Artificial Sequence
  Description of Artificial Sequence: Synthetic oligonucleotide
agaaugauggccgcaaug

SEQ ID NO: 141020 - RNA, 18 nt, Artificial Sequence
  Description of Artificial Sequence: Synthetic oligonucleotide
cacacagaaugauggccg

SEQ ID NO: 141021 - RNA, 18 nt, Artificial Sequence
  Description of Artificial Sequence: Synthetic oligonucleotide
ccaccugccccacucuca

SEQ ID NO: 141022 - RNA, 18 nt, Artificial Sequence
  Description of Artificial Sequence: Synthetic oligonucleotide
ccagcccaccugccccac

SEQ ID NO: 141023 - RNA, 18 nt, Artificial Sequence
  Description of Artificial Sequence: Synthetic oligonucleotide
ccaggccagcccaccugc

SEQ ID NO: 141024 - RNA, 18 nt, Artificial Sequence
  Description of Artificial Sequence: Synthetic oligonucleotide
gugugccaggccagccca

SEQ ID NO: 141025 - RNA, 18 nt, Artificial Sequence
  Description of Artificial Sequence: Synthetic oligonucleotide
acugggugugccaggcca

SEQ ID NO: 141026 - RNA, 18 nt, Artificial Sequence
  Description of Artificial Sequence: Synthetic oligonucleotide
ggacgacugggugugcca

SEQ ID NO: 141027 - RNA, 18 nt, Artificial Sequence
  Description of Artificial Sequence: Synthetic oligonucleotide
ccccaggacgacugggug

SEQ ID NO: 141028 - RNA, 18 nt, Artificial Sequence
  Description of Artificial Sequence: Synthetic oligonucleotide
ccaacccccaggacgacu

SEQ ID NO: 141029 - RNA, 18 nt, Artificial Sequence
  Description of Artificial Sequence: Synthetic oligonucleotide
gagggccaacccccagga

SEQ ID NO: 141030 - RNA, 18 nt, Artificial Sequence
  Description of Artificial Sequence: Synthetic oligonucleotide
gcagugagggccaacccc

SEQ ID NO: 141031 - RNA, 18 nt, Artificial Sequence
  Description of Artificial Sequence: Synthetic oligonucleotide
gcccugcagugagggcca

SEQ ID NO: 141032 - RNA, 18 nt, Artificial Sequence
  Description of Artificial Sequence: Synthetic oligonucleotide
acagugcccugcagugag

SEQ ID NO: 141033 - RNA, 18 nt, Artificial Sequence
  Description of Artificial Sequence: Synthetic oligonucleotide
caggcacagugcccugca

SEQ ID NO: 141034 - RNA, 18 nt, Artificial Sequence
  Description of Artificial Sequence: Synthetic oligonucleotide
gagcucaggcacagugcc

SEQ ID NO: 141035 - RNA, 18 nt, Artificial Sequence
  Description of Artificial Sequence: Synthetic oligonucleotide
ugucagagcucaggcaca

SEQ ID NO: 141036 - RNA, 18 nt, Artificial Sequence
  Description of Artificial Sequence: Synthetic oligonucleotide
cacacugucagagcucag

SEQ ID NO: 141037 - RNA, 18 nt, Artificial Sequence
  Description of Artificial Sequence: Synthetic oligonucleotide
uuccccacacugucagag

SEQ ID NO: 141038 - RNA, 18 nt, Artificial Sequence
  Description of Artificial Sequence: Synthetic oligonucleotide
gacacuuccccacacugu

SEQ ID NO: 141039 - RNA, 18 nt, Artificial Sequence
  Description of Artificial Sequence: Synthetic oligonucleotide
acagggacacuuccccac

SEQ ID NO: 141040 - RNA, 18 nt, Artificial Sequence
  Description of Artificial Sequence: Synthetic oligonucleotide
agaucacagggacacuuc

SEQ ID NO: 141041 - RNA, 18 nt, Artificial Sequence
  Description of Artificial Sequence: Synthetic oligonucleotide
ugccaagaucacagggac

SEQ ID NO: 141042 - RNA, 18 nt, Artificial Sequence
  Description of Artificial Sequence: Synthetic oligonucleotide
uccacugccaagaucaca

SEQ ID NO: 141043 - RNA, 18 nt, Artificial Sequence
  Description of Artificial Sequence: Synthetic oligonucleotide
cauguuccacugccaaga

SEQ ID NO: 141044 - RNA, 18 nt, Artificial Sequence
  Description of Artificial Sequence: Synthetic oligonucleotide
ccuugcauguuccacugc

SEQ ID NO: 141045 - RNA, 18 nt, Artificial Sequence
  Description of Artificial Sequence: Synthetic oligonucleotide
cagugccuugcauguucc

SEQ ID NO: 141046 - RNA, 18 nt, Artificial Sequence
  Description of Artificial Sequence: Synthetic oligonucleotide
ucagucagugccuugcau

SEQ ID NO: 141047 - RNA, 18 nt, Artificial Sequence
  Description of Artificial Sequence: Synthetic oligonucleotide
caugcucagucagugccu

SEQ ID NO: 141048 - RNA, 18 nt, Artificial Sequence
  Description of Artificial Sequence: Synthetic oligonucleotide
uccugcaugcucagucag

SEQ ID NO: 141049 - RNA, 18 nt, Artificial Sequence
  Description of Artificial Sequence: Synthetic oligonucleotide
gcugauccugcaugcuca

SEQ ID NO: 141050 - RNA, 18 nt, Artificial Sequence
  Description of Artificial Sequence: Synthetic oligonucleotide
auggagcugauccugcau

SEQ ID NO: 141051 - RNA, 18 nt, Artificial Sequence
  Description of Artificial Sequence: Synthetic oligonucleotide
augagauggagcugaucc

SEQ ID NO: 141052 - RNA, 18 nt, Artificial Sequence
  Description of Artificial Sequence: Synthetic oligonucleotide
acauaaugagauggagcu

SEQ ID NO: 141053 - RNA, 18 nt, Artificial Sequence
  Description of Artificial Sequence: Synthetic oligonucleotide
uacguacauaaugagaug

SEQ ID NO: 141054 - RNA, 18 nt, Artificial Sequence
  Description of Artificial Sequence: Synthetic oligonucleotide
cuaucuacguacauaaug

SEQ ID NO: 141055 - RNA, 18 nt, Artificial Sequence
  Description of Artificial Sequence: Synthetic oligonucleotide
caccucuaucuacguaca

SEQ ID NO: 141056 - RNA, 18 nt, Artificial Sequence
  Description of Artificial Sequence: Synthetic oligonucleotide
gucuccaccucuaucuac

SEQ ID NO: 141057 - RNA, 18 nt, Artificial Sequence
  Description of Artificial Sequence: Synthetic oligonucleotide
uuccugucuccaccucua

SEQ ID NO: 141058 - RNA, 18 nt, Artificial Sequence
  Description of Artificial Sequence: Synthetic oligonucleotide
ucuuuuuccugucuccac

SEQ ID NO: 141059 - RNA, 18 nt, Artificial Sequence
  Description of Artificial Sequence: Synthetic oligonucleotide
cuuagucuuuuuccuguc

SEQ ID NO: 141060 - RNA, 18 nt, Artificial Sequence
  Description of Artificial Sequence: Synthetic oligonucleotide
ucuggcuuagucuuuuuc

SEQ ID NO: 141061 - RNA, 18 nt, Artificial Sequence
  Description of Artificial Sequence: Synthetic oligonucleotide
ccacgucuggcuuagucu

SEQ ID NO: 141062 - RNA, 18 nt, Artificial Sequence
  Description of Artificial Sequence: Synthetic oligonucleotide
agccaccacgucuggcuu

SEQ ID NO: 141063 - RNA, 18 nt, Artificial Sequence
  Description of Artificial Sequence: Synthetic oligonucleotide
gugugagccaccacgucu

SEQ ID NO: 141064 - RNA, 18 nt, Artificial Sequence
  Description of Artificial Sequence: Synthetic oligonucleotide
uacaggugugagccacca

SEQ ID NO: 141065 - RNA, 18 nt, Artificial Sequence
  Description of Artificial Sequence: Synthetic oligonucleotide
gggauuacaggugugagc

SEQ ID NO: 141066 - RNA, 18 nt, Artificial Sequence
  Description of Artificial Sequence: Synthetic oligonucleotide
gugcugggauuacaggug

SEQ ID NO: 141067 - RNA, 18 nt, Artificial Sequence
  Description of Artificial Sequence: Synthetic oligonucleotide
ccaaagugcugggauuac

SEQ ID NO: 141068 - RNA, 18 nt, Artificial Sequence
  Description of Artificial Sequence: Synthetic oligonucleotide
gccugccaaagugcuggg

SEQ ID NO: 141069 - RNA, 18 nt, Artificial Sequence
  Description of Artificial Sequence: Synthetic oligonucleotide
ccucggccugccaaagug

SEQ ID NO: 141070 - RNA, 18 nt, Artificial Sequence
  Description of Artificial Sequence: Synthetic oligonucleotide
acccgccucggccugcca

SEQ ID NO: 141071 - RNA, 18 nt, Artificial Sequence
  Description of Artificial Sequence: Synthetic oligonucleotide
gauccacccgccucggcc

SEQ ID NO: 141072 - RNA, 18 nt, Artificial Sequence
  Description of Artificial Sequence: Synthetic oligonucleotide
caagugauccacccgccu

SEQ ID NO: 141073 - RNA, 18 nt, Artificial Sequence
  Description of Artificial Sequence: Synthetic oligonucleotide
gaccucaagugauccacc

SEQ ID NO: 141074 - RNA, 18 nt, Artificial Sequence
  Description of Artificial Sequence: Synthetic oligonucleotide
cuccugaccucaagugau

SEQ ID NO: 141075 - RNA, 18 nt, Artificial Sequence
  Description of Artificial Sequence: Synthetic oligonucleotide
ucgaacuccugaccucaa

SEQ ID NO: 141076 - RNA, 18 nt, Artificial Sequence
  Description of Artificial Sequence: Synthetic oligonucleotide
ugguuucgaacuccugac

SEQ ID NO: 141077 - RNA, 18 nt, Artificial Sequence
  Description of Artificial Sequence: Synthetic oligonucleotide
caggcugguuucgaacuc

SEQ ID NO: 141078 - RNA, 18 nt, Artificial Sequence
  Description of Artificial Sequence: Synthetic oligonucleotide
uuggccaggcugguuucg

SEQ ID NO: 141079 - RNA, 18 nt, Artificial Sequence
  Description of Artificial Sequence: Synthetic oligonucleotide
ccauguuggccaggcugg

SEQ ID NO: 141080 - RNA, 18 nt, Artificial Sequence
  Description of Artificial Sequence: Synthetic oligonucleotide
uuucaccauguuggccag

SEQ ID NO: 141081 - RNA, 18 nt, Artificial Sequence
  Description of Artificial Sequence: Synthetic oligonucleotide
ggguuucaccauguuggc

SEQ ID NO: 141082 - RNA, 18 nt, Artificial Sequence
  Description of Artificial Sequence: Synthetic oligonucleotide
auuuuuaguagagacggg

SEQ ID NO: 141083 - RNA, 18 nt, Artificial Sequence
  Description of Artificial Sequence: Synthetic oligonucleotide
uuuguauuuuuaguagag

SEQ ID NO: 141084 - RNA, 18 nt, Artificial Sequence
  Description of Artificial Sequence: Synthetic oligonucleotide
aauuuuuuguauuuuuag

SEQ ID NO: 141085 - RNA, 18 nt, Artificial Sequence
  Description of Artificial Sequence: Synthetic oligonucleotide
uggcuaauuuuuuguauu

SEQ ID NO: 141086 - RNA, 18 nt, Artificial Sequence
  Description of Artificial Sequence: Synthetic oligonucleotide
acaucuggcuaauuuuuu

SEQ ID NO: 141087 - RNA, 18 nt, Artificial Sequence
  Description of Artificial Sequence: Synthetic oligonucleotide
ccaccacaucuggcuaau

SEQ ID NO: 141088 - RNA, 18 nt, Artificial Sequence
  Description of Artificial Sequence: Synthetic oligonucleotide
gcgugccaccacaucugg

SEQ ID NO: 141089 - RNA, 18 nt, Artificial Sequence
  Description of Artificial Sequence: Synthetic oligonucleotide
caggcgcgugccaccaca

SEQ ID NO: 141090 - RNA, 18 nt, Artificial Sequence
  Description of Artificial Sequence: Synthetic oligonucleotide
gauuacaggcgcgugcca

SEQ ID NO: 141091 - RNA, 18 nt, Artificial Sequence
  Description of Artificial Sequence: Synthetic oligonucleotide
gcugggauuacaggcgcg

SEQ ID NO: 141092 - RNA, 18 nt, Artificial Sequence
  Description of Artificial Sequence: Synthetic oligonucleotide
aaguagcugggauuacag

SEQ ID NO: 141093 - RNA, 18 nt, Artificial Sequence
  Description of Artificial Sequence: Synthetic oligonucleotide
cucccaaguagcugggau

SEQ ID NO: 141094 - RNA, 18 nt, Artificial Sequence
  Description of Artificial Sequence: Synthetic oligonucleotide
ucagccucccaaguagcu

SEQ ID NO: 141095 - RNA, 18 nt, Artificial Sequence
  Description of Artificial Sequence: Synthetic oligonucleotide
cuggcucagccucccaag

SEQ ID NO: 141096 - RNA, 18 nt, Artificial Sequence
  Description of Artificial Sequence: Synthetic oligonucleotide
uucuccuggcucagccuc

SEQ ID NO: 141097 - RNA, 18 nt, Artificial Sequence
  Description of Artificial Sequence: Synthetic oligonucleotide
agcgauucuccuggcuca

SEQ ID NO: 141098 - RNA, 18 nt, Artificial Sequence
  Description of Artificial Sequence: Synthetic oligonucleotide
guucaagcgauucuccug

SEQ ID NO: 141099 - RNA, 18 nt, Artificial Sequence
  Description of Artificial Sequence: Synthetic oligonucleotide
cucggguucaagcgauuc

SEQ ID NO: 141100 - RNA, 18 nt, Artificial Sequence
  Description of Artificial Sequence: Synthetic oligonucleotide
caccucucggguucaagc

SEQ ID NO: 141101 - RNA, 18 nt, Artificial Sequence
  Description of Artificial Sequence: Synthetic oligonucleotide
accuccaccucucggguu

SEQ ID NO: 141102 - RNA, 18 nt, Artificial Sequence
  Description of Artificial Sequence: Synthetic oligonucleotide
cugcaaccuccaccucuc

SEQ ID NO: 141103 - RNA, 18 nt, Artificial Sequence
  Description of Artificial Sequence: Synthetic oligonucleotide
gcucacugcaaccuccac

SEQ ID NO: 141104 - RNA, 18 nt, Artificial Sequence
  Description of Artificial Sequence: Synthetic oligonucleotide
uuuuggcucacugcaacc

SEQ ID NO: 141105 - RNA, 18 nt, Artificial Sequence
  Description of Artificial Sequence: Synthetic oligonucleotide
ugggauuuuggcucacug

SEQ ID NO: 141106 - RNA, 18 nt, Artificial Sequence
  Description of Artificial Sequence: Synthetic oligonucleotide
aguggugggauuuuggcu

SEQ ID NO: 141107 - RNA, 18 nt, Artificial Sequence
  Description of Artificial Sequence: Synthetic oligonucleotide
agugcaguggugggauuu

SEQ ID NO: 141108 - RNA, 18 nt, Artificial Sequence
  Description of Artificial Sequence: Synthetic oligonucleotide
gcuggagugcaguggugg

SEQ ID NO: 141109 - RNA, 18 nt, Artificial Sequence
  Description of Artificial Sequence: Synthetic oligonucleotide
cccaggcuggagugcagu

SEQ ID NO: 141110 - RNA, 18 nt, Artificial Sequence
  Description of Artificial Sequence: Synthetic oligonucleotide
ugucacccaggcuggagu

SEQ ID NO: 141111 - RNA, 18 nt, Artificial Sequence
  Description of Artificial Sequence: Synthetic oligonucleotide
cacucugucacccaggcu

SEQ ID NO: 141112 - RNA, 18 nt, Artificial Sequence
  Description of Artificial Sequence: Synthetic oligonucleotide
ggucucacucugucaccc

SEQ ID NO: 141113 - RNA, 18 nt, Artificial Sequence
  Description of Artificial Sequence: Synthetic oligonucleotide
gacagggucucacucugu

SEQ ID NO: 141114 - RNA, 18 nt, Artificial Sequence
  Description of Artificial Sequence: Synthetic oligonucleotide
uuugagacagggucucac

SEQ ID NO: 141115 - RNA, 18 nt, Artificial Sequence
  Description of Artificial Sequence: Synthetic oligonucleotide
uuuuuuuugagacagggu

SEQ ID NO: 141116 - RNA, 18 nt, Artificial Sequence
  Description of Artificial Sequence: Synthetic oligonucleotide
uuuccuuuuuuuugagac

SEQ ID NO: 141117 - RNA, 18 nt, Artificial Sequence
  Description of Artificial Sequence: Synthetic oligonucleotide
guccuuuuccuuuuuuuu

SEQ ID NO: 141118 - RNA, 18 nt, Artificial Sequence
  Description of Artificial Sequence: Synthetic oligonucleotide
uguuaguccuuuuccuuu

SEQ ID NO: 141119 - RNA, 18 nt, Artificial Sequence
  Description of Artificial Sequence: Synthetic oligonucleotide
auuuuuccaccccacauu

SEQ ID NO: 141120 - RNA, 18 nt, Artificial Sequence
  Description of Artificial Sequence: Synthetic oligonucleotide
agacaauuuuuccacccc

SEQ ID NO: 141121 - RNA, 18 nt, Artificial Sequence
  Description of Artificial Sequence: Synthetic oligonucleotide
aaugcagacaauuuuucc

SEQ ID NO: 141122 - RNA, 18 nt, Artificial Sequence
  Description of Artificial Sequence: Synthetic oligonucleotide
gaaaaaaugcagacaauu

SEQ ID NO: 141123 - RNA, 18 nt, Artificial Sequence
  Description of Artificial Sequence: Synthetic oligonucleotide
augcagaaaaaaugcaga

SEQ ID NO: 141124 - RNA, 18 nt, Artificial Sequence
  Description of Artificial Sequence: Synthetic oligonucleotide
uaaaaaugcagaaaaaau

SEQ ID NO: 141125 - RNA, 18 nt, Artificial Sequence
  Description of Artificial Sequence: Synthetic oligonucleotide
aauuuuaaaaaugcagaa

SEQ ID NO: 141126 - RNA, 18 nt, Artificial Sequence
  Description of Artificial Sequence: Synthetic oligonucleotide
guuggaauuuuaaaaaug

SEQ ID NO: 141127 - RNA, 18 nt, Artificial Sequence
  Description of Artificial Sequence: Synthetic oligonucleotide
auuguguuggaauuuuaa

SEQ ID NO: 141128 - RNA, 18 nt, Artificial Sequence
  Description of Artificial Sequence: Synthetic oligonucleotide
uauuuauuguguuggaau

SEQ ID NO: 141129 - RNA, 18 nt, Artificial Sequence
  Description of Artificial Sequence: Synthetic oligonucleotide
uauuguauuuauuguguu

SEQ ID NO: 141130 - RNA, 18 nt, Artificial Sequence
  Description of Artificial Sequence: Synthetic oligonucleotide
guuauuauuguauuuauu

SEQ ID NO: 141131 - RNA, 18 nt, Artificial Sequence
  Description of Artificial Sequence: Synthetic oligonucleotide
gcauaguuauuauuguau

SEQ ID NO: 141132 - RNA, 18 nt, Artificial Sequence
  Description of Artificial Sequence: Synthetic oligonucleotide
aguuagcauaguuauuau

SEQ ID NO: 141133 - RNA, 18 nt, Artificial Sequence
  Description of Artificial Sequence: Synthetic oligonucleotide
cuguuaguuagcauaguu

SEQ ID NO: 141134 - RNA, 18 nt, Artificial Sequence
  Description of Artificial Sequence: Synthetic oligonucleotide
gaccacuguuaguuagca

SEQ ID NO: 141135 - RNA, 18 nt, Artificial Sequence
  Description of Artificial Sequence: Synthetic oligonucleotide
cucuagaccacuguuagu

SEQ ID NO: 141136 - RNA, 18 nt, Artificial Sequence
  Description of Artificial Sequence: Synthetic oligonucleotide
guaagcucuagaccacug

SEQ ID NO: 141137 - RNA, 18 nt, Artificial Sequence
  Description of Artificial Sequence: Synthetic oligonucleotide
augaaguaagcucuagac

SEQ ID NO: 141138 - RNA, 18 nt, Artificial Sequence
  Description of Artificial Sequence: Synthetic oligonucleotide
cuggcaugaaguaagcuc

SEQ ID NO: 141139 - RNA, 18 nt, Artificial Sequence
  Description of Artificial Sequence: Synthetic oligonucleotide
agugccuggcaugaagua

SEQ ID NO: 141140 - RNA, 18 nt, Artificial Sequence
  Description of Artificial Sequence: Synthetic oligonucleotide
agaacagugccuggcaug

SEQ ID NO: 141141 - RNA, 18 nt, Artificial Sequence
  Description of Artificial Sequence: Synthetic oligonucleotide
ugaaaagaacagugccug

SEQ ID NO: 141142 - RNA, 18 nt, Artificial Sequence
  Description of Artificial Sequence: Synthetic oligonucleotide
aucgaugaaaagaacagu

SEQ ID NO: 141143 - RNA, 18 nt, Artificial Sequence
  Description of Artificial Sequence: Synthetic oligonucleotide
ucaucaucgaugaaaaga

SEQ ID NO: 141144 - RNA, 18 nt, Artificial Sequence
  Description of Artificial Sequence: Synthetic oligonucleotide
gugagucaucaucgauga

SEQ ID NO: 141145 - RNA, 18 nt, Artificial Sequence
  Description of Artificial Sequence: Synthetic oligonucleotide
aucaagugagucaucauc

SEQ ID NO: 141146 - RNA, 18 nt, Artificial Sequence
  Description of Artificial Sequence: Synthetic oligonucleotide
ugaggaucaagugaguca

SEQ ID NO: 141147 - RNA, 18 nt, Artificial Sequence
  Description of Artificial Sequence: Synthetic oligonucleotide
uguugugaggaucaagug

SEQ ID NO: 141148 - RNA, 18 nt, Artificial Sequence
  Description of Artificial Sequence: Synthetic oligonucleotide
aggguuguugugaggauc

SEQ ID NO: 141149 - RNA, 18 nt, Artificial Sequence
  Description of Artificial Sequence: Synthetic oligonucleotide
ugcacaggguuguuguga

SEQ ID NO: 141150 - RNA, 18 nt, Artificial Sequence
  Description of Artificial Sequence: Synthetic oligonucleotide
cuuccugcacaggguugu

SEQ ID NO: 141151 - RNA, 18 nt, Artificial Sequence
  Description of Artificial Sequence: Synthetic oligonucleotide
acauucuuccugcacagg

SEQ ID NO: 141152 - RNA, 18 nt, Artificial Sequence
  Description of Artificial Sequence: Synthetic oligonucleotide
acaaaacauucuuccugc

SEQ ID NO: 141153 - RNA, 18 nt, Artificial Sequence
  Description of Artificial Sequence: Synthetic oligonucleotide
gagacacaaaacauucuu

SEQ ID NO: 141154 - RNA, 18 nt, Artificial Sequence
  Description of Artificial Sequence: Synthetic oligonucleotide
aaauggagacacaaaaca

SEQ ID NO: 141155 - RNA, 18 nt, Artificial Sequence
  Description of Artificial Sequence: Synthetic oligonucleotide
guguaaaauggagacaca

SEQ ID NO: 141156 - RNA, 18 nt, Artificial Sequence
  Description of Artificial Sequence: Synthetic oligonucleotide
cugauguguaaaauggag

SEQ ID NO: 141157 - RNA, 18 nt, Artificial Sequence
  Description of Artificial Sequence: Synthetic oligonucleotide
ccucucugauguguaaaa

SEQ ID NO: 141158 - RNA, 18 nt, Artificial Sequence
  Description of Artificial Sequence: Synthetic oligonucleotide
uucagccucucugaugug

SEQ ID NO: 141159 - RNA, 18 nt, Artificial Sequence
  Description of Artificial Sequence: Synthetic oligonucleotide
ggucauucagccucucug

SEQ ID NO: 141160 - RNA, 18 nt, Artificial Sequence
  Description of Artificial Sequence: Synthetic oligonucleotide
aggcaggucauucagccu

SEQ ID NO: 141161 - RNA, 18 nt, Artificial Sequence
  Description of Artificial Sequence: Synthetic oligonucleotide
gcuauaggcaggucauuc

SEQ ID NO: 141162 - RNA, 18 nt, Artificial Sequence
  Description of Artificial Sequence: Synthetic oligonucleotide
gugaggcuauaggcaggu

SEQ ID NO: 141163 - RNA, 18 nt, Artificial Sequence
  Description of Artificial Sequence: Synthetic oligonucleotide
ugccugugaggcuauagg

SEQ ID NO: 141164 - RNA, 18 nt, Artificial Sequence
  Description of Artificial Sequence: Synthetic oligonucleotide
gugucugccugugaggcu

SEQ ID NO: 141165 - RNA, 18 nt, Artificial Sequence
  Description of Artificial Sequence: Synthetic oligonucleotide
auccugugucugccugug

SEQ ID NO: 141166 - RNA, 18 nt, Artificial Sequence
  Description of Artificial Sequence: Synthetic oligonucleotide
uucaaauccugugucugc

SEQ ID NO: 141167 - RNA, 18 nt, Artificial Sequence
  Description of Artificial Sequence: Synthetic oligonucleotide
cuuaauucaaauccugug

SEQ ID NO: 141168 - RNA, 18 nt, Artificial Sequence
  Description of Artificial Sequence: Synthetic oligonucleotide
caaugcuuaauucaaauc

SEQ ID NO: 141169 - RNA, 18 nt, Artificial Sequence
  Description of Artificial Sequence: Synthetic oligonucleotide
agacucaaugcuuaauuc

SEQ ID NO: 141170 - RNA, 18 nt, Artificial Sequence
  Description of Artificial Sequence: Synthetic oligonucleotide
uuaagagacucaaugcuu

SEQ ID NO: 141171 - RNA, 18 nt, Artificial Sequence
  Description of Artificial Sequence: Synthetic oligonucleotide
ugugguuaagagacucaa

SEQ ID NO: 141172 - RNA, 18 nt, Artificial Sequence
  Description of Artificial Sequence: Synthetic oligonucleotide
aguauugugguuaagaga

SEQ ID NO: 141173 - RNA, 18 nt, Artificial Sequence
  Description of Artificial Sequence: Synthetic oligonucleotide
aacguaguauugugguua

SEQ ID NO: 141174 - RNA, 18 nt, Artificial Sequence
  Description of Artificial Sequence: Synthetic oligonucleotide
uaggcaacguaguauugu

SEQ ID NO: 141175 - RNA, 18 nt, Artificial Sequence
  Description of Artificial Sequence: Synthetic oligonucleotide
ccgauuaggcaacguagu

SEQ ID NO: 141176 - RNA, 18 nt, Artificial Sequence
  Description of Artificial Sequence: Synthetic oligonucleotide
cccccccgauuaggcaac

SEQ ID NO: 141177 - RNA, 18 nt, Artificial Sequence
  Description of Artificial Sequence: Synthetic oligonucleotide
caccucccccccgauuag

SEQ ID NO: 141178 - RNA, 18 nt, Artificial Sequence
  Description of Artificial Sequence: Synthetic oligonucleotide
guccccaccucccccccg

SEQ ID NO: 141179 - RNA, 18 nt, Artificial Sequence
  Description of Artificial Sequence: Synthetic oligonucleotide
aauuuguccccaccuccc

SEQ ID NO: 141180 - RNA, 18 nt, Artificial Sequence
  Description of Artificial Sequence: Synthetic oligonucleotide
uugccaauuuguccccac

SEQ ID NO: 141181 - RNA, 18 nt, Artificial Sequence
  Description of Artificial Sequence: Synthetic oligonucleotide
guuuuuugccaauuuguc

SEQ ID NO: 141182 - RNA, 18 nt, Artificial Sequence
  Description of Artificial Sequence: Synthetic oligonucleotide
cuuuuguuuuuugccaau

SEQ ID NO: 141183 - RNA, 18 nt, Artificial Sequence
  Description of Artificial Sequence: Synthetic oligonucleotide
cacuucuuuuguuuuuug

SEQ ID NO: 141184 - RNA, 18 nt, Artificial Sequence
  Description of Artificial Sequence: Synthetic oligonucleotide
uaauccacuucuuuuguu

SEQ ID NO: 141185 - RNA, 18 nt, Artificial Sequence
  Description of Artificial Sequence: Synthetic oligonucleotide
ggucuuaauccacuucuu

SEQ ID NO: 141186 - RNA, 18 nt, Artificial Sequence
  Description of Artificial Sequence: Synthetic oligonucleotide
ccccuggucuuaauccac

SEQ ID NO: 141187 - RNA, 18 nt, Artificial Sequence
  Description of Artificial Sequence: Synthetic oligonucleotide
cccuaccccuggucuuaa

SEQ ID NO: 141188 - RNA, 18 nt, Artificial Sequence
  Description of Artificial Sequence: Synthetic oligonucleotide
aaucucccuaccccuggu

SEQ ID NO: 141189 - RNA, 18 nt, Artificial Sequence
  Description of Artificial Sequence: Synthetic oligonucleotide
guucuaaucucccuaccc

SEQ ID NO: 141190 - RNA, 18 nt, Artificial Sequence
  Description of Artificial Sequence: Synthetic oligonucleotide
uggguguucuaaucuccc

SEQ ID NO: 141191 - RNA, 18 nt, Artificial Sequence
  Description of Artificial Sequence: Synthetic oligonucleotide
uccacuggguguucuaau

SEQ ID NO: 141192 - RNA, 18 nt, Artificial Sequence
  Description of Artificial Sequence: Synthetic oligonucleotide
aaugcuccacuggguguu

SEQ ID NO: 141193 - RNA, 18 nt, Artificial Sequence
  Description of Artificial Sequence: Synthetic oligonucleotide
ucagcaaugcuccacugg

SEQ ID NO: 141194 - RNA, 18 nt, Artificial Sequence
  Description of Artificial Sequence: Synthetic oligonucleotide
ucccaucagcaaugcucc

SEQ ID NO: 141195 - RNA, 18 nt, Artificial Sequence
  Description of Artificial Sequence: Synthetic oligonucleotide
cccugucccaucagcaau

SEQ ID NO: 141196 - RNA, 18 nt, Artificial Sequence
  Description of Artificial Sequence: Synthetic oligonucleotide
ccaagcccugucccauca

SEQ ID NO: 141197 - RNA, 18 nt, Artificial Sequence
  Description of Artificial Sequence: Synthetic oligonucleotide
acagaccaagcccugucc

SEQ ID NO: 141198 - RNA, 18 nt, Artificial Sequence
  Description of Artificial Sequence: Synthetic oligonucleotide
ccgugacagaccaagccc

SEQ ID NO: 141199 - RNA, 18 nt, Artificial Sequence
  Description of Artificial Sequence: Synthetic oligonucleotide
cuuggccgugacagacca

SEQ ID NO: 141200 - RNA, 18 nt, Artificial Sequence
  Description of Artificial Sequence: Synthetic oligonucleotide
gccuccuuggccgugaca

SEQ ID NO: 141201 - RNA, 18 nt, Artificial Sequence
  Description of Artificial Sequence: Synthetic oligonucleotide
ggcaggccuccuuggccg

SEQ ID NO: 141202 - RNA, 18 nt, Artificial Sequence
  Description of Artificial Sequence: Synthetic oligonucleotide
gggacggcaggccuccuu

SEQ ID NO: 141203 - RNA, 18 nt, Artificial Sequence
  Description of Artificial Sequence: Synthetic oligonucleotide
aggugacuuggcccaggg

SEQ ID NO: 141204 - RNA, 18 nt, Artificial Sequence
  Description of Artificial Sequence: Synthetic oligonucleotide
agaggugacuuggcccag

SEQ ID NO: 141205 - RNA, 18 nt, Artificial Sequence
  Description of Artificial Sequence: Synthetic oligonucleotide
ccccaagaggugacuugg

SEQ ID NO: 141206 - RNA, 18 nt, Artificial Sequence
  Description of Artificial Sequence: Synthetic oligonucleotide
uuccaccccaagagguga

SEQ ID NO: 141207 - RNA, 18 nt, Artificial Sequence
  Description of Artificial Sequence: Synthetic oligonucleotide
ccuacuuccaccccaaga

SEQ ID NO: 141208 - RNA, 18 nt, Artificial Sequence
  Description of Artificial Sequence: Synthetic oligonucleotide
gcuccccuacuuccaccc

SEQ ID NO: 141209 - RNA, 18 nt, Artificial Sequence
  Description of Artificial Sequence: Synthetic oligonucleotide
guggagcuccccuacuuc

SEQ ID NO: 141210 - RNA, 18 nt, Artificial Sequence
  Description of Artificial Sequence: Synthetic oligonucleotide
aggcaguggagcuccccu

SEQ ID NO: 141211 - RNA, 18 nt, Artificial Sequence
  Description of Artificial Sequence: Synthetic oligonucleotide
cagaaaggcaguggagcu

SEQ ID NO: 141212 - RNA, 18 nt, Artificial Sequence
  Description of Artificial Sequence: Synthetic oligonucleotide
gagcucagaaaggcagug

SEQ ID NO: 141213 - RNA, 18 nt, Artificial Sequence
  Description of Artificial Sequence: Synthetic oligonucleotide
ccagggagcucagaaagg

SEQ ID NO: 141214 - RNA, 18 nt, Artificial Sequence
  Description of Artificial Sequence: Synthetic oligonucleotide
gcacgccagggagcucag

SEQ ID NO: 141215 - RNA, 18 nt, Artificial Sequence
  Description of Artificial Sequence: Synthetic oligonucleotide
uucaugaggccuggccgg

SEQ ID NO: 141216 - RNA, 18 nt, Artificial Sequence
  Description of Artificial Sequence: Synthetic oligonucleotide
gaacguucaugaggccug

SEQ ID NO: 141217 - RNA, 18 nt, Artificial Sequence
  Description of Artificial Sequence: Synthetic oligonucleotide
ccguggaacguucaugag

SEQ ID NO: 141218 - RNA, 18 nt, Artificial Sequence
  Description of Artificial Sequence: Synthetic oligonucleotide
uccacccguggaacguuc

SEQ ID NO: 141219 - RNA, 18 nt, Artificial Sequence
  Description of Artificial Sequence: Synthetic oligonucleotide
uagccuccacccguggaa

SEQ ID NO: 141220 - RNA, 18 nt, Artificial Sequence
  Description of Artificial Sequence: Synthetic oligonucleotide
cuggauagccuccacccg

SEQ ID NO: 141221 - RNA, 18 nt, Artificial Sequence
  Description of Artificial Sequence: Synthetic oligonucleotide
guguccuggauagccucc

SEQ ID NO: 141222 - RNA, 18 nt, Artificial Sequence
  Description of Artificial Sequence: Synthetic oligonucleotide
ggaugguguccuggauag

SEQ ID NO: 141223 - RNA, 18 nt, Artificial Sequence
  Description of Artificial Sequence: Synthetic oligonucleotide
acgcaggaugguguccug

SEQ ID NO: 141224 - RNA, 18 nt, Artificial Sequence
  Description of Artificial Sequence: Synthetic oligonucleotide
agggcacgcaggauggug

SEQ ID NO: 141225 - RNA, 18 nt, Artificial Sequence
  Description of Artificial Sequence: Synthetic oligonucleotide
auucgagggcacgcagga

SEQ ID NO: 141226 - RNA, 18 nt, Artificial Sequence
  Description of Artificial Sequence: Synthetic oligonucleotide
guggaauucgagggcacg

SEQ ID NO: 141227 - RNA, 18 nt, Artificial Sequence
  Description of Artificial Sequence: Synthetic oligonucleotide
ugcagguggaauucgagg

SEQ ID NO: 141228 - RNA, 18 nt, Artificial Sequence
  Description of Artificial Sequence: Synthetic oligonucleotide
uggccugcagguggaauu

SEQ ID NO: 141229 - RNA, 18 nt, Artificial Sequence
  Description of Artificial Sequence: Synthetic oligonucleotide
gugguuggccugcaggug

SEQ ID NO: 141230 - RNA, 18 nt, Artificial Sequence
  Description of Artificial Sequence: Synthetic oligonucleotide
ucagggugguuggccugc

SEQ ID NO: 141231 - RNA, 18 nt, Artificial Sequence
  Description of Artificial Sequence: Synthetic oligonucleotide
gggcaucagggugguugg

SEQ ID NO: 141232 - RNA, 18 nt, Artificial Sequence
  Description of Artificial Sequence: Synthetic oligonucleotide
guacugggcaucagggug

SEQ ID NO: 141233 - RNA, 18 nt, Artificial Sequence
  Description of Artificial Sequence: Synthetic oligonucleotide
aagagguacugggcauca

SEQ ID NO: 141234 - RNA, 18 nt, Artificial Sequence
  Description of Artificial Sequence: Synthetic oligonucleotide
gggaagagguacugggca

SEQ ID NO: 141235 - RNA, 18 nt, Artificial Sequence
  Description of Artificial Sequence: Synthetic oligonucleotide
cuucugcagcagcuuggg

SEQ ID NO: 141236 - RNA, 18 nt, Artificial Sequence
  Description of Artificial Sequence: Synthetic oligonucleotide
gccaucuucugcagcagc

SEQ ID NO: 141237 - RNA, 18 nt, Artificial Sequence
  Description of Artificial Sequence: Synthetic oligonucleotide
ggucagccaucuucugca

SEQ ID NO: 141238 - RNA, 18 nt, Artificial Sequence
  Description of Artificial Sequence: Synthetic oligonucleotide
ccgcaggucagccaucuu

SEQ ID NO: 141239 - RNA, 18 nt, Artificial Sequence
  Description of Artificial Sequence: Synthetic oligonucleotide
aguugccgcaggucagcc

SEQ ID NO: 141240 - RNA, 18 nt, Artificial Sequence
  Description of Artificial Sequence: Synthetic oligonucleotide
ugaccaguugccgcaggu

SEQ ID NO: 141241 - RNA, 18 nt, Artificial Sequence
  Description of Artificial Sequence: Synthetic oligonucleotide
cucggugaccaguugccg

SEQ ID NO: 141242 - RNA, 18 nt, Artificial Sequence
  Description of Artificial Sequence: Synthetic oligonucleotide
gcgugcucggugaccagu

SEQ ID NO: 141243 - RNA, 18 nt, Artificial Sequence
  Description of Artificial Sequence: Synthetic oligonucleotide
ucugggcgugcucgguga

SEQ ID NO: 141244 - RNA, 18 nt, Artificial Sequence
  Description of Artificial Sequence: Synthetic oligonucleotide
caucaucugggcgugcuc

SEQ ID NO: 141245 - RNA, 18 nt, Artificial Sequence
  Description of Artificial Sequence: Synthetic oligonucleotide
cgcugcaucaucugggcg

SEQ ID NO: 141246 - RNA, 18 nt, Artificial Sequence
  Description of Artificial Sequence: Synthetic oligonucleotide
ugauccgcugcaucaucu

SEQ ID NO: 141247 - RNA, 18 nt, Artificial Sequence
  Description of Artificial Sequence: Synthetic oligonucleotide
cuucuugauccgcugcau

SEQ ID NO: 141248 - RNA, 18 nt, Artificial Sequence
  Description of Artificial Sequence: Synthetic oligonucleotide
ucggucuucuugauccgc

SEQ ID NO: 141249 - RNA, 18 nt, Artificial Sequence
  Description of Artificial Sequence: Synthetic oligonucleotide
cgguuucggucuucuuga

SEQ ID NO: 141250 - RNA, 18 nt, Artificial Sequence
  Description of Artificial Sequence: Synthetic oligonucleotide
ggucucgguuucggucuu

SEQ ID NO: 141251 - RNA, 18 nt, Artificial Sequence
  Description of Artificial Sequence: Synthetic oligonucleotide
agcgaggucucgguuucg

SEQ ID NO: 141252 - RNA, 18 nt, Artificial Sequence
  Description of Artificial Sequence: Synthetic oligonucleotide
ggugcagcgaggucucgg

SEQ ID NO: 141253 - RNA, 18 nt, Artificial Sequence
  Description of Artificial Sequence: Synthetic oligonucleotide
cagagggugcagcgaggu

SEQ ID NO: 141254 - RNA, 18 nt, Artificial Sequence
  Description of Artificial Sequence: Synthetic oligonucleotide
uggagcagagggugcagc

SEQ ID NO: 141255 - RNA, 18 nt, Artificial Sequence
  Description of Artificial Sequence: Synthetic oligonucleotide
ucuccuggagcagagggu

SEQ ID NO: 141256 - RNA, 18 nt, Artificial Sequence
  Description of Artificial Sequence: Synthetic oligonucleotide
guagaucuccuggagcag

SEQ ID NO: 141257 - RNA, 18 nt, Artificial Sequence
  Description of Artificial Sequence: Synthetic oligonucleotide
uccuuguagaucuccugg

SEQ ID NO: 141258 - RNA, 18 nt, Artificial Sequence
  Description of Artificial Sequence: Synthetic oligonucleotide
acauguccuuguagaucu

SEQ ID NO: 141259 - RNA, 18 nt, Artificial Sequence
  Description of Artificial Sequence: Synthetic oligonucleotide
uuaguacauguccuugua

SEQ ID NO: 141260 - RNA, 18 nt, Artificial Sequence
  Description of Artificial Sequence: Synthetic oligonucleotide
cgccguuaguacaugucc

SEQ ID NO: 141261 - RNA, 18 nt, Artificial Sequence
  Description of Artificial Sequence: Synthetic oligonucleotide
ggugccgccguuaguaca

SEQ ID NO: 141262 - RNA, 18 nt, Artificial Sequence
  Description of Artificial Sequence: Synthetic oligonucleotide
gccugggugccgccguua

SEQ ID NO: 141263 - RNA, 18 nt, Artificial Sequence
  Description of Artificial Sequence: Synthetic oligonucleotide
gggaggccugggugccgc

SEQ ID NO: 141264 - RNA, 18 nt, Artificial Sequence
  Description of Artificial Sequence: Synthetic oligonucleotide
cugcagggaggccugggu

SEQ ID NO: 141265 - RNA, 18 nt, Artificial Sequence
  Description of Artificial Sequence: Synthetic oligonucleotide
ggagucugcagggaggcc

SEQ ID NO: 141266 - RNA, 18 nt, Artificial Sequence
  Description of Artificial Sequence: Synthetic oligonucleotide
ccauuggagucugcaggg

SEQ ID NO: 141267 - RNA, 18 nt, Artificial Sequence
  Description of Artificial Sequence: Synthetic oligonucleotide
uggccccauuggagucug

SEQ ID NO: 141268 - RNA, 18 nt, Artificial Sequence
  Description of Artificial Sequence: Synthetic oligonucleotide
agugcuggccccauugga

SEQ ID NO: 141269 - RNA, 18 nt, Artificial Sequence
  Description of Artificial Sequence: Synthetic oligonucleotide
ccuccagugcuggcccca

SEQ ID NO: 141270 - RNA, 18 nt, Artificial Sequence
  Description of Artificial Sequence: Synthetic oligonucleotide
gggccccuccagugcugg

SEQ ID NO: 141271 - RNA, 18 nt, Artificial Sequence
  Description of Artificial Sequence: Synthetic oligonucleotide
ugggugggccccuccagu

SEQ ID NO: 141272 - RNA, 18 nt, Artificial Sequence
  Description of Artificial Sequence: Synthetic oligonucleotide
ucaugugggugggccccu

SEQ ID NO: 141273 - RNA, 18 nt, Artificial Sequence
  Description of Artificial Sequence: Synthetic oligonucleotide
aaaagucauguggguggg

SEQ ID NO: 141274 - RNA, 18 nt, Artificial Sequence
  Description of Artificial Sequence: Synthetic oligonucleotide
aauggaaaagucaugugg

SEQ ID NO: 141275 - RNA, 18 nt, Artificial Sequence
  Description of Artificial Sequence: Synthetic oligonucleotide
uggucaauggaaaaguca

SEQ ID NO: 141276 - RNA, 18 nt, Artificial Sequence
  Description of Artificial Sequence: Synthetic oligonucleotide
agggcuggucaauggaaa

SEQ ID NO: 141277 - RNA, 18 nt, Artificial Sequence
  Description of Artificial Sequence: Synthetic oligonucleotide
gcucaagggcuggucaau

SEQ ID NO: 141278 - RNA, 18 nt, Artificial Sequence
  Description of Artificial Sequence: Synthetic oligonucleotide
cgggugcucaagggcugg

SEQ ID NO: 141279 - RNA, 18 nt, Artificial Sequence
  Description of Artificial Sequence: Synthetic oligonucleotide
caggccgggugcucaagg

SEQ ID NO: 141280 - RNA, 18 nt, Artificial Sequence
  Description of Artificial Sequence: Synthetic oligonucleotide
ugcuccaggccgggugcu

SEQ ID NO: 141281 - RNA, 18 nt, Artificial Sequence
  Description of Artificial Sequence: Synthetic oligonucleotide
ucugcugcuccaggccgg

SEQ ID NO: 141282 - RNA, 18 nt, Artificial Sequence
  Description of Artificial Sequence: Synthetic oligonucleotide
gggacucugcugcuccag

SEQ ID NO: 141283 - RNA, 18 nt, Artificial Sequence
  Description of Artificial Sequence: Synthetic oligonucleotide
aucgugggacucugcugc

SEQ ID NO: 141284 - RNA, 18 nt, Artificial Sequence
  Description of Artificial Sequence: Synthetic oligonucleotide
gggcgaucgugggacucu

SEQ ID NO: 141285 - RNA, 18 nt, Artificial Sequence
  Description of Artificial Sequence: Synthetic oligonucleotide
ucugagggcgaucguggg

SEQ ID NO: 141286 - RNA, 18 nt, Artificial Sequence
  Description of Artificial Sequence: Synthetic oligonucleotide
augugucugagggcgauc

SEQ ID NO: 141287 - RNA, 18 nt, Artificial Sequence
  Description of Artificial Sequence: Synthetic oligonucleotide
gugucaugugucugaggg

SEQ ID NO: 141288 - RNA, 18 nt, Artificial Sequence
  Description of Artificial Sequence: Synthetic oligonucleotide
cgugggugucaugugucu

SEQ ID NO: 141289 - RNA, 18 nt, Artificial Sequence
  Description of Artificial Sequence: Synthetic oligonucleotide
gaggccgugggugucaug

SEQ ID NO: 141290 - RNA, 18 nt, Artificial Sequence
  Description of Artificial Sequence: Synthetic oligonucleotide
agccagaggccgugggug

SEQ ID NO: 141291 - RNA, 18 nt, Artificial Sequence
  Description of Artificial Sequence: Synthetic oligonucleotide
cagggagccagaggccgu

SEQ ID NO: 141292 - RNA, 18 nt, Artificial Sequence
  Description of Artificial Sequence: Synthetic oligonucleotide
gggcacagggagccagag

SEQ ID NO: 141293 - RNA, 18 nt, Artificial Sequence
  Description of Artificial Sequence: Synthetic oligonucleotide
agagagggcacagggagc

SEQ ID NO: 141294 - RNA, 18 nt, Artificial Sequence
  Description of Artificial Sequence: Synthetic oligonucleotide
gcgggagagagggcacag

SEQ ID NO: 141295 - RNA, 18 nt, Artificial Sequence
  Description of Artificial Sequence: Synthetic oligonucleotide
aggaagcgggagagaggg

SEQ ID NO: 141296 - RNA, 18 nt, Artificial Sequence
  Description of Artificial Sequence: Synthetic oligonucleotide
gcuggaggaagcgggaga

SEQ ID NO: 141297 - RNA, 18 nt, Artificial Sequence
  Description of Artificial Sequence: Synthetic oligonucleotide
agcuggcuggaggaagcg

SEQ ID NO: 141298 - RNA, 18 nt, Artificial Sequence
  Description of Artificial Sequence: Synthetic oligonucleotide
aagagagcuggcuggagg

SEQ ID NO: 141299 - RNA, 18 nt, Artificial Sequence
  Description of Artificial Sequence: Synthetic oligonucleotide
acaggaagagagcuggcu

SEQ ID NO: 141300 - RNA, 18 nt, Artificial Sequence
  Description of Artificial Sequence: Synthetic oligonucleotide
caaagacaggaagagagc

SEQ ID NO: 141301 - RNA, 18 nt, Artificial Sequence
  Description of Artificial Sequence: Synthetic oligonucleotide
gacaacaaagacaggaag

SEQ ID NO: 141302 - RNA, 18 nt, Artificial Sequence
  Description of Artificial Sequence: Synthetic oligonucleotide
agggagacaacaaagaca

SEQ ID NO: 141303 - RNA, 18 nt, Artificial Sequence
  Description of Artificial Sequence: Synthetic oligonucleotide
gaaagagggagacaacaa

SEQ ID NO: 141304 - RNA, 18 nt, Artificial Sequence
  Description of Artificial Sequence: Synthetic oligonucleotide
acugagaaagagggagac

SEQ ID NO: 141305 - RNA, 18 nt, Artificial Sequence
  Description of Artificial Sequence: Synthetic oligonucleotide
gaggaacugagaaagagg

SEQ ID NO: 141306 - RNA, 18 nt, Artificial Sequence
  Description of Artificial Sequence: Synthetic oligonucleotide
agaaagaggaacugagaa

SEQ ID NO: 141307 - RNA, 18 nt, Artificial Sequence
  Description of Artificial Sequence: Synthetic oligonucleotide
agaaaagaaagaggaacu

SEQ ID NO: 141308 - RNA, 18 nt, Artificial Sequence
  Description of Artificial Sequence: Synthetic oligonucleotide
gaauuagaaaagaaagag

SEQ ID NO: 141309 - RNA, 18 nt, Artificial Sequence
  Description of Artificial Sequence: Synthetic oligonucleotide
aacaggaauuagaaaaga

SEQ ID NO: 141310 - RNA, 18 nt, Artificial Sequence
  Description of Artificial Sequence: Synthetic oligonucleotide
agagcaacaggaauuaga

SEQ ID NO: 141311 - RNA, 18 nt, Artificial Sequence
  Description of Artificial Sequence: Synthetic oligonucleotide
gaaacagagcaacaggaa

SEQ ID NO: 141312 - RNA, 18 nt, Artificial Sequence
  Description of Artificial Sequence: Synthetic oligonucleotide
aggaagaaacagagcaac

SEQ ID NO: 141313 - RNA, 18 nt, Artificial Sequence
  Description of Artificial Sequence: Synthetic oligonucleotide
cagaaaggaagaaacaga

SEQ ID NO: 141314 - RNA, 18 nt, Artificial Sequence
  Description of Artificial Sequence: Synthetic oligonucleotide
accuacagaaaggaagaa

SEQ ID NO: 141315 - RNA, 18 nt, Artificial Sequence
  Description of Artificial Sequence: Synthetic oligonucleotide
gagaaaccuacagaaagg

SEQ ID NO: 141316 - RNA, 18 nt, Artificial Sequence
  Description of Artificial Sequence: Synthetic oligonucleotide
gaagagagaaaccuacag

SEQ ID NO: 141317 - RNA, 18 nt, Artificial Sequence
  Description of Artificial Sequence: Synthetic oligonucleotide
gaagggaagagagaaacc

SEQ ID NO: 141318 - RNA, 18 nt, Artificial Sequence
  Description of Artificial Sequence: Synthetic oligonucleotide
agggagaagggaagagag

SEQ ID NO: 141319 - RNA, 18 nt, Artificial Sequence
  Description of Artificial Sequence: Synthetic oligonucleotide
gggcaagggagaagggaa

SEQ ID NO: 141320 - RNA, 18 nt, Artificial Sequence
  Description of Artificial Sequence: Synthetic oligonucleotide
agggagggcaagggagaa

SEQ ID NO: 141321 - RNA, 18 nt, Artificial Sequence
  Description of Artificial Sequence: Synthetic oligonucleotide
gagaaagggagggcaagg

SEQ ID NO: 141322 - RNA, 18 nt, Artificial Sequence
  Description of Artificial Sequence: Synthetic oligonucleotide
ggagagagaaagggaggg

SEQ ID NO: 141323 - RNA, 18 nt, Artificial Sequence
  Description of Artificial Sequence: Synthetic oligonucleotide
ggguggagagagaaaggg

SEQ ID NO: 141324 - RNA, 18 nt, Artificial Sequence
  Description of Artificial Sequence: Synthetic oligonucleotide
aaggaggacagacguggg

SEQ ID NO: 141325 - RNA, 18 nt, Artificial Sequence
  Description of Artificial Sequence: Synthetic oligonucleotide
uaagaaaggaggacagac

SEQ ID NO: 141326 - RNA, 18 nt, Artificial Sequence
  Description of Artificial Sequence: Synthetic oligonucleotide
cagaauaagaaaggagga

SEQ ID NO: 141327 - RNA, 18 nt, Artificial Sequence
  Description of Artificial Sequence: Synthetic oligonucleotide
ucucacagaauaagaaag

SEQ ID NO: 141328 - RNA, 18 nt, Artificial Sequence
  Description of Artificial Sequence: Synthetic oligonucleotide
aaacaucucacagaauaa

SEQ ID NO: 141329 - RNA, 18 nt, Artificial Sequence
  Description of Artificial Sequence: Synthetic oligonucleotide
auacaaaacaucucacag

SEQ ID NO: 141330 - RNA, 18 nt, Artificial Sequence
  Description of Artificial Sequence: Synthetic oligonucleotide
aaauaauacaaaacaucu

SEQ ID NO: 141331 - RNA, 18 nt, Artificial Sequence
  Description of Artificial Sequence: Synthetic oligonucleotide
uggugaaauaauacaaaa

SEQ ID NO: 141332 - RNA, 18 nt, Artificial Sequence
  Description of Artificial Sequence: Synthetic oligonucleotide
gcugcuggugaaauaaua

SEQ ID NO: 141333 - RNA, 18 nt, Artificial Sequence
  Description of Artificial Sequence: Synthetic oligonucleotide
ucuaugcugcuggugaaa

SEQ ID NO: 141334 - RNA, 18 nt, Artificial Sequence
  Description of Artificial Sequence: Synthetic oligonucleotide
ccuguucuaugcugcugg

SEQ ID NO: 141335 - RNA, 18 nt, Artificial Sequence
  Description of Artificial Sequence: Synthetic oligonucleotide
gagguccuguucuaugcu

SEQ ID NO: 141336 - RNA, 18 nt, Artificial Sequence
  Description of Artificial Sequence: Synthetic oligonucleotide
aagcagagguccuguucu

SEQ ID NO: 141337 - RNA, 18 nt, Artificial Sequence
  Description of Artificial Sequence: Synthetic oligonucleotide
ugcaaaagcagagguccu

SEQ ID NO: 141338 - RNA, 18 nt, Artificial Sequence
  Description of Artificial Sequence: Synthetic oligonucleotide
aggugugcaaaagcagag

SEQ ID NO: 141339 - RNA, 18 nt, Artificial Sequence
  Description of Artificial Sequence: Synthetic oligonucleotide
ggaaaaggugugcaaaag

SEQ ID NO: 141340 - RNA, 18 nt, Artificial Sequence
  Description of Artificial Sequence: Synthetic oligonucleotide
gggaaaaggugugcaaaa

SEQ ID NO: 141341 - RNA, 18 nt, Artificial Sequence
  Description of Artificial Sequence: Synthetic oligonucleotide
cucucuucugcuccuggg

SEQ ID NO: 141342 - RNA, 18 nt, Artificial Sequence
  Description of Artificial Sequence: Synthetic oligonucleotide
ccccacucucuucugcuc

SEQ ID NO: 141343 - RNA, 18 nt, Artificial Sequence
  Description of Artificial Sequence: Synthetic oligonucleotide
gcaggccccacucucuuc

SEQ ID NO: 141344 - RNA, 18 nt, Artificial Sequence
  Description of Artificial Sequence: Synthetic oligonucleotide
agagggcaggccccacuc

SEQ ID NO: 141345 - RNA, 18 nt, Artificial Sequence
  Description of Artificial Sequence: Synthetic oligonucleotide
gggcagagggcaggcccc

SEQ ID NO: 141346 - RNA, 18 nt, Artificial Sequence
  Description of Artificial Sequence: Synthetic oligonucleotide
ugcaggugcaaugauggg

SEQ ID NO: 141347 - RNA, 18 nt, Artificial Sequence
  Description of Artificial Sequence: Synthetic oligonucleotide
aagccugcaggugcaaug

SEQ ID NO: 141348 - RNA, 18 nt, Artificial Sequence
  Description of Artificial Sequence: Synthetic oligonucleotide
gaccuaagccugcaggug

SEQ ID NO: 141349 - RNA, 18 nt, Artificial Sequence
  Description of Artificial Sequence: Synthetic oligonucleotide
gugaggaccuaagccugc

SEQ ID NO: 141350 - RNA, 18 nt, Artificial Sequence
  Description of Artificial Sequence: Synthetic oligonucleotide
cagaagugaggaccuaag

SEQ ID NO: 141351 - RNA, 18 nt, Artificial Sequence
  Description of Artificial Sequence: Synthetic oligonucleotide
ggagacagaagugaggac

SEQ ID NO: 141352 - RNA, 18 nt, Artificial Sequence
  Description of Artificial Sequence: Synthetic oligonucleotide
agacaggagacagaagug

SEQ ID NO: 141353 - RNA, 18 nt, Artificial Sequence
  Description of Artificial Sequence: Synthetic oligonucleotide
ucugaagacaggagacag

SEQ ID NO: 141354 - RNA, 18 nt, Artificial Sequence
  Description of Artificial Sequence: Synthetic oligonucleotide
uuugcucugaagacagga

SEQ ID NO: 141355 - RNA, 18 nt, Artificial Sequence
  Description of Artificial Sequence: Synthetic oligonucleotide
agucuuuugcucugaaga

SEQ ID NO: 141356 - RNA, 18 nt, Artificial Sequence
  Description of Artificial Sequence: Synthetic oligonucleotide
gcucaagucuuuugcucu

SEQ ID NO: 141357 - RNA, 18 nt, Artificial Sequence
  Description of Artificial Sequence: Synthetic oligonucleotide
ggauggcucaagucuuuu

SEQ ID NO: 141358 - RNA, 18 nt, Artificial Sequence
  Description of Artificial Sequence: Synthetic oligonucleotide
ucuuuggauggcucaagu

SEQ ID NO: 141359 - RNA, 18 nt, Artificial Sequence
  Description of Artificial Sequence: Synthetic oligonucleotide
guguuucuuuggauggcu

SEQ ID NO: 141360 - RNA, 18 nt, Artificial Sequence
  Description of Artificial Sequence: Synthetic oligonucleotide
gcuuaguguuucuuugga

SEQ ID NO: 141361 - RNA, 18 nt, Artificial Sequence
  Description of Artificial Sequence: Synthetic oligonucleotide
agagagcuuaguguuucu

SEQ ID NO: 141362 - RNA, 18 nt, Artificial Sequence
  Description of Artificial Sequence: Synthetic oligonucleotide
ggcccagagagcuuagug

SEQ ID NO: 141363 - RNA, 18 nt, Artificial Sequence
  Description of Artificial Sequence: Synthetic oligonucleotide
acccaggcccagagagcu

SEQ ID NO: 141364 - RNA, 18 nt, Artificial Sequence
  Description of Artificial Sequence: Synthetic oligonucleotide
cuggaacccaggcccaga

SEQ ID NO: 141365 - RNA, 18 nt, Artificial Sequence
  Description of Artificial Sequence: Synthetic oligonucleotide
cuucccuggaacccaggc

SEQ ID NO: 141366 - RNA, 18 nt, Artificial Sequence
  Description of Artificial Sequence: Synthetic oligonucleotide
uuagccuucccuggaacc

SEQ ID NO: 141367 - RNA, 18 nt, Artificial Sequence
  Description of Artificial Sequence: Synthetic oligonucleotide
caugcuuagccuucccug

SEQ ID NO: 141368 - RNA, 18 nt, Artificial Sequence
  Description of Artificial Sequence: Synthetic oligonucleotide
caggccaugcuuagccuu

SEQ ID NO: 141369 - RNA, 18 nt, Artificial Sequence
  Description of Artificial Sequence: Synthetic oligonucleotide
caguccaggccaugcuua

SEQ ID NO: 141370 - RNA, 18 nt, Artificial Sequence
  Description of Artificial Sequence: Synthetic oligonucleotide
gcagucaguccaggccau

SEQ ID NO: 141371 - RNA, 18 nt, Artificial Sequence
  Description of Artificial Sequence: Synthetic oligonucleotide
gggcugcagucaguccag

SEQ ID NO: 141372 - RNA, 18 nt, Artificial Sequence
  Description of Artificial Sequence: Synthetic oligonucleotide
agggaccccaugacuaua

SEQ ID NO: 141373 - RNA, 18 nt, Artificial Sequence
  Description of Artificial Sequence: Synthetic oligonucleotide
gcagcagggaccccauga

SEQ ID NO: 141374 - RNA, 18 nt, Artificial Sequence
  Description of Artificial Sequence: Synthetic oligonucleotide
ccuuugcagcagggaccc

SEQ ID NO: 141375 - RNA, 18 nt, Artificial Sequence
  Description of Artificial Sequence: Synthetic oligonucleotide
acuguccuuugcagcagg

SEQ ID NO: 141376 - RNA, 18 nt, Artificial Sequence
  Description of Artificial Sequence: Synthetic oligonucleotide
ugcccacuguccuuugca

SEQ ID NO: 141377 - RNA, 18 nt, Artificial Sequence
  Description of Artificial Sequence: Synthetic oligonucleotide
ccuccugcccacuguccu

SEQ ID NO: 141378 - RNA, 18 nt, Artificial Sequence
  Description of Artificial Sequence: Synthetic oligonucleotide
gggccuccugcccacugu

SEQ ID NO: 141379 - RNA, 18 nt, Artificial Sequence
  Description of Artificial Sequence: Synthetic oligonucleotide
ucuggcucucagccuggg

SEQ ID NO: 141380 - RNA, 18 nt, Artificial Sequence
  Description of Artificial Sequence: Synthetic oligonucleotide
aggcaucuggcucucagc

SEQ ID NO: 141381 - RNA, 18 nt, Artificial Sequence
  Description of Artificial Sequence: Synthetic oligonucleotide
gggaggcaucuggcucuc

SEQ ID NO: 141382 - RNA, 18 nt, Artificial Sequence
  Description of Artificial Sequence: Synthetic oligonucleotide
ggcaaugacagucuuggg

SEQ ID NO: 141383 - RNA, 18 nt, Artificial Sequence
  Description of Artificial Sequence: Synthetic oligonucleotide
gggcaaugacagucuugg

SEQ ID NO: 141384 - RNA, 18 nt, Artificial Sequence
  Description of Artificial Sequence: Synthetic oligonucleotide
ggccucagcaucggaggg

SEQ ID NO: 141385 - RNA, 18 nt, Artificial Sequence
  Description of Artificial Sequence: Synthetic oligonucleotide
uggguggccucagcaucg

SEQ ID NO: 141386 - RNA, 18 nt, Artificial Sequence
  Description of Artificial Sequence: Synthetic oligonucleotide
gucaguggguggccucag

SEQ ID NO: 141387 - RNA, 18 nt, Artificial Sequence
  Description of Artificial Sequence: Synthetic oligonucleotide
guugggucaguggguggc

SEQ ID NO: 141388 - RNA, 18 nt, Artificial Sequence
  Description of Artificial Sequence: Synthetic oligonucleotide
gaucaguugggucagugg

SEQ ID NO: 141389 - RNA, 18 nt, Artificial Sequence
  Description of Artificial Sequence: Synthetic oligonucleotide
agcaggaucaguuggguc

SEQ ID NO: 141390 - RNA, 18 nt, Artificial Sequence
  Description of Artificial Sequence: Synthetic oligonucleotide
gcuggagcaggaucaguu

SEQ ID NO: 141391 - RNA, 18 nt, Artificial Sequence
  Description of Artificial Sequence: Synthetic oligonucleotide
gugcugcuggagcaggau

SEQ ID NO: 141392 - RNA, 18 nt, Artificial Sequence
  Description of Artificial Sequence: Synthetic oligonucleotide
gaggugugcugcuggagc

SEQ ID NO: 141393 - RNA, 18 nt, Artificial Sequence
  Description of Artificial Sequence: Synthetic oligonucleotide
gggcugaggugugcugcu

SEQ ID NO: 141394 - RNA, 18 nt, Artificial Sequence
  Description of Artificial Sequence: Synthetic oligonucleotide
aaggacacugggugucag

SEQ ID NO: 141395 - RNA, 18 nt, Artificial Sequence
  Description of Artificial Sequence: Synthetic oligonucleotide
gauggaaggacacugggu

SEQ ID NO: 141396 - RNA, 18 nt, Artificial Sequence
  Description of Artificial Sequence: Synthetic oligonucleotide
gugaagauggaaggacac

SEQ ID NO: 141397 - RNA, 18 nt, Artificial Sequence
  Description of Artificial Sequence: Synthetic oligonucleotide
ccagugugaagauggaag

SEQ ID NO: 141398 - RNA, 18 nt, Artificial Sequence
  Description of Artificial Sequence: Synthetic oligonucleotide
gcaaaccagugugaagau

SEQ ID NO: 141399 - RNA, 18 nt, Artificial Sequence
  Description of Artificial Sequence: Synthetic oligonucleotide
gccuggcaaaccagugug

SEQ ID NO: 141400 - RNA, 18 nt, Artificial Sequence
  Description of Artificial Sequence: Synthetic oligonucleotide
cauuggccuggcaaacca

SEQ ID NO: 141401 - RNA, 18 nt, Artificial Sequence
  Description of Artificial Sequence: Synthetic oligonucleotide
agcaacauuggccuggca

SEQ ID NO: 141402 - RNA, 18 nt, Artificial Sequence
  Description of Artificial Sequence: Synthetic oligonucleotide
ccaucagcaacauuggcc

SEQ ID NO: 141403 - RNA, 18 nt, Artificial Sequence
  Description of Artificial Sequence: Synthetic oligonucleotide
gggccaucagcaacauug

SEQ ID NO: 141404 - RNA, 18 nt, Artificial Sequence
  Description of Artificial Sequence: Synthetic oligonucleotide
ccagcggccagugcaggg

SEQ ID NO: 141405 - RNA, 18 nt, Artificial Sequence
  Description of Artificial Sequence: Synthetic oligonucleotide
gccguccagcggccagug

SEQ ID NO: 141406 - RNA, 18 nt, Artificial Sequence
  Description of Artificial Sequence: Synthetic oligonucleotide
agagugccguccagcggc

SEQ ID NO: 141407 - RNA, 18 nt, Artificial Sequence
  Description of Artificial Sequence: Synthetic oligonucleotide
cugggagagugccgucca

SEQ ID NO: 141408 - RNA, 18 nt, Artificial Sequence
  Description of Artificial Sequence: Synthetic oligonucleotide
ccaagcugggagagugcc

SEQ ID NO: 141409 - RNA, 18 nt, Artificial Sequence
  Description of Artificial Sequence: Synthetic oligonucleotide
uacuuccaagcugggaga

SEQ ID NO: 141410 - RNA, 18 nt, Artificial Sequence
  Description of Artificial Sequence: Synthetic oligonucleotide
cugccuacuuccaagcug

SEQ ID NO: 141411 - RNA, 18 nt, Artificial Sequence
  Description of Artificial Sequence: Synthetic oligonucleotide
gaacccugccuacuucca

SEQ ID NO: 141412 - RNA, 18 nt, Artificial Sequence
  Description of Artificial Sequence: Synthetic oligonucleotide
ggagggaacccugccuac

SEQ ID NO: 141413 - RNA, 18 nt, Artificial Sequence
  Description of Artificial Sequence: Synthetic oligonucleotide
caccuggagggaacccug

SEQ ID NO: 141414 - RNA, 18 nt, Artificial Sequence
  Description of Artificial Sequence: Synthetic oligonucleotide
gggcccaccuggagggaa

SEQ ID NO: 141415 - RNA, 18 nt, Artificial Sequence
  Description of Artificial Sequence: Synthetic oligonucleotide
gcuccucuucagugaggu

SEQ ID NO: 141416 - RNA, 18 nt, Artificial Sequence
  Description of Artificial Sequence: Synthetic oligonucleotide
gacuugcuccucuucagu

SEQ ID NO: 141417 - RNA, 18 nt, Artificial Sequence
  Description of Artificial Sequence: Synthetic oligonucleotide
cuugagacuugcuccucu

SEQ ID NO: 141418 - RNA, 18 nt, Artificial Sequence
  Description of Artificial Sequence: Synthetic oligonucleotide
cuucucuugagacuugcu

SEQ ID NO: 141419 - RNA, 18 nt, Artificial Sequence
  Description of Artificial Sequence: Synthetic oligonucleotide
cccuccuucucuugagac

SEQ ID NO: 141420 - RNA, 18 nt, Artificial Sequence
  Description of Artificial Sequence: Synthetic oligonucleotide
auccccccuccuucucuu

SEQ ID NO: 141421 - RNA, 18 nt, Artificial Sequence
  Description of Artificial Sequence: Synthetic oligonucleotide
caccaauccccccuccuu

SEQ ID NO: 141422 - RNA, 18 nt, Artificial Sequence
  Description of Artificial Sequence: Synthetic oligonucleotide
ccaaccaccaaucccccc

SEQ ID NO: 141423 - RNA, 18 nt, Artificial Sequence
  Description of Artificial Sequence: Synthetic oligonucleotide
uuccuccaaccaccaauc

SEQ ID NO: 141424 - RNA, 18 nt, Artificial Sequence
  Description of Artificial Sequence: Synthetic oligonucleotide
gcugcuuccuccaaccac

SEQ ID NO: 141425 - RNA, 18 nt, Artificial Sequence
  Description of Artificial Sequence: Synthetic oligonucleotide
ggugugcugcuuccucca

SEQ ID NO: 141426 - RNA, 18 nt, Artificial Sequence
  Description of Artificial Sequence: Synthetic oligonucleotide
aauugggugugcugcuuc

SEQ ID NO: 141427 - RNA, 18 nt, Artificial Sequence
  Description of Artificial Sequence: Synthetic oligonucleotide
ggcagaauugggugugcu

SEQ ID NO: 141428 - RNA, 18 nt, Artificial Sequence
  Description of Artificial Sequence: Synthetic oligonucleotide
gggcagaauugggugugc

SEQ ID NO: 141429 - RNA, 18 nt, Artificial Sequence
  Description of Artificial Sequence: Synthetic oligonucleotide
agaccccgaguccuaggg

SEQ ID NO: 141430 - RNA, 18 nt, Artificial Sequence
  Description of Artificial Sequence: Synthetic oligonucleotide
gacucagaccccgagucc

SEQ ID NO: 141431 - RNA, 18 nt, Artificial Sequence
  Description of Artificial Sequence: Synthetic oligonucleotide
cccaggacucagaccccg

SEQ ID NO: 141432 - RNA, 18 nt, Artificial Sequence
  Description of Artificial Sequence: Synthetic oligonucleotide
cugaccccaggacucaga

SEQ ID NO: 141433 - RNA, 18 nt, Artificial Sequence
  Description of Artificial Sequence: Synthetic oligonucleotide
cuggccugaccccaggac

SEQ ID NO: 141434 - RNA, 18 nt, Artificial Sequence
  Description of Artificial Sequence: Synthetic oligonucleotide
ucucccuggccugacccc

SEQ ID NO: 141435 - RNA, 18 nt, Artificial Sequence
  Description of Artificial Sequence: Synthetic oligonucleotide
cgagcucucccuggccug

SEQ ID NO: 141436 - RNA, 18 nt, Artificial Sequence
  Description of Artificial Sequence: Synthetic oligonucleotide
ugccccgagcucucccug

SEQ ID NO: 141437 - RNA, 18 nt, Artificial Sequence
  Description of Artificial Sequence: Synthetic oligonucleotide
aggccugccccgagcucu

SEQ ID NO: 141438 - RNA, 18 nt, Artificial Sequence
  Description of Artificial Sequence: Synthetic oligonucleotide
gcggaaggccugccccga

SEQ ID NO: 141439 - RNA, 18 nt, Artificial Sequence
  Description of Artificial Sequence: Synthetic oligonucleotide
ugcuggcggaaggccugc

SEQ ID NO: 141440 - RNA, 18 nt, Artificial Sequence
  Description of Artificial Sequence: Synthetic oligonucleotide
gggagugcuggcggaagg

SEQ ID NO: 141441 - RNA, 18 nt, Artificial Sequence
  Description of Artificial Sequence: Synthetic oligonucleotide
gcagugggagugcuggcg

SEQ ID NO: 141442 - RNA, 18 nt, Artificial Sequence
  Description of Artificial Sequence: Synthetic oligonucleotide
gggcagugggagugcugg

SEQ ID NO: 141443 - RNA, 18 nt, Artificial Sequence
  Description of Artificial Sequence: Synthetic oligonucleotide
ggcugcuacugggcaggg

SEQ ID NO: 141444 - RNA, 18 nt, Artificial Sequence
  Description of Artificial Sequence: Synthetic oligonucleotide
ugggcggcugcuacuggg

SEQ ID NO: 141445 - RNA, 18 nt, Artificial Sequence
  Description of Artificial Sequence: Synthetic oligonucleotide
caaugugggcggcugcua

SEQ ID NO: 141446 - RNA, 18 nt, Artificial Sequence
  Description of Artificial Sequence: Synthetic oligonucleotide
ugacacaaugugggcggc

SEQ ID NO: 141447 - RNA, 18 nt, Artificial Sequence
  Description of Artificial Sequence: Synthetic oligonucleotide
gaugcugacacaaugugg

SEQ ID NO: 141448 - RNA, 18 nt, Artificial Sequence
  Description of Artificial Sequence: Synthetic oligonucleotide
cccuggaugcugacacaa

SEQ ID NO: 141449 - RNA, 18 nt, Artificial Sequence
  Description of Artificial Sequence: Synthetic oligonucleotide
ccuggcccuggaugcuga

SEQ ID NO: 141450 - RNA, 18 nt, Artificial Sequence
  Description of Artificial Sequence: Synthetic oligonucleotide
caggcccuggcccuggau

SEQ ID NO: 141451 - RNA, 18 nt, Artificial Sequence
  Description of Artificial Sequence: Synthetic oligonucleotide
gaggccaggcccuggccc

SEQ ID NO: 141452 - RNA, 18 nt, Artificial Sequence
  Description of Artificial Sequence: Synthetic oligonucleotide
gaugugaggccaggcccu

SEQ ID NO: 141453 - RNA, 18 nt, Artificial Sequence
  Description of Artificial Sequence: Synthetic oligonucleotide
gggaugugaggccaggcc

SEQ ID NO: 141454 - RNA, 18 nt, Artificial Sequence
  Description of Artificial Sequence: Synthetic oligonucleotide
cuagagaaaggagcaggg

SEQ ID NO: 141455 - RNA, 18 nt, Artificial Sequence
  Description of Artificial Sequence: Synthetic oligonucleotide
gccagcuagagaaaggag

SEQ ID NO: 141456 - RNA, 18 nt, Artificial Sequence
  Description of Artificial Sequence: Synthetic oligonucleotide
guggagccagcuagagaa

SEQ ID NO: 141457 - RNA, 18 nt, Artificial Sequence
  Description of Artificial Sequence: Synthetic oligonucleotide
cucccguggagccagcua

SEQ ID NO: 141458 - RNA, 18 nt, Artificial Sequence
  Description of Artificial Sequence: Synthetic oligonucleotide
cugaacucccguggagcc

SEQ ID NO: 141459 - RNA, 18 nt, Artificial Sequence
  Description of Artificial Sequence: Synthetic oligonucleotide
gggccugaacucccgugg

SEQ ID NO: 141460 - RNA, 18 nt, Artificial Sequence
  Description of Artificial Sequence: Synthetic oligonucleotide
ugugugugugcuggaggg

SEQ ID NO: 141461 - RNA, 18 nt, Artificial Sequence
  Description of Artificial Sequence: Synthetic oligonucleotide
gcuuaugugugugugcug

SEQ ID NO: 141462 - RNA, 18 nt, Artificial Sequence
  Description of Artificial Sequence: Synthetic oligonucleotide
ucagugcuuaugugugug

SEQ ID NO: 141463 - RNA, 18 nt, Artificial Sequence
  Description of Artificial Sequence: Synthetic oligonucleotide
ugauuucagugcuuaugu

SEQ ID NO: 141464 - RNA, 18 nt, Artificial Sequence
  Description of Artificial Sequence: Synthetic oligonucleotide
uaaagugauuucagugcu

SEQ ID NO: 141465 - RNA, 18 nt, Artificial Sequence
  Description of Artificial Sequence: Synthetic oligonucleotide
gcagguaaagugauuuca

SEQ ID NO: 141466 - RNA, 18 nt, Artificial Sequence
  Description of Artificial Sequence: Synthetic oligonucleotide
agccugcagguaaaguga

SEQ ID NO: 141467 - RNA, 18 nt, Artificial Sequence
  Description of Artificial Sequence: Synthetic oligonucleotide
cauggagccugcagguaa

SEQ ID NO: 141468 - RNA, 18 nt, Artificial Sequence
  Description of Artificial Sequence: Synthetic oligonucleotide
aggugcauggagccugca

SEQ ID NO: 141469 - RNA, 18 nt, Artificial Sequence
  Description of Artificial Sequence: Synthetic oligonucleotide
aagggaggugcauggagc

SEQ ID NO: 141470 - RNA, 18 nt, Artificial Sequence
  Description of Artificial Sequence: Synthetic oligonucleotide
gagggaagggaggugcau

SEQ ID NO: 141471 - RNA, 18 nt, Artificial Sequence
  Description of Artificial Sequence: Synthetic oligonucleotide
ucagggagggaagggagg

SEQ ID NO: 141472 - RNA, 18 nt, Artificial Sequence
  Description of Artificial Sequence: Synthetic oligonucleotide
cugccucagggagggaag

SEQ ID NO: 141473 - RNA, 18 nt, Artificial Sequence
  Description of Artificial Sequence: Synthetic oligonucleotide
cucaccugccucagggag

SEQ ID NO: 141474 - RNA, 18 nt, Artificial Sequence
  Description of Artificial Sequence: Synthetic oligonucleotide
ggguucucaccugccuca

SEQ ID NO: 141475 - RNA, 18 nt, Artificial Sequence
  Description of Artificial Sequence: Synthetic oligonucleotide
ucucuggguucucaccug

SEQ ID NO: 141476 - RNA, 18 nt, Artificial Sequence
  Description of Artificial Sequence: Synthetic oligonucleotide
cccucucucuggguucuc

SEQ ID NO: 141477 - RNA, 18 nt, Artificial Sequence
  Description of Artificial Sequence: Synthetic oligonucleotide
caggccccucucucuggg

SEQ ID NO: 141478 - RNA, 18 nt, Artificial Sequence
  Description of Artificial Sequence: Synthetic oligonucleotide
accugcaggccccucucu

SEQ ID NO: 141479 - RNA, 18 nt, Artificial Sequence
  Description of Artificial Sequence: Synthetic oligonucleotide
ugcucaccugcaggcccc

SEQ ID NO: 141480 - RNA, 18 nt, Artificial Sequence
  Description of Artificial Sequence: Synthetic oligonucleotide
cugccugcucaccugcag

SEQ ID NO: 141481 - RNA, 18 nt, Artificial Sequence
  Description of Artificial Sequence: Synthetic oligonucleotide
cagcccugccugcucacc

SEQ ID NO: 141482 - RNA, 18 nt, Artificial Sequence
  Description of Artificial Sequence: Synthetic oligonucleotide
uggcccagcccugccugc

SEQ ID NO: 141483 - RNA, 18 nt, Artificial Sequence
  Description of Artificial Sequence: Synthetic oligonucleotide
agaccuggcccagcccug

SEQ ID NO: 141484 - RNA, 18 nt, Artificial Sequence
  Description of Artificial Sequence: Synthetic oligonucleotide
cccggagaccuggcccag

SEQ ID NO: 141485 - RNA, 18 nt, Artificial Sequence
  Description of Artificial Sequence: Synthetic oligonucleotide
gccuccccggagaccugg

SEQ ID NO: 141486 - RNA, 18 nt, Artificial Sequence
  Description of Artificial Sequence: Synthetic oligonucleotide
ccccugccuccccggaga

SEQ ID NO: 141487 - RNA, 18 nt, Artificial Sequence
  Description of Artificial Sequence: Synthetic oligonucleotide
caggaccccugccucccc

SEQ ID NO: 141488 - RNA, 18 nt, Artificial Sequence
  Description of Artificial Sequence: Synthetic oligonucleotide
accugcaggaccccugcc

SEQ ID NO: 141489 - RNA, 18 nt, Artificial Sequence
  Description of Artificial Sequence: Synthetic oligonucleotide
ccaggaccugcaggaccc

SEQ ID NO: 141490 - RNA, 18 nt, Artificial Sequence
  Description of Artificial Sequence: Synthetic oligonucleotide
acccaccaggaccugcag

SEQ ID NO: 141491 - RNA, 18 nt, Artificial Sequence
  Description of Artificial Sequence: Synthetic oligonucleotide
ggcugacccaccaggacc

SEQ ID NO: 141492 - RNA, 18 nt, Artificial Sequence
  Description of Artificial Sequence: Synthetic oligonucleotide
ugcugggcugacccacca

SEQ ID NO: 141493 - RNA, 18 nt, Artificial Sequence
  Description of Artificial Sequence: Synthetic oligonucleotide
gcaggugcugggcugacc

SEQ ID NO: 141494 - RNA, 18 nt, Artificial Sequence
  Description of Artificial Sequence: Synthetic oligonucleotide
ugggagcaggugcugggc

SEQ ID NO: 141495 - RNA, 18 nt, Artificial Sequence
  Description of Artificial Sequence: Synthetic oligonucleotide
cccacugggagcaggugc

SEQ ID NO: 141496 - RNA, 18 nt, Artificial Sequence
  Description of Artificial Sequence: Synthetic oligonucleotide
aagcucccacugggagca

SEQ ID NO: 141497 - RNA, 18 nt, Artificial Sequence
  Description of Artificial Sequence: Synthetic oligonucleotide
ccgggaagcucccacugg

SEQ ID NO: 141498 - RNA, 18 nt, Artificial Sequence
  Description of Artificial Sequence: Synthetic oligonucleotide
uuaucccgggaagcuccc

SEQ ID NO: 141499 - RNA, 18 nt, Artificial Sequence
  Description of Artificial Sequence: Synthetic oligonucleotide
ucaguuuaucccgggaag

SEQ ID NO: 141500 - RNA, 18 nt, Artificial Sequence
  Description of Artificial Sequence: Synthetic oligonucleotide
caggcucaguuuaucccg

SEQ ID NO: 141501 - RNA, 18 nt, Artificial Sequence
  Description of Artificial Sequence: Synthetic oligonucleotide
augaacaggcucaguuua

SEQ ID NO: 141502 - RNA, 18 nt, Artificial Sequence
  Description of Artificial Sequence: Synthetic oligonucleotide
ucagaaugaacaggcuca

SEQ ID NO: 141503 - RNA, 18 nt, Artificial Sequence
  Description of Artificial Sequence: Synthetic oligonucleotide
ggacaucagaaugaacag

SEQ ID NO: 141504 - RNA, 18 nt, Artificial Sequence
  Description of Artificial Sequence: Synthetic oligonucleotide
caaauggacaucagaaug

SEQ ID NO: 141505 - RNA, 18 nt, Artificial Sequence
  Description of Artificial Sequence: Synthetic oligonucleotide
ugggacaaauggacauca

SEQ ID NO: 141506 - RNA, 18 nt, Artificial Sequence
  Description of Artificial Sequence: Synthetic oligonucleotide
gcuauugggacaaaugga

SEQ ID NO: 141507 - RNA, 18 nt, Artificial Sequence
  Description of Artificial Sequence: Synthetic oligonucleotide
guagagcuauugggacaa

SEQ ID NO: 141508 - RNA, 18 nt, Artificial Sequence
  Description of Artificial Sequence: Synthetic oligonucleotide
gggcaguagagcuauugg

SEQ ID NO: 141509 - RNA, 18 nt, Artificial Sequence
  Description of Artificial Sequence: Synthetic oligonucleotide
gggagggcaguagagcua

SEQ ID NO: 141510 - RNA, 18 nt, Artificial Sequence
  Description of Artificial Sequence: Synthetic oligonucleotide
gcugggcugaguaaaggg

SEQ ID NO: 141511 - RNA, 18 nt, Artificial Sequence
  Description of Artificial Sequence: Synthetic oligonucleotide
ggccagcugggcugagua

SEQ ID NO: 141512 - RNA, 18 nt, Artificial Sequence
  Description of Artificial Sequence: Synthetic oligonucleotide
uagguggccagcugggcu

SEQ ID NO: 141513 - RNA, 18 nt, Artificial Sequence
  Description of Artificial Sequence: Synthetic oligonucleotide
acuucuagguggccagcu

SEQ ID NO: 141514 - RNA, 18 nt, Artificial Sequence
  Description of Artificial Sequence: Synthetic oligonucleotide
gggagacuucuagguggc

SEQ ID NO: 141515 - RNA, 18 nt, Artificial Sequence
  Description of Artificial Sequence: Synthetic oligonucleotide
gugcagggagacuucuag

SEQ ID NO: 141516 - RNA, 18 nt, Artificial Sequence
  Description of Artificial Sequence: Synthetic oligonucleotide
aggcugugcagggagacu

SEQ ID NO: 141517 - RNA, 18 nt, Artificial Sequence
  Description of Artificial Sequence: Synthetic oligonucleotide
acuagaggcugugcaggg

SEQ ID NO: 141518 - RNA, 18 nt, Artificial Sequence
  Description of Artificial Sequence: Synthetic oligonucleotide
cggacacuagaggcugug

SEQ ID NO: 141519 - RNA, 18 nt, Artificial Sequence
  Description of Artificial Sequence: Synthetic oligonucleotide
guccccggacacuagagg

SEQ ID NO: 141520 - RNA, 18 nt, Artificial Sequence
  Description of Artificial Sequence: Synthetic oligonucleotide
acaagguccccggacacu

SEQ ID NO: 141521 - RNA, 18 nt, Artificial Sequence
  Description of Artificial Sequence: Synthetic oligonucleotide
gucccacaagguccccgg

SEQ ID NO: 141522 - RNA, 18 nt, Artificial Sequence
  Description of Artificial Sequence: Synthetic oligonucleotide
gacuggucccacaagguc

SEQ ID NO: 141523 - RNA, 18 nt, Artificial Sequence
  Description of Artificial Sequence: Synthetic oligonucleotide
ugugggacuggucccaca

SEQ ID NO: 141524 - RNA, 18 nt, Artificial Sequence
  Description of Artificial Sequence: Synthetic oligonucleotide
agcggugugggacugguc

SEQ ID NO: 141525 - RNA, 18 nt, Artificial Sequence
  Description of Artificial Sequence: Synthetic oligonucleotide
ggaccagcggugugggac

SEQ ID NO: 141526 - RNA, 18 nt, Artificial Sequence
  Description of Artificial Sequence: Synthetic oligonucleotide
ggcagggaccagcggugu

SEQ ID NO: 141527 - RNA, 18 nt, Artificial Sequence
  Description of Artificial Sequence: Synthetic oligonucleotide
gggagggcagggaccagc

SEQ ID NO: 141528 - RNA, 18 nt, Artificial Sequence
  Description of Artificial Sequence: Synthetic oligonucleotide
gcaccucaaccugggagc

SEQ ID NO: 141529 - RNA, 18 nt, Artificial Sequence
  Description of Artificial Sequence: Synthetic oligonucleotide
ugagcgcaccucaaccug

SEQ ID NO: 141530 - RNA, 18 nt, Artificial Sequence
  Description of Artificial Sequence: Synthetic oligonucleotide
ugaggugagcgcaccuca

SEQ ID NO: 141531 - RNA, 18 nt, Artificial Sequence
  Description of Artificial Sequence: Synthetic oligonucleotide
ugcucugaggugagcgca

SEQ ID NO: 141532 - RNA, 18 nt, Artificial Sequence
  Description of Artificial Sequence: Synthetic oligonucleotide
ggcccugcucugagguga

SEQ ID NO: 141533 - RNA, 18 nt, Artificial Sequence
  Description of Artificial Sequence: Synthetic oligonucleotide
gcuuuggcccugcucuga

SEQ ID NO: 141534 - RNA, 18 nt, Artificial Sequence
  Description of Artificial Sequence: Synthetic oligonucleotide
gcugugcuuuggcccugc

SEQ ID NO: 141535 - RNA, 18 nt, Artificial Sequence
  Description of Artificial Sequence: Synthetic oligonucleotide
gcccagcugugcuuuggc

SEQ ID NO: 141536 - RNA, 18 nt, Artificial Sequence
  Description of Artificial Sequence: Synthetic oligonucleotide
ggcaugcccagcugugcu

SEQ ID NO: 141537 - RNA, 18 nt, Artificial Sequence
  Description of Artificial Sequence: Synthetic oligonucleotide
gacauggcaugcccagcu

SEQ ID NO: 141538 - RNA, 18 nt, Artificial Sequence
  Description of Artificial Sequence: Synthetic oligonucleotide
gcucagacauggcaugcc

SEQ ID NO: 141539 - RNA, 18 nt, Artificial Sequence
  Description of Artificial Sequence: Synthetic oligonucleotide
gcgccgcucagacauggc

SEQ ID NO: 141540 - RNA, 18 nt, Artificial Sequence
  Description of Artificial Sequence: Synthetic oligonucleotide
gcucugcgccgcucagac

SEQ ID NO: 141541 - RNA, 18 nt, Artificial Sequence
  Description of Artificial Sequence: Synthetic oligonucleotide
ggagggcucugcgccgcu

SEQ ID NO: 141542 - RNA, 18 nt, Artificial Sequence
  Description of Artificial Sequence: Synthetic oligonucleotide
ggccuggagggcucugcg

SEQ ID NO: 141543 - RNA, 18 nt, Artificial Sequence
  Description of Artificial Sequence: Synthetic oligonucleotide
cugcaggccuggagggcu

SEQ ID NO: 141544 - RNA, 18 nt, Artificial Sequence
  Description of Artificial Sequence: Synthetic oligonucleotide
ugccccugcaggccugga

SEQ ID NO: 141545 - RNA, 18 nt, Artificial Sequence
  Description of Artificial Sequence: Synthetic oligonucleotide
ccccuugccccugcaggc

SEQ ID NO: 141546 - RNA, 18 nt, Artificial Sequence
  Description of Artificial Sequence: Synthetic oligonucleotide
gccagccccuugccccug

SEQ ID NO: 141547 - RNA, 18 nt, Artificial Sequence
  Description of Artificial Sequence: Synthetic oligonucleotide
cuccagccagccccuugc

SEQ ID NO: 141548 - RNA, 18 nt, Artificial Sequence
  Description of Artificial Sequence: Synthetic oligonucleotide
ugagacuccagccagccc

SEQ ID NO: 141549 - RNA, 18 nt, Artificial Sequence
  Description of Artificial Sequence: Synthetic oligonucleotide
ugcucugagacuccagcc

SEQ ID NO: 141550 - RNA, 18 nt, Artificial Sequence
  Description of Artificial Sequence: Synthetic oligonucleotide
cucugugcucugagacuc

SEQ ID NO: 141551 - RNA, 18 nt, Artificial Sequence
  Description of Artificial Sequence: Synthetic oligonucleotide
ccuaccucugugcucuga

SEQ ID NO: 141552 - RNA, 18 nt, Artificial Sequence
  Description of Artificial Sequence: Synthetic oligonucleotide
guucuccuaccucugugc

SEQ ID NO: 141553 - RNA, 18 nt, Artificial Sequence
  Description of Artificial Sequence: Synthetic oligonucleotide
ccccaguucuccuaccuc

SEQ ID NO: 141554 - RNA, 18 nt, Artificial Sequence
  Description of Artificial Sequence: Synthetic oligonucleotide
uugaaccccaguucuccu

SEQ ID NO: 141555 - RNA, 18 nt, Artificial Sequence
  Description of Artificial Sequence: Synthetic oligonucleotide
ugggcuugaaccccaguu

SEQ ID NO: 141556 - RNA, 18 nt, Artificial Sequence
  Description of Artificial Sequence: Synthetic oligonucleotide
aagccugggcuugaaccc

SEQ ID NO: 141557 - RNA, 18 nt, Artificial Sequence
  Description of Artificial Sequence: Synthetic oligonucleotide
ccaggaagccugggcuug

SEQ ID NO: 141558 - RNA, 18 nt, Artificial Sequence
  Description of Artificial Sequence: Synthetic oligonucleotide
aggacccaggaagccugg

SEQ ID NO: 141559 - RNA, 18 nt, Artificial Sequence
  Description of Artificial Sequence: Synthetic oligonucleotide
caggcaggacccaggaag

SEQ ID NO: 141560 - RNA, 18 nt, Artificial Sequence
  Description of Artificial Sequence: Synthetic oligonucleotide
aggaccaggcaggaccca

SEQ ID NO: 141561 - RNA, 18 nt, Artificial Sequence
  Description of Artificial Sequence: Synthetic oligonucleotide
gagggaggaccaggcagg

SEQ ID NO: 141562 - RNA, 18 nt, Artificial Sequence
  Description of Artificial Sequence: Synthetic oligonucleotide
cuugggagggaggaccag

SEQ ID NO: 141563 - RNA, 18 nt, Artificial Sequence
  Description of Artificial Sequence: Synthetic oligonucleotide
ggcuccuugggagggagg

SEQ ID NO: 141564 - RNA, 18 nt, Artificial Sequence
  Description of Artificial Sequence: Synthetic oligonucleotide
agaauggcuccuugggag

SEQ ID NO: 141565 - RNA, 18 nt, Artificial Sequence
  Description of Artificial Sequence: Synthetic oligonucleotide
cacacagaauggcuccuu

SEQ ID NO: 141566 - RNA, 18 nt, Artificial Sequence
  Description of Artificial Sequence: Synthetic oligonucleotide
agucacacacagaauggc

SEQ ID NO: 141567 - RNA, 18 nt, Artificial Sequence
  Description of Artificial Sequence: Synthetic oligonucleotide
cccagagucacacacaga

SEQ ID NO: 141568 - RNA, 18 nt, Artificial Sequence
  Description of Artificial Sequence: Synthetic oligonucleotide
uuccacccagagucacac

SEQ ID NO: 141569 - RNA, 18 nt, Artificial Sequence
  Description of Artificial Sequence: Synthetic oligonucleotide
ggcacuuccacccagagu

SEQ ID NO: 141570 - RNA, 18 nt, Artificial Sequence
  Description of Artificial Sequence: Synthetic oligonucleotide
ggcugggcacuuccaccc

SEQ ID NO: 141571 - RNA, 18 nt, Artificial Sequence
  Description of Artificial Sequence: Synthetic oligonucleotide
gggcugggcacuuccacc

SEQ ID NO: 141572 - RNA, 18 nt, Artificial Sequence
  Description of Artificial Sequence: Synthetic oligonucleotide
gcugcagcgcccguaggg

SEQ ID NO: 141573 - RNA, 18 nt, Artificial Sequence
  Description of Artificial Sequence: Synthetic oligonucleotide
gggaggcugcagcgcccg

SEQ ID NO: 141574 - RNA, 18 nt, Artificial Sequence
  Description of Artificial Sequence: Synthetic oligonucleotide
uggaagggaggcugcagc

SEQ ID NO: 141575 - RNA, 18 nt, Artificial Sequence
  Description of Artificial Sequence: Synthetic oligonucleotide
gggcauggaagggaggcu

SEQ ID NO: 141576 - RNA, 18 nt, Artificial Sequence
  Description of Artificial Sequence: Synthetic oligonucleotide
gccagcagagagugaucc

SEQ ID NO: 141577 - RNA, 18 nt, Artificial Sequence
  Description of Artificial Sequence: Synthetic oligonucleotide
auccugccagcagagagu

SEQ ID NO: 141578 - RNA, 18 nt, Artificial Sequence
  Description of Artificial Sequence: Synthetic oligonucleotide
gaagaauccugccagcag

SEQ ID NO: 141579 - RNA, 18 nt, Artificial Sequence
  Description of Artificial Sequence: Synthetic oligonucleotide
agcgggaagaauccugcc

SEQ ID NO: 141580 - RNA, 18 nt, Artificial Sequence
  Description of Artificial Sequence: Synthetic oligonucleotide
gggagcgggaagaauccu

SEQ ID NO: 141581 - RNA, 18 nt, Artificial Sequence
  Description of Artificial Sequence: Synthetic oligonucleotide
aucagcuggguagguggg

SEQ ID NO: 141582 - RNA, 18 nt, Artificial Sequence
  Description of Artificial Sequence: Synthetic oligonucleotide
cccccaucagcuggguag

SEQ ID NO: 141583 - RNA, 18 nt, Artificial Sequence
  Description of Artificial Sequence: Synthetic oligonucleotide
cccaacccccaucagcug

SEQ ID NO: 141584 - RNA, 18 nt, Artificial Sequence
  Description of Artificial Sequence: Synthetic oligonucleotide
agcaccccaacccccauc

SEQ ID NO: 141585 - RNA, 18 nt, Artificial Sequence
  Description of Artificial Sequence: Synthetic oligonucleotide
aaggaagcaccccaaccc

SEQ ID NO: 141586 - RNA, 18 nt, Artificial Sequence
  Description of Artificial Sequence: Synthetic oligonucleotide
ccugaaaggaagcacccc

SEQ ID NO: 141587 - RNA, 18 nt, Artificial Sequence
  Description of Artificial Sequence: Synthetic oligonucleotide
cuuggccugaaaggaagc

SEQ ID NO: 141588 - RNA, 18 nt, Artificial Sequence
  Description of Artificial Sequence: Synthetic oligonucleotide
auagccuuggccugaaag

SEQ ID NO: 141589 - RNA, 18 nt, Artificial Sequence
  Description of Artificial Sequence: Synthetic oligonucleotide
ccuucauagccuuggccu

SEQ ID NO: 141590 - RNA, 18 nt, Artificial Sequence
  Description of Artificial Sequence: Synthetic oligonucleotide
cugucccuucauagccuu

SEQ ID NO: 141591 - RNA, 18 nt, Artificial Sequence
  Description of Artificial Sequence: Synthetic oligonucleotide
agcagcugucccuucaua

SEQ ID NO: 141592 - RNA, 18 nt, Artificial Sequence
  Description of Artificial Sequence: Synthetic oligonucleotide
gucccagcagcugucccu

SEQ ID NO: 141593 - RNA, 18 nt, Artificial Sequence
  Description of Artificial Sequence: Synthetic oligonucleotide
ggugggucccagcagcug

SEQ ID NO: 141594 - RNA, 18 nt, Artificial Sequence
  Description of Artificial Sequence: Synthetic oligonucleotide
gggaggugggucccagca

SEQ ID NO: 141595 - RNA, 18 nt, Artificial Sequence
  Description of Artificial Sequence: Synthetic oligonucleotide
acgcggcauguggccggg

SEQ ID NO: 141596 - RNA, 18 nt, Artificial Sequence
  Description of Artificial Sequence: Synthetic oligonucleotide
cagggacgcggcaugugg

SEQ ID NO: 141597 - RNA, 18 nt, Artificial Sequence
  Description of Artificial Sequence: Synthetic oligonucleotide
gggcagggacgcggcaug

SEQ ID NO: 141598 - RNA, 18 nt, Artificial Sequence
  Description of Artificial Sequence: Synthetic oligonucleotide
caccagacccgggucggg

SEQ ID NO: 141599 - RNA, 18 nt, Artificial Sequence
  Description of Artificial Sequence: Synthetic oligonucleotide
cucagcaccagacccggg

SEQ ID NO: 141600 - RNA, 18 nt, Artificial Sequence
  Description of Artificial Sequence: Synthetic oligonucleotide
guauccucagcaccagac

SEQ ID NO: 141601 - RNA, 18 nt, Artificial Sequence
  Description of Artificial Sequence: Synthetic oligonucleotide
gagcuguauccucagcac

SEQ ID NO: 141602 - RNA, 18 nt, Artificial Sequence
  Description of Artificial Sequence: Synthetic oligonucleotide
gagaagagcuguauccuc

SEQ ID NO: 141603 - RNA, 18 nt, Artificial Sequence
  Description of Artificial Sequence: Synthetic oligonucleotide
acacugagaagagcugua

SEQ ID NO: 141604 - RNA, 18 nt, Artificial Sequence
  Description of Artificial Sequence: Synthetic oligonucleotide
uucagacacugagaagag

SEQ ID NO: 141605 - RNA, 18 nt, Artificial Sequence
  Description of Artificial Sequence: Synthetic oligonucleotide
gauuguucagacacugag

SEQ ID NO: 141606 - RNA, 18 nt, Artificial Sequence
  Description of Artificial Sequence: Synthetic oligonucleotide
uuggagauuguucagaca

SEQ ID NO: 141607 - RNA, 18 nt, Artificial Sequence
  Description of Artificial Sequence: Synthetic oligonucleotide
caauuuuggagauuguuc

SEQ ID NO: 141608 - RNA, 18 nt, Artificial Sequence
  Description of Artificial Sequence: Synthetic oligonucleotide
cauuucaauuuuggagau

SEQ ID NO: 141609 - RNA, 18 nt, Artificial Sequence
  Description of Artificial Sequence: Synthetic oligonucleotide
auauacauuucaauuuug

SEQ ID NO: 141610 - RNA, 18 nt, Artificial Sequence
  Description of Artificial Sequence: Synthetic oligonucleotide
caaaaauauacauuucaa

SEQ ID NO: 141611 - RNA, 18 nt, Artificial Sequence
  Description of Artificial Sequence: Synthetic oligonucleotide
ccuagcaaaaauauacau

SEQ ID NO: 141612 - RNA, 18 nt, Artificial Sequence
  Description of Artificial Sequence: Synthetic oligonucleotide
gggcuccuagcaaaaaua

SEQ ID NO: 141613 - RNA, 18 nt, Artificial Sequence
  Description of Artificial Sequence: Synthetic oligonucleotide
auuaaaaacacaggaagc

SEQ ID NO: 141614 - RNA, 18 nt, Artificial Sequence
  Description of Artificial Sequence: Synthetic oligonucleotide
uuuauauuaaaaacacag

SEQ ID NO: 141615 - RNA, 18 nt, Artificial Sequence
  Description of Artificial Sequence: Synthetic oligonucleotide
cacuauuuauauuaaaaa

SEQ ID NO: 141616 - RNA, 18 nt, Artificial Sequence
  Description of Artificial Sequence: Synthetic oligonucleotide
guguacacuauuuauauu

SEQ ID NO: 141617 - RNA, 18 nt, Artificial Sequence
  Description of Artificial Sequence: Synthetic oligonucleotide
agucuguguacacuauuu

SEQ ID NO: 141618 - RNA, 18 nt, Artificial Sequence
  Description of Artificial Sequence: Synthetic oligonucleotide
ucgucagucuguguacac

SEQ ID NO: 141619 - RNA, 18 nt, Artificial Sequence
  Description of Artificial Sequence: Synthetic oligonucleotide
aaguuucgucagucugug

SEQ ID NO: 141620 - RNA, 18 nt, Artificial Sequence
  Description of Artificial Sequence: Synthetic oligonucleotide
auuuaaaguuucgucagu

SEQ ID NO: 141621 - RNA, 18 nt, Artificial Sequence
  Description of Artificial Sequence: Synthetic oligonucleotide
cauuuauuuaaaguuucg

SEQ ID NO: 141622 - RNA, 18 nt, Artificial Sequence
  Description of Artificial Sequence: Synthetic oligonucleotide
auucccauuuauuuaaag

SEQ ID NO: 141623 - RNA, 18 nt, Artificial Sequence
  Description of Artificial Sequence: Synthetic oligonucleotide
auuuaauucccauuuauu

SEQ ID NO: 141624 - RNA, 18 nt, Artificial Sequence
  Description of Artificial Sequence: Synthetic oligonucleotide
uaaauauuuaauucccau

SEQ ID NO: 141625 - RNA, 18 nt, Artificial Sequence
  Description of Artificial Sequence: Synthetic oligonucleotide
gcucuuaaauauuuaauu

SEQ ID NO: 141626 - RNA, 18 nt, Artificial Sequence
  Description of Artificial Sequence: Synthetic oligonucleotide
agucagcucuuaaauauu

SEQ ID NO: 141627 - RNA, 18 nt, Artificial Sequence
  Description of Artificial Sequence: Synthetic oligonucleotide
uacagggugguucccauc

SEQ ID NO: 141628 - RNA, 18 nt, Artificial Sequence
  Description of Artificial Sequence: Synthetic oligonucleotide
accucuacagggugguuc

SEQ ID NO: 141629 - RNA, 18 nt, Artificial Sequence
  Description of Artificial Sequence: Synthetic oligonucleotide
gauggaccucuacagggu

SEQ ID NO: 141630 - RNA, 18 nt, Artificial Sequence
  Description of Artificial Sequence: Synthetic oligonucleotide
acgcagauggaccucuac

SEQ ID NO: 141631 - RNA, 18 nt, Artificial Sequence
  Description of Artificial Sequence: Synthetic oligonucleotide
ucugaacgcagauggacc

SEQ ID NO: 141632 - RNA, 18 nt, Artificial Sequence
  Description of Artificial Sequence: Synthetic oligonucleotide
cugggucugaacgcagau

SEQ ID NO: 141633 - RNA, 18 nt, Artificial Sequence
  Description of Artificial Sequence: Synthetic oligonucleotide
aucgucugggucugaacg

SEQ ID NO: 141634 - RNA, 18 nt, Artificial Sequence
  Description of Artificial Sequence: Synthetic oligonucleotide
cuggcaucgucugggucu

SEQ ID NO: 141635 - RNA, 18 nt, Artificial Sequence
  Description of Artificial Sequence: Synthetic oligonucleotide
uagcucuggcaucgucug

SEQ ID NO: 141636 - RNA, 18 nt, Artificial Sequence
  Description of Artificial Sequence: Synthetic oligonucleotide
agucauagcucuggcauc

SEQ ID NO: 141637 - RNA, 18 nt, Artificial Sequence
  Description of Artificial Sequence: Synthetic oligonucleotide
ggcccagucauagcucug

SEQ ID NO: 141638 - RNA, 18 nt, Artificial Sequence
  Description of Artificial Sequence: Synthetic oligonucleotide
cugcaggcccagucauag

SEQ ID NO: 141639 - RNA, 18 nt, Artificial Sequence
  Description of Artificial Sequence: Synthetic oligonucleotide
cacaccugcaggcccagu

SEQ ID NO: 141640 - RNA, 18 nt, Artificial Sequence
  Description of Artificial Sequence: Synthetic oligonucleotide
ggcgccacaccugcaggc

SEQ ID NO: 141641 - RNA, 18 nt, Artificial Sequence
  Description of Artificial Sequence: Synthetic oligonucleotide
cccucggcgccacaccug

SEQ ID NO: 141642 - RNA, 18 nt, Artificial Sequence
  Description of Artificial Sequence: Synthetic oligonucleotide
aucuccccucggcgccac

SEQ ID NO: 141643 - RNA, 18 nt, Artificial Sequence
  Description of Artificial Sequence: Synthetic oligonucleotide
ggcugaucuccccucggc

SEQ ID NO: 141644 - RNA, 18 nt, Artificial Sequence
  Description of Artificial Sequence: Synthetic oligonucleotide
uccauggcugaucucccc

SEQ ID NO: 141645 - RNA, 18 nt, Artificial Sequence
  Description of Artificial Sequence: Synthetic oligonucleotide
gcugcuccauggcugauc

SEQ ID NO: 141646 - RNA, 18 nt, Artificial Sequence
  Description of Artificial Sequence: Synthetic oligonucleotide
cuguggcugcuccauggc

SEQ ID NO: 141647 - RNA, 18 nt, Artificial Sequence
  Description of Artificial Sequence: Synthetic oligonucleotide
uccuccuguggcugcucc

SEQ ID NO: 141648 - RNA, 18 nt, Artificial Sequence
  Description of Artificial Sequence: Synthetic oligonucleotide
gggcuuccuccuguggcu

SEQ ID NO: 141649 - RNA, 18 nt, Artificial Sequence
  Description of Artificial Sequence: Synthetic oligonucleotide
ucuucccggaccucaggg

SEQ ID NO: 141650 - RNA, 18 nt, Artificial Sequence
  Description of Artificial Sequence: Synthetic oligonucleotide
uccucuucccggaccuca

SEQ ID NO: 141651 - RNA, 18 nt, Artificial Sequence
  Description of Artificial Sequence: Synthetic oligonucleotide
ucuccuccucuucccgga

SEQ ID NO: 141652 - RNA, 18 nt, Artificial Sequence
  Description of Artificial Sequence: Synthetic oligonucleotide
cucuuucuccuccucuuc

SEQ ID NO: 141653 - RNA, 18 nt, Artificial Sequence
  Description of Artificial Sequence: Synthetic oligonucleotide
acuuccucuuucuccucc

SEQ ID NO: 141654 - RNA, 18 nt, Artificial Sequence
  Description of Artificial Sequence: Synthetic oligonucleotide
cugccacuuccucuuucu

SEQ ID NO: 141655 - RNA, 18 nt, Artificial Sequence
  Description of Artificial Sequence: Synthetic oligonucleotide
ugccucugccacuuccuc

SEQ ID NO: 141656 - RNA, 18 nt, Artificial Sequence
  Description of Artificial Sequence: Synthetic oligonucleotide
ccuucugccucugccacu

SEQ ID NO: 141657 - RNA, 18 nt, Artificial Sequence
  Description of Artificial Sequence: Synthetic oligonucleotide
gggcuccuucugccucug

SEQ ID NO: 141658 - RNA, 18 nt, Artificial Sequence
  Description of Artificial Sequence: Synthetic oligonucleotide
cccccauugagcucuggg

SEQ ID NO: 141659 - RNA, 18 nt, Artificial Sequence
  Description of Artificial Sequence: Synthetic oligonucleotide
gucccccauugagcucug

SEQ ID NO: 141660 - RNA, 18 nt, Artificial Sequence
  Description of Artificial Sequence: Synthetic oligonucleotide
cuguggucccccauugag

SEQ ID NO: 141661 - RNA, 18 nt, Artificial Sequence
  Description of Artificial Sequence: Synthetic oligonucleotide
gcaugcugugguccccca

SEQ ID NO: 141662 - RNA, 18 nt, Artificial Sequence
  Description of Artificial Sequence: Synthetic oligonucleotide
gaagugcaugcugugguc

SEQ ID NO: 141663 - RNA, 18 nt, Artificial Sequence
  Description of Artificial Sequence: Synthetic oligonucleotide
ggaaggaagugcaugcug

SEQ ID NO: 141664 - RNA, 18 nt, Artificial Sequence
  Description of Artificial Sequence: Synthetic oligonucleotide
cugcuggaaggaagugca

SEQ ID NO: 141665 - RNA, 18 nt, Artificial Sequence
  Description of Artificial Sequence: Synthetic oligonucleotide
uguagcugcuggaaggaa

SEQ ID NO: 141666 - RNA, 18 nt, Artificial Sequence
  Description of Artificial Sequence: Synthetic oligonucleotide
uccccugccaguccucuc

SEQ ID NO: 141667 - RNA, 18 nt, Artificial Sequence
  Description of Artificial Sequence: Synthetic oligonucleotide
ccguguccccugccaguc

SEQ ID NO: 141668 - RNA, 18 nt, Artificial Sequence
  Description of Artificial Sequence: Synthetic oligonucleotide
cugccccguguccccugc

SEQ ID NO: 141669 - RNA, 18 nt, Artificial Sequence
  Description of Artificial Sequence: Synthetic oligonucleotide
cuccucugccccgugucc

SEQ ID NO: 141670 - RNA, 18 nt, Artificial Sequence
  Description of Artificial Sequence: Synthetic oligonucleotide
ugugccuccucugccccg

SEQ ID NO: 141671 - RNA, 18 nt, Artificial Sequence
  Description of Artificial Sequence: Synthetic oligonucleotide
ugggcugugccuccucug

SEQ ID NO: 141672 - RNA, 18 nt, Artificial Sequence
  Description of Artificial Sequence: Synthetic oligonucleotide
ugcacugggcugugccuc

SEQ ID NO: 141673 - RNA, 18 nt, Artificial Sequence
  Description of Artificial Sequence: Synthetic oligonucleotide
cccacugcacugggcugu

SEQ ID NO: 141674 - RNA, 18 nt, Artificial Sequence
  Description of Artificial Sequence: Synthetic oligonucleotide
ggauccccacugcacugg

SEQ ID NO: 141675 - RNA, 18 nt, Artificial Sequence
  Description of Artificial Sequence: Synthetic oligonucleotide
ggccaggauccccacugc

SEQ ID NO: 141676 - RNA, 18 nt, Artificial Sequence
  Description of Artificial Sequence: Synthetic oligonucleotide
cagagggccaggaucccc

SEQ ID NO: 141677 - RNA, 18 nt, Artificial Sequence
  Description of Artificial Sequence: Synthetic oligonucleotide
guuugcagagggccagga

SEQ ID NO: 141678 - RNA, 18 nt, Artificial Sequence
  Description of Artificial Sequence: Synthetic oligonucleotide
auggcguuugcagagggc

SEQ ID NO: 141679 - RNA, 18 nt, Artificial Sequence
  Description of Artificial Sequence: Synthetic oligonucleotide
acaugauggcguuugcag

SEQ ID NO: 141680 - RNA, 18 nt, Artificial Sequence
  Description of Artificial Sequence: Synthetic oligonucleotide
gccccacaugauggcguu

SEQ ID NO: 141681 - RNA, 18 nt, Artificial Sequence
  Description of Artificial Sequence: Synthetic oligonucleotide
ucugcgccccacaugaug

SEQ ID NO: 141682 - RNA, 18 nt, Artificial Sequence
  Description of Artificial Sequence: Synthetic oligonucleotide
gcuacucugcgccccaca

SEQ ID NO: 141683 - RNA, 18 nt, Artificial Sequence
  Description of Artificial Sequence: Synthetic oligonucleotide
acucugcuacucugcgcc

SEQ ID NO: 141684 - RNA, 18 nt, Artificial Sequence
  Description of Artificial Sequence: Synthetic oligonucleotide
ucagcacucugcuacucu

SEQ ID NO: 141685 - RNA, 18 nt, Artificial Sequence
  Description of Artificial Sequence: Synthetic oligonucleotide
guccuucagcacucugcu

SEQ ID NO: 141686 - RNA, 18 nt, Artificial Sequence
  Description of Artificial Sequence: Synthetic oligonucleotide
cuccaguccuucagcacu

SEQ ID NO: 141687 - RNA, 18 nt, Artificial Sequence
  Description of Artificial Sequence: Synthetic oligonucleotide
uccggcuccaguccuuca

SEQ ID NO: 141688 - RNA, 18 nt, Artificial Sequence
  Description of Artificial Sequence: Synthetic oligonucleotide
aggcuuccggcuccaguc

SEQ ID NO: 141689 - RNA, 18 nt, Artificial Sequence
  Description of Artificial Sequence: Synthetic oligonucleotide
aacccaggcuuccggcuc

SEQ ID NO: 141690 - RNA, 18 nt, Artificial Sequence
  Description of Artificial Sequence: Synthetic oligonucleotide
gcgugaacccaggcuucc

SEQ ID NO: 141691 - RNA, 18 nt, Artificial Sequence
  Description of Artificial Sequence: Synthetic oligonucleotide
acugggcgugaacccagg

SEQ ID NO: 141692 - RNA, 18 nt, Artificial Sequence
  Description of Artificial Sequence: Synthetic oligonucleotide
accgcacugggcgugaac

SEQ ID NO: 141693 - RNA, 18 nt, Artificial Sequence
  Description of Artificial Sequence: Synthetic oligonucleotide
uccccaccgcacugggcg

SEQ ID NO: 141694 - RNA, 18 nt, Artificial Sequence
  Description of Artificial Sequence: Synthetic oligonucleotide
gcagauccccaccgcacu

SEQ ID NO: 141695 - RNA, 18 nt, Artificial Sequence
  Description of Artificial Sequence: Synthetic oligonucleotide
gcagagcagauccccacc

SEQ ID NO: 141696 - RNA, 18 nt, Artificial Sequence
  Description of Artificial Sequence: Synthetic oligonucleotide
gaguggcagagcagaucc

SEQ ID NO: 141697 - RNA, 18 nt, Artificial Sequence
  Description of Artificial Sequence: Synthetic oligonucleotide
cuggugaguggcagagca

SEQ ID NO: 141698 - RNA, 18 nt, Artificial Sequence
  Description of Artificial Sequence: Synthetic oligonucleotide
cacugcuggugaguggca

SEQ ID NO: 141699 - RNA, 18 nt, Artificial Sequence
  Description of Artificial Sequence: Synthetic oligonucleotide
ggccccacugcuggugag

SEQ ID NO: 141700 - RNA, 18 nt, Artificial Sequence
  Description of Artificial Sequence: Synthetic oligonucleotide
cuccaggccccacugcug

SEQ ID NO: 141701 - RNA, 18 nt, Artificial Sequence
  Description of Artificial Sequence: Synthetic oligonucleotide
gcuugcuccaggccccac

SEQ ID NO: 141702 - RNA, 18 nt, Artificial Sequence
  Description of Artificial Sequence: Synthetic oligonucleotide
gugcagcuugcuccaggc

SEQ ID NO: 141703 - RNA, 18 nt, Artificial Sequence
  Description of Artificial Sequence: Synthetic oligonucleotide
aaguggugcagcuugcuc

SEQ ID NO: 141704 - RNA, 18 nt, Artificial Sequence
  Description of Artificial Sequence: Synthetic oligonucleotide
gaaggaaguggugcagcu

SEQ ID NO: 141705 - RNA, 18 nt, Artificial Sequence
  Description of Artificial Sequence: Synthetic oligonucleotide
uuacagaaggaaguggug

SEQ ID NO: 141706 - RNA, 18 nt, Artificial Sequence
  Description of Artificial Sequence: Synthetic oligonucleotide
cuguuuuacagaaggaag

SEQ ID NO: 141707 - RNA, 18 nt, Artificial Sequence
  Description of Artificial Sequence: Synthetic oligonucleotide
uuggccuguuuuacagaa

SEQ ID NO: 141708 - RNA, 18 nt, Artificial Sequence
  Description of Artificial Sequence: Synthetic oligonucleotide
auccuuuggccuguuuua

SEQ ID NO: 141709 - RNA, 18 nt, Artificial Sequence
  Description of Artificial Sequence: Synthetic oligonucleotide
cuaccauccuuuggccug

SEQ ID NO: 141710 - RNA, 18 nt, Artificial Sequence
  Description of Artificial Sequence: Synthetic oligonucleotide
aucaccuaccauccuuug

SEQ ID NO: 141711 - RNA, 18 nt, Artificial Sequence
  Description of Artificial Sequence: Synthetic oligonucleotide
uccacaucaccuaccauc

SEQ ID NO: 141712 - RNA, 18 nt, Artificial Sequence
  Description of Artificial Sequence: Synthetic oligonucleotide
ccauauccacaucaccua

SEQ ID NO: 141713 - RNA, 18 nt, Artificial Sequence
  Description of Artificial Sequence: Synthetic oligonucleotide
aaagcccauauccacauc

SEQ ID NO: 141714 - RNA, 18 nt, Artificial Sequence
  Description of Artificial Sequence: Synthetic oligonucleotide
ucacgaaagcccauaucc

SEQ ID NO: 141715 - RNA, 18 nt, Artificial Sequence
  Description of Artificial Sequence: Synthetic oligonucleotide
aauucucacgaaagccca

SEQ ID NO: 141716 - RNA, 18 nt, Artificial Sequence
  Description of Artificial Sequence: Synthetic oligonucleotide
cauuuaauucucacgaaa

SEQ ID NO: 141717 - RNA, 18 nt, Artificial Sequence
  Description of Artificial Sequence: Synthetic oligonucleotide
ccacucauuuaauucuca

SEQ ID NO: 141718 - RNA, 18 nt, Artificial Sequence
  Description of Artificial Sequence: Synthetic oligonucleotide
gaugcccacucauuuaau

SEQ ID NO: 141719 - RNA, 18 nt, Artificial Sequence
  Description of Artificial Sequence: Synthetic oligonucleotide
uuacagaugcccacucau

SEQ ID NO: 141720 - RNA, 18 nt, Artificial Sequence
  Description of Artificial Sequence: Synthetic oligonucleotide
auguguuacagaugccca

SEQ ID NO: 141721 - RNA, 18 nt, Artificial Sequence
  Description of Artificial Sequence: Synthetic oligonucleotide
augacauguguuacagau

SEQ ID NO: 141722 - RNA, 18 nt, Artificial Sequence
  Description of Artificial Sequence: Synthetic oligonucleotide
ugaugaugacauguguua

SEQ ID NO: 141723 - RNA, 18 nt, Artificial Sequence
  Description of Artificial Sequence: Synthetic oligonucleotide
aauaaugaugaugacaug

SEQ ID NO: 141724 - RNA, 18 nt, Artificial Sequence
  Description of Artificial Sequence: Synthetic oligonucleotide
auacuaauaaugaugaug

SEQ ID NO: 141725 - RNA, 18 nt, Artificial Sequence
  Description of Artificial Sequence: Synthetic oligonucleotide
ugggaauacuaauaauga

SEQ ID NO: 141726 - RNA, 18 nt, Artificial Sequence
  Description of Artificial Sequence: Synthetic oligonucleotide
aguggugggaauacuaau

SEQ ID NO: 141727 - RNA, 18 nt, Artificial Sequence
  Description of Artificial Sequence: Synthetic oligonucleotide
uuaacaguggugggaaua

SEQ ID NO: 141728 - RNA, 18 nt, Artificial Sequence
  Description of Artificial Sequence: Synthetic oligonucleotide
uuguguuaacaguggugg

SEQ ID NO: 141729 - RNA, 18 nt, Artificial Sequence
  Description of Artificial Sequence: Synthetic oligonucleotide
augccuuguguuaacagu

SEQ ID NO: 141730 - RNA, 18 nt, Artificial Sequence
  Description of Artificial Sequence: Synthetic oligonucleotide
cucagaugccuuguguua

SEQ ID NO: 141731 - RNA, 18 nt, Artificial Sequence
  Description of Artificial Sequence: Synthetic oligonucleotide
uuggucucagaugccuug

SEQ ID NO: 141732 - RNA, 18 nt, Artificial Sequence
  Description of Artificial Sequence: Synthetic oligonucleotide
ggagauuggucucagaug

SEQ ID NO: 141733 - RNA, 18 nt, Artificial Sequence
  Description of Artificial Sequence: Synthetic oligonucleotide
uuaguggagauuggucuc

SEQ ID NO: 141734 - RNA, 18 nt, Artificial Sequence
  Description of Artificial Sequence: Synthetic oligonucleotide
ugcuguuaguggagauug

SEQ ID NO: 141735 - RNA, 18 nt, Artificial Sequence
  Description of Artificial Sequence: Synthetic oligonucleotide
uagugugcuguuagugga

SEQ ID NO: 141736 - RNA, 18 nt, Artificial Sequence
  Description of Artificial Sequence: Synthetic oligonucleotide
cuuucuagugugcuguua

SEQ ID NO: 141737 - RNA, 18 nt, Artificial Sequence
  Description of Artificial Sequence: Synthetic oligonucleotide
cugaucuuucuagugugc

SEQ ID NO: 141738 - RNA, 18 nt, Artificial Sequence
  Description of Artificial Sequence: Synthetic oligonucleotide
uacagcugaucuuucuag

SEQ ID NO: 141739 - RNA, 18 nt, Artificial Sequence
  Description of Artificial Sequence: Synthetic oligonucleotide
ccagguacagcugaucuu

SEQ ID NO: 141740 - RNA, 18 nt, Artificial Sequence
  Description of Artificial Sequence: Synthetic oligonucleotide
caaucccagguacagcug

SEQ ID NO: 141741 - RNA, 18 nt, Artificial Sequence
  Description of Artificial Sequence: Synthetic oligonucleotide
cauaacaaucccagguac

SEQ ID NO: 141742 - RNA, 18 nt, Artificial Sequence
  Description of Artificial Sequence: Synthetic oligonucleotide
cugaucauaacaauccca

SEQ ID NO: 141743 - RNA, 18 nt, Artificial Sequence
  Description of Artificial Sequence: Synthetic oligonucleotide
uucgacugaucauaacaa

SEQ ID NO: 141744 - RNA, 18 nt, Artificial Sequence
  Description of Artificial Sequence: Synthetic oligonucleotide
uguguuucgacugaucau

SEQ ID NO: 141745 - RNA, 18 nt, Artificial Sequence
  Description of Artificial Sequence: Synthetic oligonucleotide
aacuguguguuucgacug

SEQ ID NO: 141746 - RNA, 18 nt, Artificial Sequence
  Description of Artificial Sequence: Synthetic oligonucleotide
aauugaacuguguguuuc

SEQ ID NO: 141747 - RNA, 18 nt, Artificial Sequence
  Description of Artificial Sequence: Synthetic oligonucleotide
agaccaauugaacugugu

SEQ ID NO: 141748 - RNA, 18 nt, Artificial Sequence
  Description of Artificial Sequence: Synthetic oligonucleotide
uuaccagaccaauugaac

SEQ ID NO: 141749 - RNA, 18 nt, Artificial Sequence
  Description of Artificial Sequence: Synthetic oligonucleotide
aauuauuaccagaccaau

SEQ ID NO: 141750 - RNA, 18 nt, Artificial Sequence
  Description of Artificial Sequence: Synthetic oligonucleotide
uguauaauuauuaccaga

SEQ ID NO: 141751 - RNA, 18 nt, Artificial Sequence
  Description of Artificial Sequence: Synthetic oligonucleotide
ugauguguauaauuauua

SEQ ID NO: 141752 - RNA, 18 nt, Artificial Sequence
  Description of Artificial Sequence: Synthetic oligonucleotide
aaugaugauguguauaau

SEQ ID NO: 141753 - RNA, 18 nt, Artificial Sequence
  Description of Artificial Sequence: Synthetic oligonucleotide
ggcucaaugaugaugugu

SEQ ID NO: 141754 - RNA, 18 nt, Artificial Sequence
  Description of Artificial Sequence: Synthetic oligonucleotide
gauacggcucaaugauga

SEQ ID NO: 141755 - RNA, 18 nt, Artificial Sequence
  Description of Artificial Sequence: Synthetic oligonucleotide
auuaugauacggcucaau

SEQ ID NO: 141756 - RNA, 18 nt, Artificial Sequence
  Description of Artificial Sequence: Synthetic oligonucleotide
aucuaauuaugauacggc

SEQ ID NO: 141757 - RNA, 18 nt, Artificial Sequence
  Description of Artificial Sequence: Synthetic oligonucleotide
uuuuuaucuaauuaugau

SEQ ID NO: 141758 - RNA, 18 nt, Artificial Sequence
  Description of Artificial Sequence: Synthetic oligonucleotide
uagcauuuuuaucuaauu

SEQ ID NO: 141759 - RNA, 18 nt, Artificial Sequence
  Description of Artificial Sequence: Synthetic oligonucleotide
cugcuuagcauuuuuauc

SEQ ID NO: 141760 - RNA, 18 nt, Artificial Sequence
  Description of Artificial Sequence: Synthetic oligonucleotide
acuaacugcuuagcauuu

SEQ ID NO: 141761 - RNA, 18 nt, Artificial Sequence
  Description of Artificial Sequence: Synthetic oligonucleotide
uucauacuaacugcuuag

SEQ ID NO: 141762 - RNA, 18 nt, Artificial Sequence
  Description of Artificial Sequence: Synthetic oligonucleotide
aguuauucauacuaacug

SEQ ID NO: 141763 - RNA, 18 nt, Artificial Sequence
  Description of Artificial Sequence: Synthetic oligonucleotide
aguugaguuauucauacu

SEQ ID NO: 141764 - RNA, 18 nt, Artificial Sequence
  Description of Artificial Sequence: Synthetic oligonucleotide
auauuaguugaguuauuc

SEQ ID NO: 141765 - RNA, 18 nt, Artificial Sequence
  Description of Artificial Sequence: Synthetic oligonucleotide
cacaggaaguucuauucu

SEQ ID NO: 141766 - RNA, 18 nt, Artificial Sequence
  Description of Artificial Sequence: Synthetic oligonucleotide
ucccccacaggaaguucu

SEQ ID NO: 141767 - RNA, 18 nt, Artificial Sequence
  Description of Artificial Sequence: Synthetic oligonucleotide
caccaucccccacaggaa

SEQ ID NO: 141768 - RNA, 18 nt, Artificial Sequence
  Description of Artificial Sequence: Synthetic oligonucleotide
cuccccaccaucccccac

SEQ ID NO: 141769 - RNA, 18 nt, Artificial Sequence
  Description of Artificial Sequence: Synthetic oligonucleotide
cuagccuccccaccaucc

SEQ ID NO: 141770 - RNA, 18 nt, Artificial Sequence
  Description of Artificial Sequence: Synthetic oligonucleotide
cagagcuagccuccccac

SEQ ID NO: 141771 - RNA, 18 nt, Artificial Sequence
  Description of Artificial Sequence: Synthetic oligonucleotide
cucugcagagcuagccuc

SEQ ID NO: 141772 - RNA, 18 nt, Artificial Sequence
  Description of Artificial Sequence: Synthetic oligonucleotide
uagaccucugcagagcua

SEQ ID NO: 141773 - RNA, 18 nt, Artificial Sequence
  Description of Artificial Sequence: Synthetic oligonucleotide
gacuguagaccucugcag

SEQ ID NO: 141774 - RNA, 18 nt, Artificial Sequence
  Description of Artificial Sequence: Synthetic oligonucleotide
ugcaggacuguagaccuc

SEQ ID NO: 141775 - RNA, 18 nt, Artificial Sequence
  Description of Artificial Sequence: Synthetic oligonucleotide
gaaacugcaggacuguag

SEQ ID NO: 141776 - RNA, 18 nt, Artificial Sequence
  Description of Artificial Sequence: Synthetic oligonucleotide
uugcagaaacugcaggac

SEQ ID NO: 141777 - RNA, 18 nt, Artificial Sequence
  Description of Artificial Sequence: Synthetic oligonucleotide
guguuuugcagaaacugc

SEQ ID NO: 141778 - RNA, 18 nt, Artificial Sequence
  Description of Artificial Sequence: Synthetic oligonucleotide
gcaacguguuuugcagaa

SEQ ID NO: 141779 - RNA, 18 nt, Artificial Sequence
  Description of Artificial Sequence: Synthetic oligonucleotide
ugugugcaacguguuuug

SEQ ID NO: 141780 - RNA, 18 nt, Artificial Sequence
  Description of Artificial Sequence: Synthetic oligonucleotide
ggagaugugugcaacgug

SEQ ID NO: 141781 - RNA, 18 nt, Artificial Sequence
  Description of Artificial Sequence: Synthetic oligonucleotide
cauauggagaugugugca

SEQ ID NO: 141782 - RNA, 18 nt, Artificial Sequence
  Description of Artificial Sequence: Synthetic oligonucleotide
uggcccauauggagaugu

SEQ ID NO: 141783 - RNA, 18 nt, Artificial Sequence
  Description of Artificial Sequence: Synthetic oligonucleotide
ccguguggcccauaugga

SEQ ID NO: 141784 - RNA, 18 nt, Artificial Sequence
  Description of Artificial Sequence: Synthetic oligonucleotide
ugccaccguguggcccau

SEQ ID NO: 141785 - RNA, 18 nt, Artificial Sequence
  Description of Artificial Sequence: Synthetic oligonucleotide
gagguugccaccgugugg

SEQ ID NO: 141786 - RNA, 18 nt, Artificial Sequence
  Description of Artificial Sequence: Synthetic oligonucleotide
guucagagguugccaccg

SEQ ID NO: 141787 - RNA, 18 nt, Artificial Sequence
  Description of Artificial Sequence: Synthetic oligonucleotide
uccugguucagagguugc

SEQ ID NO: 141788 - RNA, 18 nt, Artificial Sequence
  Description of Artificial Sequence: Synthetic oligonucleotide
agcucuccugguucagag

SEQ ID NO: 141789 - RNA, 18 nt, Artificial Sequence
  Description of Artificial Sequence: Synthetic oligonucleotide
gaagcagcucuccugguu

SEQ ID NO: 141790 - RNA, 18 nt, Artificial Sequence
  Description of Artificial Sequence: Synthetic oligonucleotide
cuuaggaagcagcucucc

SEQ ID NO: 141791 - RNA, 18 nt, Artificial Sequence
  Description of Artificial Sequence: Synthetic oligonucleotide
uagcccuuaggaagcagc

SEQ ID NO: 141792 - RNA, 18 nt, Artificial Sequence
  Description of Artificial Sequence: Synthetic oligonucleotide
ggucuuagcccuuaggaa

SEQ ID NO: 141793 - RNA, 18 nt, Artificial Sequence
  Description of Artificial Sequence: Synthetic oligonucleotide
cagagggucuuagcccuu

SEQ ID NO: 141794 - RNA, 18 nt, Artificial Sequence
  Description of Artificial Sequence: Synthetic oligonucleotide
gcagacagagggucuuag

SEQ ID NO: 141795 - RNA, 18 nt, Artificial Sequence
  Description of Artificial Sequence: Synthetic oligonucleotide
agaaagcagacagagggu

SEQ ID NO: 141796 - RNA, 18 nt, Artificial Sequence
  Description of Artificial Sequence: Synthetic oligonucleotide
gagagagaaagcagacag

SEQ ID NO: 141797 - RNA, 18 nt, Artificial Sequence
  Description of Artificial Sequence: Synthetic oligonucleotide
agcaagagagagaaagca

SEQ ID NO: 141798 - RNA, 18 nt, Artificial Sequence
  Description of Artificial Sequence: Synthetic oligonucleotide
aggaaagcaagagagaga

SEQ ID NO: 141799 - RNA, 18 nt, Artificial Sequence
  Description of Artificial Sequence: Synthetic oligonucleotide
uugggaggaaagcaagag

SEQ ID NO: 141800 - RNA, 18 nt, Artificial Sequence
  Description of Artificial Sequence: Synthetic oligonucleotide
guguuuugggaggaaagc

SEQ ID NO: 141801 - RNA, 18 nt, Artificial Sequence
  Description of Artificial Sequence: Synthetic oligonucleotide
uggcuguguuuugggagg

SEQ ID NO: 141802 - RNA, 18 nt, Artificial Sequence
  Description of Artificial Sequence: Synthetic oligonucleotide
gaggauggcuguguuuug

SEQ ID NO: 141803 - RNA, 18 nt, Artificial Sequence
  Description of Artificial Sequence: Synthetic oligonucleotide
gggaggaggauggcugug

SEQ ID NO: 141804 - RNA, 18 nt, Artificial Sequence
  Description of Artificial Sequence: Synthetic oligonucleotide
ggcugaacucaccauggg

SEQ ID NO: 141805 - RNA, 18 nt, Artificial Sequence
  Description of Artificial Sequence: Synthetic oligonucleotide
ugggcugaacucaccaug

SEQ ID NO: 141806 - RNA, 18 nt, Artificial Sequence
  Description of Artificial Sequence: Synthetic oligonucleotide
cuuccugggcugaacuca

SEQ ID NO: 141807 - RNA, 18 nt, Artificial Sequence
  Description of Artificial Sequence: Synthetic oligonucleotide
agaggcuuccugggcuga

SEQ ID NO: 141808 - RNA, 18 nt, Artificial Sequence
  Description of Artificial Sequence: Synthetic oligonucleotide
gggucagaggcuuccugg

SEQ ID NO: 141809 - RNA, 18 nt, Artificial Sequence
  Description of Artificial Sequence: Synthetic oligonucleotide
gggcugggucagaggcuu

SEQ ID NO: 141810 - RNA, 18 nt, Artificial Sequence
  Description of Artificial Sequence: Synthetic oligonucleotide
caucagggcugggucaga

SEQ ID NO: 141811 - RNA, 18 nt, Artificial Sequence
  Description of Artificial Sequence: Synthetic oligonucleotide
auuaccaucagggcuggg

SEQ ID NO: 141812 - RNA, 18 nt, Artificial Sequence
  Description of Artificial Sequence: Synthetic oligonucleotide
cagcuauuaccaucaggg

SEQ ID NO: 141813 - RNA, 18 nt, Artificial Sequence
  Description of Artificial Sequence: Synthetic oligonucleotide
cacagcagcuauuaccau

SEQ ID NO: 141814 - RNA, 18 nt, Artificial Sequence
  Description of Artificial Sequence: Synthetic oligonucleotide
caguacacagcagcuauu

SEQ ID NO: 141815 - RNA, 18 nt, Artificial Sequence
  Description of Artificial Sequence: Synthetic oligonucleotide
auguccaguacacagcag

SEQ ID NO: 141816 - RNA, 18 nt, Artificial Sequence
  Description of Artificial Sequence: Synthetic oligonucleotide
agaagauguccaguacac

SEQ ID NO: 141817 - RNA, 18 nt, Artificial Sequence
  Description of Artificial Sequence: Synthetic oligonucleotide
cauacagaagauguccag

SEQ ID NO: 141818 - RNA, 18 nt, Artificial Sequence
  Description of Artificial Sequence: Synthetic oligonucleotide
ccuaacauacagaagaug

SEQ ID NO: 141819 - RNA, 18 nt, Artificial Sequence
  Description of Artificial Sequence: Synthetic oligonucleotide
cagagccuaacauacaga

SEQ ID NO: 141820 - RNA, 18 nt, Artificial Sequence
  Description of Artificial Sequence: Synthetic oligonucleotide
ucucccagagccuaacau

SEQ ID NO: 141821 - RNA, 18 nt, Artificial Sequence
  Description of Artificial Sequence: Synthetic oligonucleotide
gcauuucucccagagccu

SEQ ID NO: 141822 - RNA, 18 nt, Artificial Sequence
  Description of Artificial Sequence: Synthetic oligonucleotide
ccacagcauuucucccag

SEQ ID NO: 141823 - RNA, 18 nt, Artificial Sequence
  Description of Artificial Sequence: Synthetic oligonucleotide
agucuccacagcauuucu

SEQ ID NO: 141824 - RNA, 18 nt, Artificial Sequence
  Description of Artificial Sequence: Synthetic oligonucleotide
caaaaagucuccacagca

SEQ ID NO: 141825 - RNA, 18 nt, Artificial Sequence
  Description of Artificial Sequence: Synthetic oligonucleotide
augggcaaaaagucucca

SEQ ID NO: 141826 - RNA, 18 nt, Artificial Sequence
  Description of Artificial Sequence: Synthetic oligonucleotide
ggaggaugggcaaaaagu

SEQ ID NO: 141827 - RNA, 18 nt, Artificial Sequence
  Description of Artificial Sequence: Synthetic oligonucleotide
cucugggaggaugggcaa

SEQ ID NO: 141828 - RNA, 18 nt, Artificial Sequence
  Description of Artificial Sequence: Synthetic oligonucleotide
agcuucucugggaggaug

SEQ ID NO: 141829 - RNA, 18 nt, Artificial Sequence
  Description of Artificial Sequence: Synthetic oligonucleotide
cugacagcuucucuggga

SEQ ID NO: 141830 - RNA, 18 nt, Artificial Sequence
  Description of Artificial Sequence: Synthetic oligonucleotide
ggguacugacagcuucuc

SEQ ID NO: 141831 - RNA, 18 nt, Artificial Sequence
  Description of Artificial Sequence: Synthetic oligonucleotide
ucuucaccuagaacaggg

SEQ ID NO: 141832 - RNA, 18 nt, Artificial Sequence
  Description of Artificial Sequence: Synthetic oligonucleotide
guuucuucaccuagaaca

SEQ ID NO: 141833 - RNA, 18 nt, Artificial Sequence
  Description of Artificial Sequence: Synthetic oligonucleotide
gaccaguuucuucaccua

SEQ ID NO: 141834 - RNA, 18 nt, Artificial Sequence
  Description of Artificial Sequence: Synthetic oligonucleotide
cugaggaccaguuucuuc

SEQ ID NO: 141835 - RNA, 18 nt, Artificial Sequence
  Description of Artificial Sequence: Synthetic oligonucleotide
ccuuucugaggaccaguu

SEQ ID NO: 141836 - RNA, 18 nt, Artificial Sequence
  Description of Artificial Sequence: Synthetic oligonucleotide
gucaaccuuucugaggac

SEQ ID NO: 141837 - RNA, 18 nt, Artificial Sequence
  Description of Artificial Sequence: Synthetic oligonucleotide
agggagucaaccuuucug

SEQ ID NO: 141838 - RNA, 18 nt, Artificial Sequence
  Description of Artificial Sequence: Synthetic oligonucleotide
gccucagggagucaaccu

SEQ ID NO: 141839 - RNA, 18 nt, Artificial Sequence
  Description of Artificial Sequence: Synthetic oligonucleotide
guguggccucagggaguc

SEQ ID NO: 141840 - RNA, 18 nt, Artificial Sequence
  Description of Artificial Sequence: Synthetic oligonucleotide
cagcuguguggccucagg

SEQ ID NO: 141841 - RNA, 18 nt, Artificial Sequence
  Description of Artificial Sequence: Synthetic oligonucleotide
cuuaacagcuguguggcc

SEQ ID NO: 141842 - RNA, 18 nt, Artificial Sequence
  Description of Artificial Sequence: Synthetic oligonucleotide
agccacuuaacagcugug

SEQ ID NO: 141843 - RNA, 18 nt, Artificial Sequence
  Description of Artificial Sequence: Synthetic oligonucleotide
gccucagccacuuaacag

SEQ ID NO: 141844 - RNA, 18 nt, Artificial Sequence
  Description of Artificial Sequence: Synthetic oligonucleotide
cccucgccucagccacuu

SEQ ID NO: 141845 - RNA, 18 nt, Artificial Sequence
  Description of Artificial Sequence: Synthetic oligonucleotide
cacagcccucgccucagc

SEQ ID NO: 141846 - RNA, 18 nt, Artificial Sequence
  Description of Artificial Sequence: Synthetic oligonucleotide
agccccacagcccucgcc

SEQ ID NO: 141847 - RNA, 18 nt, Artificial Sequence
  Description of Artificial Sequence: Synthetic oligonucleotide
ggaacagccccacagccc

SEQ ID NO: 141848 - RNA, 18 nt, Artificial Sequence
  Description of Artificial Sequence: Synthetic oligonucleotide
gcgugggaacagccccac

SEQ ID NO: 141849 - RNA, 18 nt, Artificial Sequence
  Description of Artificial Sequence: Synthetic oligonucleotide
ccagggcgugggaacagc

SEQ ID NO: 141850 - RNA, 18 nt, Artificial Sequence
  Description of Artificial Sequence: Synthetic oligonucleotide
ggaagccagggcguggga

SEQ ID NO: 141851 - RNA, 18 nt, Artificial Sequence
  Description of Artificial Sequence: Synthetic oligonucleotide
ggccuggaagccagggcg

SEQ ID NO: 141852 - RNA, 18 nt, Artificial Sequence
  Description of Artificial Sequence: Synthetic oligonucleotide
ugccaggccuggaagcca

SEQ ID NO: 141853 - RNA, 18 nt, Artificial Sequence
  Description of Artificial Sequence: Synthetic oligonucleotide
caugcugccaggccugga

SEQ ID NO: 141854 - RNA, 18 nt, Artificial Sequence
  Description of Artificial Sequence: Synthetic oligonucleotide
cuccacaugcugccaggc

SEQ ID NO: 141855 - RNA, 18 nt, Artificial Sequence
  Description of Artificial Sequence: Synthetic oligonucleotide
ggcagcuccacaugcugc

SEQ ID NO: 141856 - RNA, 18 nt, Artificial Sequence
  Description of Artificial Sequence: Synthetic oligonucleotide
gaggagcuccgggagagg

SEQ ID NO: 141857 - RNA, 18 nt, Artificial Sequence
  Description of Artificial Sequence: Synthetic oligonucleotide
guggcgaggagcuccggg

SEQ ID NO: 141858 - RNA, 18 nt, Artificial Sequence
  Description of Artificial Sequence: Synthetic oligonucleotide
ugaggguggcgaggagcu

SEQ ID NO: 141859 - RNA, 18 nt, Artificial Sequence
  Description of Artificial Sequence: Synthetic oligonucleotide
agcagugaggguggcgag

SEQ ID NO: 141860 - RNA, 18 nt, Artificial Sequence
  Description of Artificial Sequence: Synthetic oligonucleotide
gguccagcagugagggug

SEQ ID NO: 141861 - RNA, 18 nt, Artificial Sequence
  Description of Artificial Sequence: Synthetic oligonucleotide
caguugguccagcaguga

SEQ ID NO: 141862 - RNA, 18 nt, Artificial Sequence
  Description of Artificial Sequence: Synthetic oligonucleotide
aucugcaguugguccagc

SEQ ID NO: 141863 - RNA, 18 nt, Artificial Sequence
  Description of Artificial Sequence: Synthetic oligonucleotide
agcccaucugcaguuggu

SEQ ID NO: 141864 - RNA, 18 nt, Artificial Sequence
  Description of Artificial Sequence: Synthetic oligonucleotide
gucacagcccaucugcag

SEQ ID NO: 141865 - RNA, 18 nt, Artificial Sequence
  Description of Artificial Sequence: Synthetic oligonucleotide
gccccgucacagcccauc

SEQ ID NO: 141866 - RNA, 18 nt, Artificial Sequence
  Description of Artificial Sequence: Synthetic oligonucleotide
augaggccccgucacagc

SEQ ID NO: 141867 - RNA, 18 nt, Artificial Sequence
  Description of Artificial Sequence: Synthetic oligonucleotide
gccgcaugaggccccguc

SEQ ID NO: 141868 - RNA, 18 nt, Artificial Sequence
  Description of Artificial Sequence: Synthetic oligonucleotide
aggcugccgcaugaggcc

SEQ ID NO: 141869 - RNA, 18 nt, Artificial Sequence
  Description of Artificial Sequence: Synthetic oligonucleotide
uguugaggcugccgcaug

SEQ ID NO: 141870 - RNA, 18 nt, Artificial Sequence
  Description of Artificial Sequence: Synthetic oligonucleotide
cuccauguugaggcugcc

SEQ ID NO: 141871 - RNA, 18 nt, Artificial Sequence
  Description of Artificial Sequence: Synthetic oligonucleotide
cggcacuccauguugagg

SEQ ID NO: 141872 - RNA, 18 nt, Artificial Sequence
  Description of Artificial Sequence: Synthetic oligonucleotide
acacccggcacuccaugu

SEQ ID NO: 141873 - RNA, 18 nt, Artificial Sequence
  Description of Artificial Sequence: Synthetic oligonucleotide
cccgcacacccggcacuc

SEQ ID NO: 141874 - RNA, 18 nt, Artificial Sequence
  Description of Artificial Sequence: Synthetic oligonucleotide
uuguccccgcacacccgg

SEQ ID NO: 141875 - RNA, 18 nt, Artificial Sequence
  Description of Artificial Sequence: Synthetic oligonucleotide
augccuuguccccgcaca

SEQ ID NO: 141876 - RNA, 18 nt, Artificial Sequence
  Description of Artificial Sequence: Synthetic oligonucleotide
gcccgaugccuugucccc

SEQ ID NO: 141877 - RNA, 18 nt, Artificial Sequence
  Description of Artificial Sequence: Synthetic oligonucleotide
uggaagcccgaugccuug

SEQ ID NO: 141878 - RNA, 18 nt, Artificial Sequence
  Description of Artificial Sequence: Synthetic oligonucleotide
cguaguggaagcccgaug

SEQ ID NO: 141879 - RNA, 18 nt, Artificial Sequence
  Description of Artificial Sequence: Synthetic oligonucleotide
aacaccguaguggaagcc

SEQ ID NO: 141880 - RNA, 18 nt, Artificial Sequence
  Description of Artificial Sequence: Synthetic oligonucleotide
gcaugaacaccguagugg

SEQ ID NO: 141881 - RNA, 18 nt, Artificial Sequence
  Description of Artificial Sequence: Synthetic oligonucleotide
cacaugcaugaacaccgu

SEQ ID NO: 141882 - RNA, 18 nt, Artificial Sequence
  Description of Artificial Sequence: Synthetic oligonucleotide
ccccucacaugcaugaac

SEQ ID NO: 141883 - RNA, 18 nt, Artificial Sequence
  Description of Artificial Sequence: Synthetic oligonucleotide
uugcaccccucacaugca

SEQ ID NO: 141884 - RNA, 18 nt, Artificial Sequence
  Description of Artificial Sequence: Synthetic oligonucleotide
ggcgaggagcuccgggag

SEQ ID NO: 141885 - RNA, 18 nt, Artificial Sequence
  Description of Artificial Sequence: Synthetic oligonucleotide
aggguggcgaggagcucc

SEQ ID NO: 141886 - RNA, 18 nt, Artificial Sequence
  Description of Artificial Sequence: Synthetic oligonucleotide
cagugaggguggcgagga

SEQ ID NO: 141887 - RNA, 18 nt, Artificial Sequence
  Description of Artificial Sequence: Synthetic oligonucleotide
uccagcagugaggguggc

SEQ ID NO: 141888 - RNA, 18 nt, Artificial Sequence
  Description of Artificial Sequence: Synthetic oligonucleotide
guugguccagcagugagg

SEQ ID NO: 141889 - RNA, 18 nt, Artificial Sequence
  Description of Artificial Sequence: Synthetic oligonucleotide
cugcaguugguccagcag

SEQ ID NO: 141890 - RNA, 18 nt, Artificial Sequence
  Description of Artificial Sequence: Synthetic oligonucleotide
cccaucugcaguuggucc

SEQ ID NO: 141891 - RNA, 18 nt, Artificial Sequence
  Description of Artificial Sequence: Synthetic oligonucleotide
cacagcccaucugcaguu

SEQ ID NO: 141892 - RNA, 18 nt, Artificial Sequence
  Description of Artificial Sequence: Synthetic oligonucleotide
cccgucacagcccaucug

SEQ ID NO: 141893 - RNA, 18 nt, Artificial Sequence
  Description of Artificial Sequence: Synthetic oligonucleotide
gaggccccgucacagccc

SEQ ID NO: 141894 - RNA, 18 nt, Artificial Sequence
  Description of Artificial Sequence: Synthetic oligonucleotide
cgcaugaggccccgucac

SEQ ID NO: 141895 - RNA, 18 nt, Artificial Sequence
  Description of Artificial Sequence: Synthetic oligonucleotide
gcugccgcaugaggcccc

SEQ ID NO: 141896 - RNA, 18 nt, Artificial Sequence
  Description of Artificial Sequence: Synthetic oligonucleotide
uugaggcugccgcaugag

SEQ ID NO: 141897 - RNA, 18 nt, Artificial Sequence
  Description of Artificial Sequence: Synthetic oligonucleotide
ccauguugaggcugccgc

SEQ ID NO: 141898 - RNA, 18 nt, Artificial Sequence
  Description of Artificial Sequence: Synthetic oligonucleotide
gcacuccauguugaggcu

SEQ ID NO: 141899 - RNA, 18 nt, Artificial Sequence
  Description of Artificial Sequence: Synthetic oligonucleotide
acccggcacuccauguug

SEQ ID NO: 141900 - RNA, 18 nt, Artificial Sequence
  Description of Artificial Sequence: Synthetic oligonucleotide
cgcacacccggcacucca

SEQ ID NO: 141901 - RNA, 18 nt, Artificial Sequence
  Description of Artificial Sequence: Synthetic oligonucleotide
guccccgcacacccggca

SEQ ID NO: 141902 - RNA, 18 nt, Artificial Sequence
  Description of Artificial Sequence: Synthetic oligonucleotide
gccuuguccccgcacacc

SEQ ID NO: 141903 - RNA, 18 nt, Artificial Sequence
  Description of Artificial Sequence: Synthetic oligonucleotide
ccgaugccuuguccccgc

SEQ ID NO: 141904 - RNA, 18 nt, Artificial Sequence
  Description of Artificial Sequence: Synthetic oligonucleotide
gaagcccgaugccuuguc

SEQ ID NO: 141905 - RNA, 18 nt, Artificial Sequence
  Description of Artificial Sequence: Synthetic oligonucleotide
uaguggaagcccgaugcc

SEQ ID NO: 141906 - RNA, 18 nt, Artificial Sequence
  Description of Artificial Sequence: Synthetic oligonucleotide
caccguaguggaagcccg

SEQ ID NO: 141907 - RNA, 18 nt, Artificial Sequence
  Description of Artificial Sequence: Synthetic oligonucleotide
augaacaccguaguggaa

SEQ ID NO: 141908 - RNA, 18 nt, Artificial Sequence
  Description of Artificial Sequence: Synthetic oligonucleotide
caugcaugaacaccguag

SEQ ID NO: 141909 - RNA, 18 nt, Artificial Sequence
  Description of Artificial Sequence: Synthetic oligonucleotide
ccucacaugcaugaacac

SEQ ID NO: 141910 - RNA, 18 nt, Artificial Sequence
  Description of Artificial Sequence: Synthetic oligonucleotide
gcaccccucacaugcaug

SEQ ID NO: 141911 - RNA, 18 nt, Artificial Sequence
  Description of Artificial Sequence: Synthetic oligonucleotide
ccaccgcuccccccaguc

SEQ ID NO: 141912 - RNA, 18 nt, Artificial Sequence
  Description of Artificial Sequence: Synthetic oligonucleotide
gccagccaccgcuccccc

SEQ ID NO: 141913 - RNA, 18 nt, Artificial Sequence
  Description of Artificial Sequence: Synthetic oligonucleotide
caguggccagccaccgcu

SEQ ID NO: 141914 - RNA, 18 nt, Artificial Sequence
  Description of Artificial Sequence: Synthetic oligonucleotide
agccucaguggccagcca

SEQ ID NO: 141915 - RNA, 18 nt, Artificial Sequence
  Description of Artificial Sequence: Synthetic oligonucleotide
accacagccucaguggcc

SEQ ID NO: 141916 - RNA, 18 nt, Artificial Sequence
  Description of Artificial Sequence: Synthetic oligonucleotide
augugaccacagccucag

SEQ ID NO: 141917 - RNA, 18 nt, Artificial Sequence
  Description of Artificial Sequence: Synthetic oligonucleotide
ucaccaugugaccacagc

SEQ ID NO: 141918 - RNA, 18 nt, Artificial Sequence
  Description of Artificial Sequence: Synthetic oligonucleotide
ucaauucaccaugugacc

SEQ ID NO: 141919 - RNA, 18 nt, Artificial Sequence
  Description of Artificial Sequence: Synthetic oligonucleotide
gagggucaauucaccaug

SEQ ID NO: 141920 - RNA, 18 nt, Artificial Sequence
  Description of Artificial Sequence: Synthetic oligonucleotide
uuguggagggucaauuca

SEQ ID NO: 141921 - RNA, 18 nt, Artificial Sequence
  Description of Artificial Sequence: Synthetic oligonucleotide
aagcuuuguggaggguca

SEQ ID NO: 141922 - RNA, 18 nt, Artificial Sequence
  Description of Artificial Sequence: Synthetic oligonucleotide
aaggaaagcuuuguggag

SEQ ID NO: 141923 - RNA, 18 nt, Artificial Sequence
  Description of Artificial Sequence: Synthetic oligonucleotide
aaggcaaggaaagcuuug

SEQ ID NO: 141924 - RNA, 18 nt, Artificial Sequence
  Description of Artificial Sequence: Synthetic oligonucleotide
accccaaggcaaggaaag

SEQ ID NO: 141925 - RNA, 18 nt, Artificial Sequence
  Description of Artificial Sequence: Synthetic oligonucleotide
gccccaccccaaggcaag

SEQ ID NO: 141926 - RNA, 18 nt, Artificial Sequence
  Description of Artificial Sequence: Synthetic oligonucleotide
ucagggccccaccccaag

SEQ ID NO: 141927 - RNA, 18 nt, Artificial Sequence
  Description of Artificial Sequence: Synthetic oligonucleotide
uacagucagggccccacc

SEQ ID NO: 141928 - RNA, 18 nt, Artificial Sequence
  Description of Artificial Sequence: Synthetic oligonucleotide
auagguacagucagggcc

SEQ ID NO: 141929 - RNA, 18 nt, Artificial Sequence
  Description of Artificial Sequence: Synthetic oligonucleotide
cugcaauagguacaguca

SEQ ID NO: 141930 - RNA, 18 nt, Artificial Sequence
  Description of Artificial Sequence: Synthetic oligonucleotide
gaauucugcaauagguac

SEQ ID NO: 141931 - RNA, 18 nt, Artificial Sequence
  Description of Artificial Sequence: Synthetic oligonucleotide
ggcaggaauucugcaaua

SEQ ID NO: 141932 - RNA, 18 nt, Artificial Sequence
  Description of Artificial Sequence: Synthetic oligonucleotide
uccugggcaggaauucug

SEQ ID NO: 141933 - RNA, 18 nt, Artificial Sequence
  Description of Artificial Sequence: Synthetic oligonucleotide
cugccuccugggcaggaa

SEQ ID NO: 141934 - RNA, 18 nt, Artificial Sequence
  Description of Artificial Sequence: Synthetic oligonucleotide
ccuggcugccuccugggc

SEQ ID NO: 141935 - RNA, 18 nt, Artificial Sequence
  Description of Artificial Sequence: Synthetic oligonucleotide
aagggccuggcugccucc

SEQ ID NO: 141936 - RNA, 18 nt, Artificial Sequence
  Description of Artificial Sequence: Synthetic oligonucleotide
agcacaagggccuggcug

SEQ ID NO: 141937 - RNA, 18 nt, Artificial Sequence
  Description of Artificial Sequence: Synthetic oligonucleotide
ucuggagcacaagggccu

SEQ ID NO: 141938 - RNA, 18 nt, Artificial Sequence
  Description of Artificial Sequence: Synthetic oligonucleotide
ugaggucuggagcacaag

SEQ ID NO: 141939 - RNA, 18 nt, Artificial Sequence
  Description of Artificial Sequence: Synthetic oligonucleotide
agagcugaggucuggagc

SEQ ID NO: 141940 - RNA, 18 nt, Artificial Sequence
  Description of Artificial Sequence: Synthetic oligonucleotide
ugcccagagcugaggucu

SEQ ID NO: 141941 - RNA, 18 nt, Artificial Sequence
  Description of Artificial Sequence: Synthetic oligonucleotide
ugcagugcccagagcuga

SEQ ID NO: 141942 - RNA, 18 nt, Artificial Sequence
  Description of Artificial Sequence: Synthetic oligonucleotide
ucuccugcagugcccaga

SEQ ID NO: 141943 - RNA, 18 nt, Artificial Sequence
  Description of Artificial Sequence: Synthetic oligonucleotide
ccucuucuccugcagugc

SEQ ID NO: 141944 - RNA, 18 nt, Artificial Sequence
  Description of Artificial Sequence: Synthetic oligonucleotide
aacccccucuucuccugc

SEQ ID NO: 141945 - RNA, 18 nt, Artificial Sequence
  Description of Artificial Sequence: Synthetic oligonucleotide
aagggaacccccucuucu

SEQ ID NO: 141946 - RNA, 18 nt, Artificial Sequence
  Description of Artificial Sequence: Synthetic oligonucleotide
uugacaagggaacccccu

SEQ ID NO: 141947 - RNA, 18 nt, Artificial Sequence
  Description of Artificial Sequence: Synthetic oligonucleotide
uaggcuugacaagggaac

SEQ ID NO: 141948 - RNA, 18 nt, Artificial Sequence
  Description of Artificial Sequence: Synthetic oligonucleotide
caggguaggcuugacaag

SEQ ID NO: 141949 - RNA, 18 nt, Artificial Sequence
  Description of Artificial Sequence: Synthetic oligonucleotide
cccagcaggguaggcuug

SEQ ID NO: 141950 - RNA, 18 nt, Artificial Sequence
  Description of Artificial Sequence: Synthetic oligonucleotide
aggugcccagcaggguag

SEQ ID NO: 141951 - RNA, 18 nt, Artificial Sequence
  Description of Artificial Sequence: Synthetic oligonucleotide
aacacaggugcccagcag

SEQ ID NO: 141952 - RNA, 18 nt, Artificial Sequence
  Description of Artificial Sequence: Synthetic oligonucleotide
gggucaacacaggugccc

SEQ ID NO: 141953 - RNA, 18 nt, Artificial Sequence
  Description of Artificial Sequence: Synthetic oligonucleotide
gagcugggucaacacagg

SEQ ID NO: 141954 - RNA, 18 nt, Artificial Sequence
  Description of Artificial Sequence: Synthetic oligonucleotide
ccacagagcugggucaac

SEQ ID NO: 141955 - RNA, 18 nt, Artificial Sequence
  Description of Artificial Sequence: Synthetic oligonucleotide
aucacccacagagcuggg

SEQ ID NO: 141956 - RNA, 18 nt, Artificial Sequence
  Description of Artificial Sequence: Synthetic oligonucleotide
acacaaucacccacagag

SEQ ID NO: 141957 - RNA, 18 nt, Artificial Sequence
  Description of Artificial Sequence: Synthetic oligonucleotide
gggacacaaucacccaca

SEQ ID NO: 141958 - RNA, 18 nt, Artificial Sequence
  Description of Artificial Sequence: Synthetic oligonucleotide
gcugccugguccccaggg

SEQ ID NO: 141959 - RNA, 18 nt, Artificial Sequence
  Description of Artificial Sequence: Synthetic oligonucleotide
cccuagcugccugguccc

SEQ ID NO: 141960 - RNA, 18 nt, Artificial Sequence
  Description of Artificial Sequence: Synthetic oligonucleotide
uucugcccuagcugccug

SEQ ID NO: 141961 - RNA, 18 nt, Artificial Sequence
  Description of Artificial Sequence: Synthetic oligonucleotide
ccucauucugcccuagcu

SEQ ID NO: 141962 - RNA, 18 nt, Artificial Sequence
  Description of Artificial Sequence: Synthetic oligonucleotide
aagacccucauucugccc

SEQ ID NO: 141963 - RNA, 18 nt, Artificial Sequence
  Description of Artificial Sequence: Synthetic oligonucleotide
agcccaagacccucauuc

SEQ ID NO: 141964 - RNA, 18 nt, Artificial Sequence
  Description of Artificial Sequence: Synthetic oligonucleotide
ggcucagcccaagacccu

SEQ ID NO: 141965 - RNA, 18 nt, Artificial Sequence
  Description of Artificial Sequence: Synthetic oligonucleotide
acgauggcucagcccaag

SEQ ID NO: 141966 - RNA, 18 nt, Artificial Sequence
  Description of Artificial Sequence: Synthetic oligonucleotide
guaagacgauggcucagc

SEQ ID NO: 141967 - RNA, 18 nt, Artificial Sequence
  Description of Artificial Sequence: Synthetic oligonucleotide
cucagguaagacgauggc

SEQ ID NO: 141968 - RNA, 18 nt, Artificial Sequence
  Description of Artificial Sequence: Synthetic oligonucleotide
cagaccucagguaagacg

SEQ ID NO: 141969 - RNA, 18 nt, Artificial Sequence
  Description of Artificial Sequence: Synthetic oligonucleotide
aaacccagaccucaggua

SEQ ID NO: 141970 - RNA, 18 nt, Artificial Sequence
  Description of Artificial Sequence: Synthetic oligonucleotide
acaagaaacccagaccuc

SEQ ID NO: 141971 - RNA, 18 nt, Artificial Sequence
  Description of Artificial Sequence: Synthetic oligonucleotide
gagaaacaagaaacccag

SEQ ID NO: 141972 - RNA, 18 nt, Artificial Sequence
  Description of Artificial Sequence: Synthetic oligonucleotide
gccuugagaaacaagaaa

SEQ ID NO: 141973 - RNA, 18 nt, Artificial Sequence
  Description of Artificial Sequence: Synthetic oligonucleotide
uuugagccuugagaaaca

SEQ ID NO: 141974 - RNA, 18 nt, Artificial Sequence
  Description of Artificial Sequence: Synthetic oligonucleotide
cccgcuuugagccuugag

SEQ ID NO: 141975 - RNA, 18 nt, Artificial Sequence
  Description of Artificial Sequence: Synthetic oligonucleotide
cagagcccgcuuugagcc

SEQ ID NO: 141976 - RNA, 18 nt, Artificial Sequence
  Description of Artificial Sequence: Synthetic oligonucleotide
uuucucagagcccgcuuu

SEQ ID NO: 141977 - RNA, 18 nt, Artificial Sequence
  Description of Artificial Sequence: Synthetic oligonucleotide
ccuuuuuucucagagccc

SEQ ID NO: 141978 - RNA, 18 nt, Artificial Sequence
  Description of Artificial Sequence: Synthetic oligonucleotide
ucuguccuuuuuucucag

SEQ ID NO: 141979 - RNA, 18 nt, Artificial Sequence
  Description of Artificial Sequence: Synthetic oligonucleotide
aaaugucuguccuuuuuu

SEQ ID NO: 141980 - RNA, 18 nt, Artificial Sequence
  Description of Artificial Sequence: Synthetic oligonucleotide
aaaacaaaugucuguccu

SEQ ID NO: 141981 - RNA, 18 nt, Artificial Sequence
  Description of Artificial Sequence: Synthetic oligonucleotide
cuggaaaaacaaaugucu

SEQ ID NO: 141982 - RNA, 18 nt, Artificial Sequence
  Description of Artificial Sequence: Synthetic oligonucleotide
uaucacuggaaaaacaaa

SEQ ID NO: 141983 - RNA, 18 nt, Artificial Sequence
  Description of Artificial Sequence: Synthetic oligonucleotide
acaaauaucacuggaaaa

SEQ ID NO: 141984 - RNA, 18 nt, Artificial Sequence
  Description of Artificial Sequence: Synthetic oligonucleotide
gacccacaaauaucacug

SEQ ID NO: 141985 - RNA, 18 nt, Artificial Sequence
  Description of Artificial Sequence: Synthetic oligonucleotide
ggaaggacccacaaauau

SEQ ID NO: 141986 - RNA, 18 nt, Artificial Sequence
  Description of Artificial Sequence: Synthetic oligonucleotide
aguuaggaaggacccaca

SEQ ID NO: 141987 - RNA, 18 nt, Artificial Sequence
  Description of Artificial Sequence: Synthetic oligonucleotide
ugugaaguuaggaaggac

SEQ ID NO: 141988 - RNA, 18 nt, Artificial Sequence
  Description of Artificial Sequence: Synthetic oligonucleotide
augggugugaaguuagga

SEQ ID NO: 141989 - RNA, 18 nt, Artificial Sequence
  Description of Artificial Sequence: Synthetic oligonucleotide
uuuugaugggugugaagu

SEQ ID NO: 141990 - RNA, 18 nt, Artificial Sequence
  Description of Artificial Sequence: Synthetic oligonucleotide
ugagauuuugaugggugu

SEQ ID NO: 141991 - RNA, 18 nt, Artificial Sequence
  Description of Artificial Sequence: Synthetic oligonucleotide
aucugugagauuuugaug

SEQ ID NO: 141992 - RNA, 18 nt, Artificial Sequence
  Description of Artificial Sequence: Synthetic oligonucleotide
aaauaaucugugagauuu

SEQ ID NO: 141993 - RNA, 18 nt, Artificial Sequence
  Description of Artificial Sequence: Synthetic oligonucleotide
caauaaaauaaucuguga

SEQ ID NO: 141994 - RNA, 18 nt, Artificial Sequence
  Description of Artificial Sequence: Synthetic oligonucleotide
ugauucaauaaaauaauc

SEQ ID NO: 141995 - RNA, 18 nt, Artificial Sequence
  Description of Artificial Sequence: Synthetic oligonucleotide
gguggugauucaauaaaa

SEQ ID NO: 141996 - RNA, 18 nt, Artificial Sequence
  Description of Artificial Sequence: Synthetic oligonucleotide
ugugagguggugauucaa

SEQ ID NO: 141997 - RNA, 18 nt, Artificial Sequence
  Description of Artificial Sequence: Synthetic oligonucleotide
guauuugugaggugguga

SEQ ID NO: 141998 - RNA, 18 nt, Artificial Sequence
  Description of Artificial Sequence: Synthetic oligonucleotide
ucuguguauuugugaggu

SEQ ID NO: 141999 - RNA, 18 nt, Artificial Sequence
  Description of Artificial Sequence: Synthetic oligonucleotide
cugguucuguguauuugu

SEQ ID NO: 142000 - RNA, 18 nt, Artificial Sequence
  Description of Artificial Sequence: Synthetic oligonucleotide
uguaucugguucugugua

SEQ ID NO: 142001 - RNA, 18 nt, Artificial Sequence
  Description of Artificial Sequence: Synthetic oligonucleotide
auaaauguaucugguucu

SEQ ID NO: 142002 - RNA, 18 nt, Artificial Sequence
  Description of Artificial Sequence: Synthetic oligonucleotide
ucuucauaaauguaucug

SEQ ID NO: 142003 - RNA, 18 nt, Artificial Sequence
  Description of Artificial Sequence: Synthetic oligonucleotide
ugauuucuucauaaaugu

SEQ ID NO: 142004 - RNA, 18 nt, Artificial Sequence
  Description of Artificial Sequence: Synthetic oligonucleotide
uaacuugauuucuucaua

SEQ ID NO: 142005 - RNA, 18 nt, Artificial Sequence
  Description of Artificial Sequence: Synthetic oligonucleotide
acggcuaacuugauuucu

SEQ ID NO: 142006 - RNA, 18 nt, Artificial Sequence
  Description of Artificial Sequence: Synthetic oligonucleotide
gucucacggcuaacuuga

SEQ ID NO: 142007 - RNA, 18 nt, Artificial Sequence
  Description of Artificial Sequence: Synthetic oligonucleotide
agauugucucacggcuaa

SEQ ID NO: 142008 - RNA, 18 nt, Artificial Sequence
  Description of Artificial Sequence: Synthetic oligonucleotide
aacaaaaaaaaaacacaa

SEQ ID NO: 142009 - RNA, 18 nt, Artificial Sequence
  Description of Artificial Sequence: Synthetic oligonucleotide
aacaaaacaaaaaaaaaa

SEQ ID NO: 142010 - RNA, 18 nt, Artificial Sequence
  Description of Artificial Sequence: Synthetic oligonucleotide
aacaaaacaaaacaaaaa

SEQ ID NO: 142011 - RNA, 18 nt, Artificial Sequence
  Description of Artificial Sequence: Synthetic oligonucleotide
aauaaaacaaaacaaaac

SEQ ID NO: 142012 - RNA, 18 nt, Artificial Sequence
  Description of Artificial Sequence: Synthetic oligonucleotide
aacaaaauaaaacaaaac

SEQ ID NO: 142013 - RNA, 18 nt, Artificial Sequence
  Description of Artificial Sequence: Synthetic oligonucleotide
aacaaaacaaaauaaaac

SEQ ID NO: 142014 - RNA, 18 nt, Artificial Sequence
  Description of Artificial Sequence: Synthetic oligonucleotide
aacaaaacaaaacaaaau

SEQ ID NO: 142015 - RNA, 18 nt, Artificial Sequence
  Description of Artificial Sequence: Synthetic oligonucleotide
cucaaaacaaaacaaaac

SEQ ID NO: 142016 - RNA, 18 nt, Artificial Sequence
  Description of Artificial Sequence: Synthetic oligonucleotide
uccaucucaaaacaaaac

SEQ ID NO: 142017 - RNA, 18 nt, Artificial Sequence
  Description of Artificial Sequence: Synthetic oligonucleotide
gaaacuccaucucaaaac

SEQ ID NO: 142018 - RNA, 18 nt, Artificial Sequence
  Description of Artificial Sequence: Synthetic oligonucleotide
agagugaaacuccaucuc

SEQ ID NO: 142019 - RNA, 18 nt, Artificial Sequence
  Description of Artificial Sequence: Synthetic oligonucleotide
caacaagagugaaacucc

SEQ ID NO: 142020 - RNA, 18 nt, Artificial Sequence
  Description of Artificial Sequence: Synthetic oligonucleotide
cuggacaacaagagugaa

SEQ ID NO: 142021 - RNA, 18 nt, Artificial Sequence
  Description of Artificial Sequence: Synthetic oligonucleotide
ccagccuggacaacaaga

SEQ ID NO: 142022 - RNA, 18 nt, Artificial Sequence
  Description of Artificial Sequence: Synthetic oligonucleotide
acacuccagccuggacaa

SEQ ID NO: 142023 - RNA, 18 nt, Artificial Sequence
  Description of Artificial Sequence: Synthetic oligonucleotide
ccauuacacuccagccug

SEQ ID NO: 142024 - RNA, 18 nt, Artificial Sequence
  Description of Artificial Sequence: Synthetic oligonucleotide
ucgcgccauuacacucca

SEQ ID NO: 142025 - RNA, 18 nt, Artificial Sequence
  Description of Artificial Sequence: Synthetic oligonucleotide
caagaucgcgccauuaca

SEQ ID NO: 142026 - RNA, 18 nt, Artificial Sequence
  Description of Artificial Sequence: Synthetic oligonucleotide
ucagccaagaucgcgcca

SEQ ID NO: 142027 - RNA, 18 nt, Artificial Sequence
  Description of Artificial Sequence: Synthetic oligonucleotide
ugcagucagccaagaucg

SEQ ID NO: 142028 - RNA, 18 nt, Artificial Sequence
  Description of Artificial Sequence: Synthetic oligonucleotide
gagguugcagucagccaa

SEQ ID NO: 142029 - RNA, 18 nt, Artificial Sequence
  Description of Artificial Sequence: Synthetic oligonucleotide
agguggagguugcaguca

SEQ ID NO: 142030 - RNA, 18 nt, Artificial Sequence
  Description of Artificial Sequence: Synthetic oligonucleotide
ccgggagguggagguugc

SEQ ID NO: 142031 - RNA, 18 nt, Artificial Sequence
  Description of Artificial Sequence: Synthetic oligonucleotide
ugaacccgggagguggag

SEQ ID NO: 142032 - RNA, 18 nt, Artificial Sequence
  Description of Artificial Sequence: Synthetic oligonucleotide
ucgcuugaacccgggagg

SEQ ID NO: 142033 - RNA, 18 nt, Artificial Sequence
  Description of Artificial Sequence: Synthetic oligonucleotide
gggaaucgcuugaacccg

SEQ ID NO: 142034 - RNA, 18 nt, Artificial Sequence
  Description of Artificial Sequence: Synthetic oligonucleotide
caggaggcugaggcaggg

SEQ ID NO: 142035 - RNA, 18 nt, Artificial Sequence
  Description of Artificial Sequence: Synthetic oligonucleotide
ucaggaggcugaggcagg

SEQ ID NO: 142036 - RNA, 18 nt, Artificial Sequence
  Description of Artificial Sequence: Synthetic oligonucleotide
gcuacucaggaggcugag

SEQ ID NO: 142037 - RNA, 18 nt, Artificial Sequence
  Description of Artificial Sequence: Synthetic oligonucleotide
ucccagcuacucaggagg

SEQ ID NO: 142038 - RNA, 18 nt, Artificial Sequence
  Description of Artificial Sequence: Synthetic oligonucleotide
uguaaucccagcuacuca

SEQ ID NO: 142039 - RNA, 18 nt, Artificial Sequence
  Description of Artificial Sequence: Synthetic oligonucleotide
accccuguaaucccagcu

SEQ ID NO: 142040 - RNA, 18 nt, Artificial Sequence
  Description of Artificial Sequence: Synthetic oligonucleotide
ggcacaccccuguaaucc

SEQ ID NO: 142041 - RNA, 18 nt, Artificial Sequence
  Description of Artificial Sequence: Synthetic oligonucleotide
guaguggcacaccccugu

SEQ ID NO: 142042 - RNA, 18 nt, Artificial Sequence
  Description of Artificial Sequence: Synthetic oligonucleotide
uggguguaguggcacacc

SEQ ID NO: 142043 - RNA, 18 nt, Artificial Sequence
  Description of Artificial Sequence: Synthetic oligonucleotide
uuagcuggguguaguggc

SEQ ID NO: 142044 - RNA, 18 nt, Artificial Sequence
  Description of Artificial Sequence: Synthetic oligonucleotide
aaaaauuagcugggugua

SEQ ID NO: 142045 - RNA, 18 nt, Artificial Sequence
  Description of Artificial Sequence: Synthetic oligonucleotide
uacagaaaaauuagcugg

SEQ ID NO: 142046 - RNA, 18 nt, Artificial Sequence
  Description of Artificial Sequence: Synthetic oligonucleotide
aaaaauacagaaaaauua

SEQ ID NO: 142047 - RNA, 18 nt, Artificial Sequence
  Description of Artificial Sequence: Synthetic oligonucleotide
cuacuaaaaauacagaaa

SEQ ID NO: 142048 - RNA, 18 nt, Artificial Sequence
  Description of Artificial Sequence: Synthetic oligonucleotide
cgucucuacuaaaaauac

SEQ ID NO: 142049 - RNA, 18 nt, Artificial Sequence
  Description of Artificial Sequence: Synthetic oligonucleotide
aaccccgucucuacuaaa

SEQ ID NO: 142050 - RNA, 18 nt, Artificial Sequence
  Description of Artificial Sequence: Synthetic oligonucleotide
ggugaaaccccgucucua

SEQ ID NO: 142051 - RNA, 18 nt, Artificial Sequence
  Description of Artificial Sequence: Synthetic oligonucleotide
aacauggugaaaccccgu

SEQ ID NO: 142052 - RNA, 18 nt, Artificial Sequence
  Description of Artificial Sequence: Synthetic oligonucleotide
uggccaacauggugaaac

SEQ ID NO: 142053 - RNA, 18 nt, Artificial Sequence
  Description of Artificial Sequence: Synthetic oligonucleotide
cagccuggccaacauggu

SEQ ID NO: 142054 - RNA, 18 nt, Artificial Sequence
  Description of Artificial Sequence: Synthetic oligonucleotide
gagaccagccuggccaac

SEQ ID NO: 142055 - RNA, 18 nt, Artificial Sequence
  Description of Artificial Sequence: Synthetic oligonucleotide
aguuugagaccagccugg

SEQ ID NO: 142056 - RNA, 18 nt, Artificial Sequence
  Description of Artificial Sequence: Synthetic oligonucleotide
ucaggaguuugagaccag

SEQ ID NO: 142057 - RNA, 18 nt, Artificial Sequence
  Description of Artificial Sequence: Synthetic oligonucleotide
ugaggucaggaguuugag

SEQ ID NO: 142058 - RNA, 18 nt, Artificial Sequence
  Description of Artificial Sequence: Synthetic oligonucleotide
ucaccugaggucaggagu

SEQ ID NO: 142059 - RNA, 18 nt, Artificial Sequence
  Description of Artificial Sequence: Synthetic oligonucleotide
gcggaucaccugagguca

SEQ ID NO: 142060 - RNA, 18 nt, Artificial Sequence
  Description of Artificial Sequence: Synthetic oligonucleotide
ggugggcggaucaccuga

SEQ ID NO: 142061 - RNA, 18 nt, Artificial Sequence
  Description of Artificial Sequence: Synthetic oligonucleotide
gccgaggugggcggauca

SEQ ID NO: 142062 - RNA, 18 nt, Artificial Sequence
  Description of Artificial Sequence: Synthetic oligonucleotide
gagaggccgaggugggcg

SEQ ID NO: 142063 - RNA, 18 nt, Artificial Sequence
  Description of Artificial Sequence: Synthetic oligonucleotide
acuuugagaggccgaggu

SEQ ID NO: 142064 - RNA, 18 nt, Artificial Sequence
  Description of Artificial Sequence: Synthetic oligonucleotide
ccagcacuuugagaggcc

SEQ ID NO: 142065 - RNA, 18 nt, Artificial Sequence
  Description of Artificial Sequence: Synthetic oligonucleotide
uaaucccagcacuuugag

SEQ ID NO: 142066 - RNA, 18 nt, Artificial Sequence
  Description of Artificial Sequence: Synthetic oligonucleotide
gccuguaaucccagcacu

SEQ ID NO: 142067 - RNA, 18 nt, Artificial Sequence
  Description of Artificial Sequence: Synthetic oligonucleotide
cucacgccuguaauccca

SEQ ID NO: 142068 - RNA, 18 nt, Artificial Sequence
  Description of Artificial Sequence: Synthetic oligonucleotide
aguggcucacgccuguaa

SEQ ID NO: 142069 - RNA, 18 nt, Artificial Sequence
  Description of Artificial Sequence: Synthetic oligonucleotide
ggcacaguggcucacgcc

SEQ ID NO: 142070 - RNA, 18 nt, Artificial Sequence
  Description of Artificial Sequence: Synthetic oligonucleotide
guucaggcacaguggcuc

SEQ ID NO: 142071 - RNA, 18 nt, Artificial Sequence
  Description of Artificial Sequence: Synthetic oligonucleotide
uuuuaguucaggcacagu

SEQ ID NO: 142072 - RNA, 18 nt, Artificial Sequence
  Description of Artificial Sequence: Synthetic oligonucleotide
aacuauuuuaguucaggc

SEQ ID NO: 142073 - RNA, 18 nt, Artificial Sequence
  Description of Artificial Sequence: Synthetic oligonucleotide
auuaaaacuauuuuaguu

SEQ ID NO: 142074 - RNA, 18 nt, Artificial Sequence
  Description of Artificial Sequence: Synthetic oligonucleotide
cuuuaauuaaaacuauuu

SEQ ID NO: 142075 - RNA, 18 nt, Artificial Sequence
  Description of Artificial Sequence: Synthetic oligonucleotide
uaaaacuuuaauuaaaac

SEQ ID NO: 142076 - RNA, 18 nt, Artificial Sequence
  Description of Artificial Sequence: Synthetic oligonucleotide
aauucuaaaacuuuaauu

SEQ ID NO: 142077 - RNA, 18 nt, Artificial Sequence
  Description of Artificial Sequence: Synthetic oligonucleotide
aaaguaauucuaaaacuu

SEQ ID NO: 142078 - RNA, 18 nt, Artificial Sequence
  Description of Artificial Sequence: Synthetic oligonucleotide
gaaggaaaguaauucuaa

SEQ ID NO: 142079 - RNA, 18 nt, Artificial Sequence
  Description of Artificial Sequence: Synthetic oligonucleotide
auggagaaggaaaguaau

SEQ ID NO: 142080 - RNA, 18 nt, Artificial Sequence
  Description of Artificial Sequence: Synthetic oligonucleotide
gggagauggagaaggaaa

SEQ ID NO: 142081 - RNA, 18 nt, Artificial Sequence
  Description of Artificial Sequence: Synthetic oligonucleotide
agaaauuuuuuuggaggg

SEQ ID NO: 142082 - RNA, 18 nt, Artificial Sequence
  Description of Artificial Sequence: Synthetic oligonucleotide
gagaagaaauuuuuuugg

SEQ ID NO: 142083 - RNA, 18 nt, Artificial Sequence
  Description of Artificial Sequence: Synthetic oligonucleotide
guaacgagaagaaauuuu

SEQ ID NO: 142084 - RNA, 18 nt, Artificial Sequence
  Description of Artificial Sequence: Synthetic oligonucleotide
uggaaguaacgagaagaa

SEQ ID NO: 142085 - RNA, 18 nt, Artificial Sequence
  Description of Artificial Sequence: Synthetic oligonucleotide
acauuuggaaguaacgag

SEQ ID NO: 142086 - RNA, 18 nt, Artificial Sequence
  Description of Artificial Sequence: Synthetic oligonucleotide
uccugacauuuggaagua

SEQ ID NO: 142087 - RNA, 18 nt, Artificial Sequence
  Description of Artificial Sequence: Synthetic oligonucleotide
aacacuccugacauuugg

SEQ ID NO: 142088 - RNA, 18 nt, Artificial Sequence
  Description of Artificial Sequence: Synthetic oligonucleotide
guguaaacacuccugaca

SEQ ID NO: 142089 - RNA, 18 nt, Artificial Sequence
  Description of Artificial Sequence: Synthetic oligonucleotide
auaagguguaaacacucc

SEQ ID NO: 142090 - RNA, 18 nt, Artificial Sequence
  Description of Artificial Sequence: Synthetic oligonucleotide
uauguauaagguguaaac

SEQ ID NO: 142091 - RNA, 18 nt, Artificial Sequence
  Description of Artificial Sequence: Synthetic oligonucleotide
ccgauuauguauaaggug

SEQ ID NO: 142092 - RNA, 18 nt, Artificial Sequence
  Description of Artificial Sequence: Synthetic oligonucleotide
agggcccgauuauguaua

SEQ ID NO: 142093 - RNA, 18 nt, Artificial Sequence
  Description of Artificial Sequence: Synthetic oligonucleotide
gccaaagggcccgauuau

SEQ ID NO: 142094 - RNA, 18 nt, Artificial Sequence
  Description of Artificial Sequence: Synthetic oligonucleotide
gcugugccaaagggcccg

SEQ ID NO: 142095 - RNA, 18 nt, Artificial Sequence
  Description of Artificial Sequence: Synthetic oligonucleotide
gggaggcugugccaaagg

SEQ ID NO: 142096 - RNA, 18 nt, Artificial Sequence
  Description of Artificial Sequence: Synthetic oligonucleotide
ugggagggaggcugugcc

SEQ ID NO: 142097 - RNA, 18 nt, Artificial Sequence
  Description of Artificial Sequence: Synthetic oligonucleotide
ggaggugggagggaggcu

SEQ ID NO: 142098 - RNA, 18 nt, Artificial Sequence
  Description of Artificial Sequence: Synthetic oligonucleotide
caccaggaggugggaggg

SEQ ID NO: 142099 - RNA, 18 nt, Artificial Sequence
  Description of Artificial Sequence: Synthetic oligonucleotide
aaggccaccaggaggugg

SEQ ID NO: 142100 - RNA, 18 nt, Artificial Sequence
  Description of Artificial Sequence: Synthetic oligonucleotide
gaggaaaggccaccagga

SEQ ID NO: 142101 - RNA, 18 nt, Artificial Sequence
  Description of Artificial Sequence: Synthetic oligonucleotide
caggugaggaaaggccac

SEQ ID NO: 142102 - RNA, 18 nt, Artificial Sequence
  Description of Artificial Sequence: Synthetic oligonucleotide
ucguacgacggaagaagc

SEQ ID NO: 142103 - RNA, 18 nt, Artificial Sequence
  Description of Artificial Sequence: Synthetic oligonucleotide
gcggaucguacgacggaa

SEQ ID NO: 142104 - RNA, 18 nt, Artificial Sequence
  Description of Artificial Sequence: Synthetic oligonucleotide
uucaugcggaucguacga

SEQ ID NO: 142105 - RNA, 18 nt, Artificial Sequence
  Description of Artificial Sequence: Synthetic oligonucleotide
ccagcuucaugcggaucg

SEQ ID NO: 142106 - RNA, 18 nt, Artificial Sequence
  Description of Artificial Sequence: Synthetic oligonucleotide
guacuccagcuucaugcg

SEQ ID NO: 142107 - RNA, 18 nt, Artificial Sequence
  Description of Artificial Sequence: Synthetic oligonucleotide
uucucguacuccagcuuc

SEQ ID NO: 142108 - RNA, 18 nt, Artificial Sequence
  Description of Artificial Sequence: Synthetic oligonucleotide
cacacuucucguacucca

SEQ ID NO: 142109 - RNA, 18 nt, Artificial Sequence
  Description of Artificial Sequence: Synthetic oligonucleotide
gcgcucacacuucucgua

SEQ ID NO: 142110 - RNA, 18 nt, Artificial Sequence
  Description of Artificial Sequence: Synthetic oligonucleotide
cagcugcgcucacacuuc

SEQ ID NO: 142111 - RNA, 18 nt, Artificial Sequence
  Description of Artificial Sequence: Synthetic oligonucleotide
ucuugcagcugcgcucac

SEQ ID NO: 142112 - RNA, 18 nt, Artificial Sequence
  Description of Artificial Sequence: Synthetic oligonucleotide
cugaaucuugcagcugcg

SEQ ID NO: 142113 - RNA, 18 nt, Artificial Sequence
  Description of Artificial Sequence: Synthetic oligonucleotide
uucuucugaaucuugcag

SEQ ID NO: 142114 - RNA, 18 nt, Artificial Sequence
  Description of Artificial Sequence: Synthetic oligonucleotide
gguucuucuucugaaucu

SEQ ID NO: 142115 - RNA, 18 nt, Artificial Sequence
  Description of Artificial Sequence: Synthetic oligonucleotide
guugcgguucuucuucug

SEQ ID NO: 142116 - RNA, 18 nt, Artificial Sequence
  Description of Artificial Sequence: Synthetic oligonucleotide
cacuuguugcgguucuuc

SEQ ID NO: 142117 - RNA, 18 nt, Artificial Sequence
  Description of Artificial Sequence: Synthetic oligonucleotide
acuggcacuuguugcggu

SEQ ID NO: 142118 - RNA, 18 nt, Artificial Sequence
  Description of Artificial Sequence: Synthetic oligonucleotide
gcaguacuggcacuuguu

SEQ ID NO: 142119 - RNA, 18 nt, Artificial Sequence
  Description of Artificial Sequence: Synthetic oligonucleotide
aagcggcaguacuggcac

SEQ ID NO: 142120 - RNA, 18 nt, Artificial Sequence
  Description of Artificial Sequence: Synthetic oligonucleotide
ucuggaagcggcaguacu

SEQ ID NO: 142121 - RNA, 18 nt, Artificial Sequence
  Description of Artificial Sequence: Synthetic oligonucleotide
gcacuucuggaagcggca

SEQ ID NO: 142122 - RNA, 18 nt, Artificial Sequence
  Description of Artificial Sequence: Synthetic oligonucleotide
gccaggcacuucuggaag

SEQ ID NO: 142123 - RNA, 18 nt, Artificial Sequence
  Description of Artificial Sequence: Synthetic oligonucleotide
ccagugccaggcacuucu

SEQ ID NO: 142124 - RNA, 18 nt, Artificial Sequence
  Description of Artificial Sequence: Synthetic oligonucleotide
caugcccagugccaggca

SEQ ID NO: 142125 - RNA, 18 nt, Artificial Sequence
  Description of Artificial Sequence: Synthetic oligonucleotide
ugugacaugcccagugcc

SEQ ID NO: 142126 - RNA, 18 nt, Artificial Sequence
  Description of Artificial Sequence: Synthetic oligonucleotide
cguugugugacaugccca

SEQ ID NO: 142127 - RNA, 18 nt, Artificial Sequence
  Description of Artificial Sequence: Synthetic oligonucleotide
gaucguacgacggaagaa

SEQ ID NO: 142128 - RNA, 18 nt, Artificial Sequence
  Description of Artificial Sequence: Synthetic oligonucleotide
augcggaucguacgacgg

SEQ ID NO: 142129 - RNA, 18 nt, Artificial Sequence
  Description of Artificial Sequence: Synthetic oligonucleotide
gcuucaugcggaucguac

SEQ ID NO: 142130 - RNA, 18 nt, Artificial Sequence
  Description of Artificial Sequence: Synthetic oligonucleotide
cuccagcuucaugcggau

SEQ ID NO: 142131 - RNA, 18 nt, Artificial Sequence
  Description of Artificial Sequence: Synthetic oligonucleotide
ucguacuccagcuucaug

SEQ ID NO: 142132 - RNA, 18 nt, Artificial Sequence
  Description of Artificial Sequence: Synthetic oligonucleotide
acuucucguacuccagcu

SEQ ID NO: 142133 - RNA, 18 nt, Artificial Sequence
  Description of Artificial Sequence: Synthetic oligonucleotide
cucacacuucucguacuc

SEQ ID NO: 142134 - RNA, 18 nt, Artificial Sequence
  Description of Artificial Sequence: Synthetic oligonucleotide
cugcgcucacacuucucg

SEQ ID NO: 142135 - RNA, 18 nt, Artificial Sequence
  Description of Artificial Sequence: Synthetic oligonucleotide
ugcagcugcgcucacacu

SEQ ID NO: 142136 - RNA, 18 nt, Artificial Sequence
  Description of Artificial Sequence: Synthetic oligonucleotide
aaucuugcagcugcgcuc

SEQ ID NO: 142137 - RNA, 18 nt, Artificial Sequence
  Description of Artificial Sequence: Synthetic oligonucleotide
uucugaaucuugcagcug

SEQ ID NO: 142138 - RNA, 18 nt, Artificial Sequence
  Description of Artificial Sequence: Synthetic oligonucleotide
ucuucuucugaaucuugc

SEQ ID NO: 142139 - RNA, 18 nt, Artificial Sequence
  Description of Artificial Sequence: Synthetic oligonucleotide
gcgguucuucuucugaau

SEQ ID NO: 142140 - RNA, 18 nt, Artificial Sequence
  Description of Artificial Sequence: Synthetic oligonucleotide
uuguugcgguucuucuuc

SEQ ID NO: 142141 - RNA, 18 nt, Artificial Sequence
  Description of Artificial Sequence: Synthetic oligonucleotide
ggcacuuguugcgguucu

SEQ ID NO: 142142 - RNA, 18 nt, Artificial Sequence
  Description of Artificial Sequence: Synthetic oligonucleotide
guacuggcacuuguugcg

SEQ ID NO: 142143 - RNA, 18 nt, Artificial Sequence
  Description of Artificial Sequence: Synthetic oligonucleotide
cggcaguacuggcacuug

SEQ ID NO: 142144 - RNA, 18 nt, Artificial Sequence
  Description of Artificial Sequence: Synthetic oligonucleotide
ggaagcggcaguacuggc

SEQ ID NO: 142145 - RNA, 18 nt, Artificial Sequence
  Description of Artificial Sequence: Synthetic oligonucleotide
cuucuggaagcggcagua

SEQ ID NO: 142146 - RNA, 18 nt, Artificial Sequence
  Description of Artificial Sequence: Synthetic oligonucleotide
aggcacuucuggaagcgg

SEQ ID NO: 142147 - RNA, 18 nt, Artificial Sequence
  Description of Artificial Sequence: Synthetic oligonucleotide
gugccaggcacuucugga

SEQ ID NO: 142148 - RNA, 18 nt, Artificial Sequence
  Description of Artificial Sequence: Synthetic oligonucleotide
gcccagugccaggcacuu

SEQ ID NO: 142149 - RNA, 18 nt, Artificial Sequence
  Description of Artificial Sequence: Synthetic oligonucleotide
gacaugcccagugccagg

SEQ ID NO: 142150 - RNA, 18 nt, Artificial Sequence
  Description of Artificial Sequence: Synthetic oligonucleotide
ugugugacaugcccagug

SEQ ID NO: 142151 - RNA, 18 nt, Artificial Sequence
  Description of Artificial Sequence: Synthetic oligonucleotide
gaguugcccuggucagcu

SEQ ID NO: 142152 - RNA, 18 nt, Artificial Sequence
  Description of Artificial Sequence: Synthetic oligonucleotide
cccgugaguugcccuggu

SEQ ID NO: 142153 - RNA, 18 nt, Artificial Sequence
  Description of Artificial Sequence: Synthetic oligonucleotide
agcagcccgugaguugcc

SEQ ID NO: 142154 - RNA, 18 nt, Artificial Sequence
  Description of Artificial Sequence: Synthetic oligonucleotide
gagccagcagcccgugag

SEQ ID NO: 142155 - RNA, 18 nt, Artificial Sequence
  Description of Artificial Sequence: Synthetic oligonucleotide
guguggagccagcagccc

SEQ ID NO: 142156 - RNA, 18 nt, Artificial Sequence
  Description of Artificial Sequence: Synthetic oligonucleotide
aggcuguguggagccagc

SEQ ID NO: 142157 - RNA, 18 nt, Artificial Sequence
  Description of Artificial Sequence: Synthetic oligonucleotide
guuucaggcuguguggag

SEQ ID NO: 142158 - RNA, 18 nt, Artificial Sequence
  Description of Artificial Sequence: Synthetic oligonucleotide
ccuugguuucaggcugug

SEQ ID NO: 142159 - RNA, 18 nt, Artificial Sequence
  Description of Artificial Sequence: Synthetic oligonucleotide
cuggaccuugguuucagg

SEQ ID NO: 142160 - RNA, 18 nt, Artificial Sequence
  Description of Artificial Sequence: Synthetic oligonucleotide
gcucccuggaccuugguu

SEQ ID NO: 142161 - RNA, 18 nt, Artificial Sequence
  Description of Artificial Sequence: Synthetic oligonucleotide
caagggcucccuggaccu

SEQ ID NO: 142162 - RNA, 18 nt, Artificial Sequence
  Description of Artificial Sequence: Synthetic oligonucleotide
ugccccaagggcucccug

SEQ ID NO: 142163 - RNA, 18 nt, Artificial Sequence
  Description of Artificial Sequence: Synthetic oligonucleotide
uaggcugccccaagggcu

SEQ ID NO: 142164 - RNA, 18 nt, Artificial Sequence
  Description of Artificial Sequence: Synthetic oligonucleotide
cccucuaggcugccccaa

SEQ ID NO: 142165 - RNA, 18 nt, Artificial Sequence
  Description of Artificial Sequence: Synthetic oligonucleotide
gugcccccucuaggcugc

SEQ ID NO: 142166 - RNA, 18 nt, Artificial Sequence
  Description of Artificial Sequence: Synthetic oligonucleotide
uacaggugcccccucuag

SEQ ID NO: 142167 - RNA, 18 nt, Artificial Sequence
  Description of Artificial Sequence: Synthetic oligonucleotide
ugcucuacaggugccccc

SEQ ID NO: 142168 - RNA, 18 nt, Artificial Sequence
  Description of Artificial Sequence: Synthetic oligonucleotide
ggcacugcucuacaggug

SEQ ID NO: 142169 - RNA, 18 nt, Artificial Sequence
  Description of Artificial Sequence: Synthetic oligonucleotide
cgccaggcacugcucuac

SEQ ID NO: 142170 - RNA, 18 nt, Artificial Sequence
  Description of Artificial Sequence: Synthetic oligonucleotide
cugugcgccaggcacugc

SEQ ID NO: 142171 - RNA, 18 nt, Artificial Sequence
  Description of Artificial Sequence: Synthetic oligonucleotide
gcuuacugugcgccaggc

SEQ ID NO: 142172 - RNA, 18 nt, Artificial Sequence
  Description of Artificial Sequence: Synthetic oligonucleotide
auggugcuuacugugcgc

SEQ ID NO: 142173 - RNA, 18 nt, Artificial Sequence
  Description of Artificial Sequence: Synthetic oligonucleotide
cagccauggugcuuacug

SEQ ID NO: 142174 - RNA, 18 nt, Artificial Sequence
  Description of Artificial Sequence: Synthetic oligonucleotide
gccaacagccauggugcu

SEQ ID NO: 142175 - RNA, 18 nt, Artificial Sequence
  Description of Artificial Sequence: Synthetic oligonucleotide
caacagccaacagccaug

SEQ ID NO: 142176 - RNA, 18 nt, Artificial Sequence
  Description of Artificial Sequence: Synthetic oligonucleotide
aaagccaacagccaacag

SEQ ID NO: 142177 - RNA, 18 nt, Artificial Sequence
  Description of Artificial Sequence: Synthetic oligonucleotide
ucagcaaagccaacagcc

SEQ ID NO: 142178 - RNA, 18 nt, Artificial Sequence
  Description of Artificial Sequence: Synthetic oligonucleotide
ccagaucagcaaagccaa

SEQ ID NO: 142179 - RNA, 18 nt, Artificial Sequence
  Description of Artificial Sequence: Synthetic oligonucleotide
aagguccagaucagcaaa

SEQ ID NO: 142180 - RNA, 18 nt, Artificial Sequence
  Description of Artificial Sequence: Synthetic oligonucleotide
gauccaagguccagauca

SEQ ID NO: 142181 - RNA, 18 nt, Artificial Sequence
  Description of Artificial Sequence: Synthetic oligonucleotide
ucuaagauccaaggucca

SEQ ID NO: 142182 - RNA, 18 nt, Artificial Sequence
  Description of Artificial Sequence: Synthetic oligonucleotide
uaggcucuaagauccaag

SEQ ID NO: 142183 - RNA, 18 nt, Artificial Sequence
  Description of Artificial Sequence: Synthetic oligonucleotide
ggucuuaggcucuaagau

SEQ ID NO: 142184 - RNA, 18 nt, Artificial Sequence
  Description of Artificial Sequence: Synthetic oligonucleotide
uggcaggucuuaggcucu

SEQ ID NO: 142185 - RNA, 18 nt, Artificial Sequence
  Description of Artificial Sequence: Synthetic oligonucleotide
ggaaguggcaggucuuag

SEQ ID NO: 142186 - RNA, 18 nt, Artificial Sequence
  Description of Artificial Sequence: Synthetic oligonucleotide
ucugaggaaguggcaggu

SEQ ID NO: 142187 - RNA, 18 nt, Artificial Sequence
  Description of Artificial Sequence: Synthetic oligonucleotide
ggcagucugaggaagugg

SEQ ID NO: 142188 - RNA, 18 nt, Artificial Sequence
  Description of Artificial Sequence: Synthetic oligonucleotide
augcuggcagucugagga

SEQ ID NO: 142189 - RNA, 18 nt, Artificial Sequence
  Description of Artificial Sequence: Synthetic oligonucleotide
gguagaugcuggcagucu

SEQ ID NO: 142190 - RNA, 18 nt, Artificial Sequence
  Description of Artificial Sequence: Synthetic oligonucleotide
cccaugguagaugcuggc

SEQ ID NO: 142191 - RNA, 18 nt, Artificial Sequence
  Description of Artificial Sequence: Synthetic oligonucleotide
ugggacccaugguagaug

SEQ ID NO: 142192 - RNA, 18 nt, Artificial Sequence
  Description of Artificial Sequence: Synthetic oligonucleotide
acgccugggacccauggu

SEQ ID NO: 142193 - RNA, 18 nt, Artificial Sequence
  Description of Artificial Sequence: Synthetic oligonucleotide
accccacgccugggaccc

SEQ ID NO: 142194 - RNA, 18 nt, Artificial Sequence
  Description of Artificial Sequence: Synthetic oligonucleotide
acacuaccccacgccugg

SEQ ID NO: 142195 - RNA, 18 nt, Artificial Sequence
  Description of Artificial Sequence: Synthetic oligonucleotide
gguaaacacuaccccacg

SEQ ID NO: 142196 - RNA, 18 nt, Artificial Sequence
  Description of Artificial Sequence: Synthetic oligonucleotide
agggagguaaacacuacc

SEQ ID NO: 142197 - RNA, 18 nt, Artificial Sequence
  Description of Artificial Sequence: Synthetic oligonucleotide
gguauagggagguaaaca

SEQ ID NO: 142198 - RNA, 18 nt, Artificial Sequence
  Description of Artificial Sequence: Synthetic oligonucleotide
ccucagguauagggaggu

SEQ ID NO: 142199 - RNA, 18 nt, Artificial Sequence
  Description of Artificial Sequence: Synthetic oligonucleotide
guaaaccucagguauagg

SEQ ID NO: 142200 - RNA, 18 nt, Artificial Sequence
  Description of Artificial Sequence: Synthetic oligonucleotide
aaugcguaaaccucaggu

SEQ ID NO: 142201 - RNA, 18 nt, Artificial Sequence
  Description of Artificial Sequence: Synthetic oligonucleotide
gccagaaugcguaaaccu

SEQ ID NO: 142202 - RNA, 18 nt, Artificial Sequence
  Description of Artificial Sequence: Synthetic oligonucleotide
ucugggccagaaugcgua

SEQ ID NO: 142203 - RNA, 18 nt, Artificial Sequence
  Description of Artificial Sequence: Synthetic oligonucleotide
ucccuucugggccagaau

SEQ ID NO: 142204 - RNA, 18 nt, Artificial Sequence
  Description of Artificial Sequence: Synthetic oligonucleotide
ucaguucccuucugggcc

SEQ ID NO: 142205 - RNA, 18 nt, Artificial Sequence
  Description of Artificial Sequence: Synthetic oligonucleotide
aauuaucaguucccuucu

SEQ ID NO: 142206 - RNA, 18 nt, Artificial Sequence
  Description of Artificial Sequence: Synthetic oligonucleotide
guaucaauuaucaguucc

SEQ ID NO: 142207 - RNA, 18 nt, Artificial Sequence
  Description of Artificial Sequence: Synthetic oligonucleotide
agcugguaucaauuauca

SEQ ID NO: 142208 - RNA, 18 nt, Artificial Sequence
  Description of Artificial Sequence: Synthetic oligonucleotide
guucaagcugguaucaau

SEQ ID NO: 142209 - RNA, 18 nt, Artificial Sequence
  Description of Artificial Sequence: Synthetic oligonucleotide
aaauuguucaagcuggua

SEQ ID NO: 142210 - RNA, 18 nt, Artificial Sequence
  Description of Artificial Sequence: Synthetic oligonucleotide
uccccaaauuguucaagc

SEQ ID NO: 142211 - RNA, 18 nt, Artificial Sequence
  Description of Artificial Sequence: Synthetic oligonucleotide
gguguuccccaaauuguu

SEQ ID NO: 142212 - RNA, 18 nt, Artificial Sequence
  Description of Artificial Sequence: Synthetic oligonucleotide
ggacugguguuccccaaa

SEQ ID NO: 142213 - RNA, 18 nt, Artificial Sequence
  Description of Artificial Sequence: Synthetic oligonucleotide
uucugggacugguguucc

SEQ ID NO: 142214 - RNA, 18 nt, Artificial Sequence
  Description of Artificial Sequence: Synthetic oligonucleotide
ugaguuucugggacuggu

SEQ ID NO: 142215 - RNA, 18 nt, Artificial Sequence
  Description of Artificial Sequence: Synthetic oligonucleotide
aggcuugaguuucuggga

SEQ ID NO: 142216 - RNA, 18 nt, Artificial Sequence
  Description of Artificial Sequence: Synthetic oligonucleotide
gagacaggcuugaguuuc

SEQ ID NO: 142217 - RNA, 18 nt, Artificial Sequence
  Description of Artificial Sequence: Synthetic oligonucleotide
caucugagacaggcuuga

SEQ ID NO: 142218 - RNA, 18 nt, Artificial Sequence
  Description of Artificial Sequence: Synthetic oligonucleotide
caggucaucugagacagg

SEQ ID NO: 142219 - RNA, 18 nt, Artificial Sequence
  Description of Artificial Sequence: Synthetic oligonucleotide
ugugucaggucaucugag

SEQ ID NO: 142220 - RNA, 18 nt, Artificial Sequence
  Description of Artificial Sequence: Synthetic oligonucleotide
caugcugugucaggucau

SEQ ID NO: 142221 - RNA, 18 nt, Artificial Sequence
  Description of Artificial Sequence: Synthetic oligonucleotide
gcuuucaugcugugucag

SEQ ID NO: 142222 - RNA, 18 nt, Artificial Sequence
  Description of Artificial Sequence: Synthetic oligonucleotide
caguagcuuucaugcugu

SEQ ID NO: 142223 - RNA, 18 nt, Artificial Sequence
  Description of Artificial Sequence: Synthetic oligonucleotide
cuuggcaguagcuuucau

SEQ ID NO: 142224 - RNA, 18 nt, Artificial Sequence
  Description of Artificial Sequence: Synthetic oligonucleotide
cuggccuuggcaguagcu

SEQ ID NO: 142225 - RNA, 18 nt, Artificial Sequence
  Description of Artificial Sequence: Synthetic oligonucleotide
gccaccuggccuuggcag

SEQ ID NO: 142226 - RNA, 18 nt, Artificial Sequence
  Description of Artificial Sequence: Synthetic oligonucleotide
gaagggccaccuggccuu

SEQ ID NO: 142227 - RNA, 18 nt, Artificial Sequence
  Description of Artificial Sequence: Synthetic oligonucleotide
accaagaagggccaccug

SEQ ID NO: 142228 - RNA, 18 nt, Artificial Sequence
  Description of Artificial Sequence: Synthetic oligonucleotide
cuauaaccaagaagggcc

SEQ ID NO: 142229 - RNA, 18 nt, Artificial Sequence
  Description of Artificial Sequence: Synthetic oligonucleotide
gccuucuauaaccaagaa

SEQ ID NO: 142230 - RNA, 18 nt, Artificial Sequence
  Description of Artificial Sequence: Synthetic oligonucleotide
ugccugccuucuauaacc

SEQ ID NO: 142231 - RNA, 18 nt, Artificial Sequence
  Description of Artificial Sequence: Synthetic oligonucleotide
guuacugccugccuucua

SEQ ID NO: 142232 - RNA, 18 nt, Artificial Sequence
  Description of Artificial Sequence: Synthetic oligonucleotide
uacugguuacugccugcc

SEQ ID NO: 142233 - RNA, 18 nt, Artificial Sequence
  Description of Artificial Sequence: Synthetic oligonucleotide
uuacuuacugguuacugc

SEQ ID NO: 142234 - RNA, 18 nt, Artificial Sequence
  Description of Artificial Sequence: Synthetic oligonucleotide
ugugguuacuuacugguu

SEQ ID NO: 142235 - RNA, 18 nt, Artificial Sequence
  Description of Artificial Sequence: Synthetic oligonucleotide
acaaaugugguuacuuac

SEQ ID NO: 142236 - RNA, 18 nt, Artificial Sequence
  Description of Artificial Sequence: Synthetic oligonucleotide
aguugacaaaugugguua

SEQ ID NO: 142237 - RNA, 18 nt, Artificial Sequence
  Description of Artificial Sequence: Synthetic oligonucleotide
cuggcaguugacaaaugu

SEQ ID NO: 142238 - RNA, 18 nt, Artificial Sequence
  Description of Artificial Sequence: Synthetic oligonucleotide
ggcuccuggcaguugaca

SEQ ID NO: 142239 - RNA, 18 nt, Artificial Sequence
  Description of Artificial Sequence: Synthetic oligonucleotide
ugccuggcuccuggcagu

SEQ ID NO: 142240 - RNA, 18 nt, Artificial Sequence
  Description of Artificial Sequence: Synthetic oligonucleotide
acuucugccuggcuccug

SEQ ID NO: 142241 - RNA, 18 nt, Artificial Sequence
  Description of Artificial Sequence: Synthetic oligonucleotide
aagaaacuucugccuggc

SEQ ID NO: 142242 - RNA, 18 nt, Artificial Sequence
  Description of Artificial Sequence: Synthetic oligonucleotide
ccuccaagaaacuucugc

SEQ ID NO: 142243 - RNA, 18 nt, Artificial Sequence
  Description of Artificial Sequence: Synthetic oligonucleotide
ggugaccuccaagaaacu

SEQ ID NO: 142244 - RNA, 18 nt, Artificial Sequence
  Description of Artificial Sequence: Synthetic oligonucleotide
gagugggugaccuccaag

SEQ ID NO: 142245 - RNA, 18 nt, Artificial Sequence
  Description of Artificial Sequence: Synthetic oligonucleotide
ccugggagugggugaccu

SEQ ID NO: 142246 - RNA, 18 nt, Artificial Sequence
  Description of Artificial Sequence: Synthetic oligonucleotide
ugucuccugggagugggu

SEQ ID NO: 142247 - RNA, 18 nt, Artificial Sequence
  Description of Artificial Sequence: Synthetic oligonucleotide
ggcucugucuccugggag

SEQ ID NO: 142248 - RNA, 18 nt, Artificial Sequence
  Description of Artificial Sequence: Synthetic oligonucleotide
gagaaggcucugucuccu

SEQ ID NO: 142249 - RNA, 18 nt, Artificial Sequence
  Description of Artificial Sequence: Synthetic oligonucleotide
gggcagagaaggcucugu

SEQ ID NO: 142250 - RNA, 18 nt, Artificial Sequence
  Description of Artificial Sequence: Synthetic oligonucleotide
aauucucugucucagccu

SEQ ID NO: 142251 - RNA, 18 nt, Artificial Sequence
  Description of Artificial Sequence: Synthetic oligonucleotide
caagcaauucucugucuc

SEQ ID NO: 142252 - RNA, 18 nt, Artificial Sequence
  Description of Artificial Sequence: Synthetic oligonucleotide
ggguucaagcaauucucu

SEQ ID NO: 142253 - RNA, 18 nt, Artificial Sequence
  Description of Artificial Sequence: Synthetic oligonucleotide
cucccggguucaagcaau

SEQ ID NO: 142254 - RNA, 18 nt, Artificial Sequence
  Description of Artificial Sequence: Synthetic oligonucleotide
ucugccucccggguucaa

SEQ ID NO: 142255 - RNA, 18 nt, Artificial Sequence
  Description of Artificial Sequence: Synthetic oligonucleotide
caaccucugccucccggg

SEQ ID NO: 142256 - RNA, 18 nt, Artificial Sequence
  Description of Artificial Sequence: Synthetic oligonucleotide
cacugcaaccucugccuc

SEQ ID NO: 142257 - RNA, 18 nt, Artificial Sequence
  Description of Artificial Sequence: Synthetic oligonucleotide
cggcucacugcaaccucu

SEQ ID NO: 142258 - RNA, 18 nt, Artificial Sequence
  Description of Artificial Sequence: Synthetic oligonucleotide
gaucucggcucacugcaa

SEQ ID NO: 142259 - RNA, 18 nt, Artificial Sequence
  Description of Artificial Sequence: Synthetic oligonucleotide
ggcacgaucucggcucac

SEQ ID NO: 142260 - RNA, 18 nt, Artificial Sequence
  Description of Artificial Sequence: Synthetic oligonucleotide
gcaguggcacgaucucgg

SEQ ID NO: 142261 - RNA, 18 nt, Artificial Sequence
  Description of Artificial Sequence: Synthetic oligonucleotide
ggagugcaguggcacgau

SEQ ID NO: 142262 - RNA, 18 nt, Artificial Sequence
  Description of Artificial Sequence: Synthetic oligonucleotide
aggcuggagugcaguggc

SEQ ID NO: 142263 - RNA, 18 nt, Artificial Sequence
  Description of Artificial Sequence: Synthetic oligonucleotide
cucccaggcuggagugca

SEQ ID NO: 142264 - RNA, 18 nt, Artificial Sequence
  Description of Artificial Sequence: Synthetic oligonucleotide
ucugucucccaggcugga

SEQ ID NO: 142265 - RNA, 18 nt, Artificial Sequence
  Description of Artificial Sequence: Synthetic oligonucleotide
cucgcucugucucccagg

SEQ ID NO: 142266 - RNA, 18 nt, Artificial Sequence
  Description of Artificial Sequence: Synthetic oligonucleotide
agagucucgcucugucuc

SEQ ID NO: 142267 - RNA, 18 nt, Artificial Sequence
  Description of Artificial Sequence: Synthetic oligonucleotide
gagacagagucucgcucu

SEQ ID NO: 142268 - RNA, 18 nt, Artificial Sequence
  Description of Artificial Sequence: Synthetic oligonucleotide
uuuuugagacagagucuc

SEQ ID NO: 142269 - RNA, 18 nt, Artificial Sequence
  Description of Artificial Sequence: Synthetic oligonucleotide
uuuuuuuuuugagacaga

SEQ ID NO: 142270 - RNA, 18 nt, Artificial Sequence
  Description of Artificial Sequence: Synthetic oligonucleotide
ucuuuuuuuuuuuuugag

SEQ ID NO: 142271 - RNA, 18 nt, Artificial Sequence
  Description of Artificial Sequence: Synthetic oligonucleotide
ucuuuucuuuuuuuuuuu

SEQ ID NO: 142272 - RNA, 18 nt, Artificial Sequence
  Description of Artificial Sequence: Synthetic oligonucleotide
cuuuuucuuuucuuuuuu

SEQ ID NO: 142273 - RNA, 18 nt, Artificial Sequence
  Description of Artificial Sequence: Synthetic oligonucleotide
cuuuucuuuuucuuuucu

SEQ ID NO: 142274 - RNA, 18 nt, Artificial Sequence
  Description of Artificial Sequence: Synthetic oligonucleotide
cuucacuuuucuuuuucu

SEQ ID NO: 142275 - RNA, 18 nt, Artificial Sequence
  Description of Artificial Sequence: Synthetic oligonucleotide
gacuccuucacuuuucuu

SEQ ID NO: 142276 - RNA, 18 nt, Artificial Sequence
  Description of Artificial Sequence: Synthetic oligonucleotide
gggcagacuccuucacuu

SEQ ID NO: 142277 - RNA, 18 nt, Artificial Sequence
  Description of Artificial Sequence: Synthetic oligonucleotide
cuagcuuugugacuuggg

SEQ ID NO: 142278 - RNA, 18 nt, Artificial Sequence
  Description of Artificial Sequence: Synthetic oligonucleotide
uacuagcuuugugacuug

SEQ ID NO: 142279 - RNA, 18 nt, Artificial Sequence
  Description of Artificial Sequence: Synthetic oligonucleotide
caguuuacuagcuuugug

SEQ ID NO: 142280 - RNA, 18 nt, Artificial Sequence
  Description of Artificial Sequence: Synthetic oligonucleotide
cucagcaguuuacuagcu

SEQ ID NO: 142281 - RNA, 18 nt, Artificial Sequence
  Description of Artificial Sequence: Synthetic oligonucleotide
uccagcucagcaguuuac

SEQ ID NO: 142282 - RNA, 18 nt, Artificial Sequence
  Description of Artificial Sequence: Synthetic oligonucleotide
ugaguuccagcucagcag

SEQ ID NO: 142283 - RNA, 18 nt, Artificial Sequence
  Description of Artificial Sequence: Synthetic oligonucleotide
gggcuugaguuccagcuc

SEQ ID NO: 142284 - RNA, 18 nt, Artificial Sequence
  Description of Artificial Sequence: Synthetic oligonucleotide
ggccugggcuugaguucc

SEQ ID NO: 142285 - RNA, 18 nt, Artificial Sequence
  Description of Artificial Sequence: Synthetic oligonucleotide
acaaaggccugggcuuga

SEQ ID NO: 142286 - RNA, 18 nt, Artificial Sequence
  Description of Artificial Sequence: Synthetic oligonucleotide
uggugacaaaggccuggg

SEQ ID NO: 142287 - RNA, 18 nt, Artificial Sequence
  Description of Artificial Sequence: Synthetic oligonucleotide
gacuuuggugacaaaggc

SEQ ID NO: 142288 - RNA, 18 nt, Artificial Sequence
  Description of Artificial Sequence: Synthetic oligonucleotide
agacagacuuuggugaca

SEQ ID NO: 142289 - RNA, 18 nt, Artificial Sequence
  Description of Artificial Sequence: Synthetic oligonucleotide
ggguaagacagacuuugg

SEQ ID NO: 142290 - RNA, 18 nt, Artificial Sequence
  Description of Artificial Sequence: Synthetic oligonucleotide
ugagcuacgcuagcuggg

SEQ ID NO: 142291 - RNA, 18 nt, Artificial Sequence
  Description of Artificial Sequence: Synthetic oligonucleotide
ugacugagcuacgcuagc

SEQ ID NO: 142292 - RNA, 18 nt, Artificial Sequence
  Description of Artificial Sequence: Synthetic oligonucleotide
cugagugacugagcuacg

SEQ ID NO: 142293 - RNA, 18 nt, Artificial Sequence
  Description of Artificial Sequence: Synthetic oligonucleotide
acuuacugagugacugag

SEQ ID NO: 142294 - RNA, 18 nt, Artificial Sequence
  Description of Artificial Sequence: Synthetic oligonucleotide
cucuaacuuacugaguga

SEQ ID NO: 142295 - RNA, 18 nt, Artificial Sequence
  Description of Artificial Sequence: Synthetic oligonucleotide
aaggacucuaacuuacug

SEQ ID NO: 142296 - RNA, 18 nt, Artificial Sequence
  Description of Artificial Sequence: Synthetic oligonucleotide
cacacaaggacucuaacu

SEQ ID NO: 142297 - RNA, 18 nt, Artificial Sequence
  Description of Artificial Sequence: Synthetic oligonucleotide
cccagcacacaaggacuc

SEQ ID NO: 142298 - RNA, 18 nt, Artificial Sequence
  Description of Artificial Sequence: Synthetic oligonucleotide
cagugcccagcacacaag

SEQ ID NO: 142299 - RNA, 18 nt, Artificial Sequence
  Description of Artificial Sequence: Synthetic oligonucleotide
guucacagugcccagcac

SEQ ID NO: 142300 - RNA, 18 nt, Artificial Sequence
  Description of Artificial Sequence: Synthetic oligonucleotide
guuuuguucacagugccc

SEQ ID NO: 142301 - RNA, 18 nt, Artificial Sequence
  Description of Artificial Sequence: Synthetic oligonucleotide
ugucuguuuuguucacag

SEQ ID NO: 142302 - RNA, 18 nt, Artificial Sequence
  Description of Artificial Sequence: Synthetic oligonucleotide
gauuuugucuguuuuguu

SEQ ID NO: 142303 - RNA, 18 nt, Artificial Sequence
  Description of Artificial Sequence: Synthetic oligonucleotide
gcagugauuuugucuguu

SEQ ID NO: 142304 - RNA, 18 nt, Artificial Sequence
  Description of Artificial Sequence: Synthetic oligonucleotide
caagagcagugauuuugu

SEQ ID NO: 142305 - RNA, 18 nt, Artificial Sequence
  Description of Artificial Sequence: Synthetic oligonucleotide
cuuugcaagagcagugau

SEQ ID NO: 142306 - RNA, 18 nt, Artificial Sequence
  Description of Artificial Sequence: Synthetic oligonucleotide
uguaucuuugcaagagca

SEQ ID NO: 142307 - RNA, 18 nt, Artificial Sequence
  Description of Artificial Sequence: Synthetic oligonucleotide
uuugguguaucuuugcaa

SEQ ID NO: 142308 - RNA, 18 nt, Artificial Sequence
  Description of Artificial Sequence: Synthetic oligonucleotide
uuuuuuuugguguaucuu

SEQ ID NO: 142309 - RNA, 18 nt, Artificial Sequence
  Description of Artificial Sequence: Synthetic oligonucleotide
uuuuuuuuuuuuuggugu

SEQ ID NO: 142310 - RNA, 18 nt, Artificial Sequence
  Description of Artificial Sequence: Synthetic oligonucleotide
ugauuuuuuuuuuuuuuu

SEQ ID NO: 142311 - RNA, 18 nt, Artificial Sequence
  Description of Artificial Sequence: Synthetic oligonucleotide
agaugugauuuuuuuuuu

SEQ ID NO: 142312 - RNA, 18 nt, Artificial Sequence
  Description of Artificial Sequence: Synthetic oligonucleotide
ccacaagaugugauuuuu

SEQ ID NO: 142313 - RNA, 18 nt, Artificial Sequence
  Description of Artificial Sequence: Synthetic oligonucleotide
aagcuccacaagauguga

SEQ ID NO: 142314 - RNA, 18 nt, Artificial Sequence
  Description of Artificial Sequence: Synthetic oligonucleotide
aucgcaagcuccacaaga

SEQ ID NO: 142315 - RNA, 18 nt, Artificial Sequence
  Description of Artificial Sequence: Synthetic oligonucleotide
uccagaucgcaagcucca

SEQ ID NO: 142316 - RNA, 18 nt, Artificial Sequence
  Description of Artificial Sequence: Synthetic oligonucleotide
gccccuccagaucgcaag

SEQ ID NO: 142317 - RNA, 18 nt, Artificial Sequence
  Description of Artificial Sequence: Synthetic oligonucleotide
ggguggccccuccagauc

SEQ ID NO: 142318 - RNA, 18 nt, Artificial Sequence
  Description of Artificial Sequence: Synthetic oligonucleotide
caagguaggaaugauggg

SEQ ID NO: 142319 - RNA, 18 nt, Artificial Sequence
  Description of Artificial Sequence: Synthetic oligonucleotide
ucagcaagguaggaauga

SEQ ID NO: 142320 - RNA, 18 nt, Artificial Sequence
  Description of Artificial Sequence: Synthetic oligonucleotide
uagagucagcaagguagg

SEQ ID NO: 142321 - RNA, 18 nt, Artificial Sequence
  Description of Artificial Sequence: Synthetic oligonucleotide
agcucuagagucagcaag

SEQ ID NO: 142322 - RNA, 18 nt, Artificial Sequence
  Description of Artificial Sequence: Synthetic oligonucleotide
ccagaagcucuagaguca

SEQ ID NO: 142323 - RNA, 18 nt, Artificial Sequence
  Description of Artificial Sequence: Synthetic oligonucleotide
ggcccccagaagcucuag

SEQ ID NO: 142324 - RNA, 18 nt, Artificial Sequence
  Description of Artificial Sequence: Synthetic oligonucleotide
ccuaaggcccccagaagc

SEQ ID NO: 142325 - RNA, 18 nt, Artificial Sequence
  Description of Artificial Sequence: Synthetic oligonucleotide
uggagccuaaggccccca

SEQ ID NO: 142326 - RNA, 18 nt, Artificial Sequence
  Description of Artificial Sequence: Synthetic oligonucleotide
ccuuuuggagccuaaggc

SEQ ID NO: 142327 - RNA, 18 nt, Artificial Sequence
  Description of Artificial Sequence: Synthetic oligonucleotide
caaauccuuuuggagccu

SEQ ID NO: 142328 - RNA, 18 nt, Artificial Sequence
  Description of Artificial Sequence: Synthetic oligonucleotide
ugggccaaauccuuuugg

SEQ ID NO: 142329 - RNA, 18 nt, Artificial Sequence
  Description of Artificial Sequence: Synthetic oligonucleotide
gugcaugggccaaauccu

SEQ ID NO: 142330 - RNA, 18 nt, Artificial Sequence
  Description of Artificial Sequence: Synthetic oligonucleotide
uacaggugcaugggccaa

SEQ ID NO: 142331 - RNA, 18 nt, Artificial Sequence
  Description of Artificial Sequence: Synthetic oligonucleotide
cccuuuacaggugcaugg

SEQ ID NO: 142332 - RNA, 18 nt, Artificial Sequence
  Description of Artificial Sequence: Synthetic oligonucleotide
cccaucccuuuacaggug

SEQ ID NO: 142333 - RNA, 18 nt, Artificial Sequence
  Description of Artificial Sequence: Synthetic oligonucleotide
acauccccaucccuuuac

SEQ ID NO: 142334 - RNA, 18 nt, Artificial Sequence
  Description of Artificial Sequence: Synthetic oligonucleotide
cucugacauccccauccc

SEQ ID NO: 142335 - RNA, 18 nt, Artificial Sequence
  Description of Artificial Sequence: Synthetic oligonucleotide
agcaccucugacaucccc

SEQ ID NO: 142336 - RNA, 18 nt, Artificial Sequence
  Description of Artificial Sequence: Synthetic oligonucleotide
gccccagcaccucugaca

SEQ ID NO: 142337 - RNA, 18 nt, Artificial Sequence
  Description of Artificial Sequence: Synthetic oligonucleotide
ggcaggccccagcaccuc

SEQ ID NO: 142338 - RNA, 18 nt, Artificial Sequence
  Description of Artificial Sequence: Synthetic oligonucleotide
gcccaggcaggccccagc

SEQ ID NO: 142339 - RNA, 18 nt, Artificial Sequence
  Description of Artificial Sequence: Synthetic oligonucleotide
aaggagcccaggcaggcc

SEQ ID NO: 142340 - RNA, 18 nt, Artificial Sequence
  Description of Artificial Sequence: Synthetic oligonucleotide
ucagcaaggagcccaggc

SEQ ID NO: 142341 - RNA, 18 nt, Artificial Sequence
  Description of Artificial Sequence: Synthetic oligonucleotide
ggcagucagcaaggagcc

SEQ ID NO: 142342 - RNA, 18 nt, Artificial Sequence
  Description of Artificial Sequence: Synthetic oligonucleotide
auccgaccaaaacggaua

SEQ ID NO: 142343 - RNA, 18 nt, Artificial Sequence
  Description of Artificial Sequence: Synthetic oligonucleotide
ccggcauccgaccaaaac

SEQ ID NO: 142344 - RNA, 18 nt, Artificial Sequence
  Description of Artificial Sequence: Synthetic oligonucleotide
agccuccggcauccgacc

SEQ ID NO: 142345 - RNA, 18 nt, Artificial Sequence
  Description of Artificial Sequence: Synthetic oligonucleotide
uucucagccuccggcauc

SEQ ID NO: 142346 - RNA, 18 nt, Artificial Sequence
  Description of Artificial Sequence: Synthetic oligonucleotide
uccucuucucagccuccg

SEQ ID NO: 142347 - RNA, 18 nt, Artificial Sequence
  Description of Artificial Sequence: Synthetic oligonucleotide
cagcuuccucuucucagc

SEQ ID NO: 142348 - RNA, 18 nt, Artificial Sequence
  Description of Artificial Sequence: Synthetic oligonucleotide
gccaccagcuuccucuuc

SEQ ID NO: 142349 - RNA, 18 nt, Artificial Sequence
  Description of Artificial Sequence: Synthetic oligonucleotide
gcccugccaccagcuucc

SEQ ID NO: 142350 - RNA, 18 nt, Artificial Sequence
  Description of Artificial Sequence: Synthetic oligonucleotide
agucagcccugccaccag

SEQ ID NO: 142351 - RNA, 18 nt, Artificial Sequence
  Description of Artificial Sequence: Synthetic oligonucleotide
uuugcagucagcccugcc

SEQ ID NO: 142352 - RNA, 18 nt, Artificial Sequence
  Description of Artificial Sequence: Synthetic oligonucleotide
ccucguuugcagucagcc

SEQ ID NO: 142353 - RNA, 18 nt, Artificial Sequence
  Description of Artificial Sequence: Synthetic oligonucleotide
gcuccccucguuugcagu

SEQ ID NO: 142354 - RNA, 18 nt, Artificial Sequence
  Description of Artificial Sequence: Synthetic oligonucleotide
uacuggcuccccucguuu

SEQ ID NO: 142355 - RNA, 18 nt, Artificial Sequence
  Description of Artificial Sequence: Synthetic oligonucleotide
gguuguacuggcuccccu

SEQ ID NO: 142356 - RNA, 18 nt, Artificial Sequence
  Description of Artificial Sequence: Synthetic oligonucleotide
cuguggguuguacuggcu

SEQ ID NO: 142357 - RNA, 18 nt, Artificial Sequence
  Description of Artificial Sequence: Synthetic oligonucleotide
gccaccuguggguuguac

SEQ ID NO: 142358 - RNA, 18 nt, Artificial Sequence
  Description of Artificial Sequence: Synthetic oligonucleotide
ggucggccaccugugggu

SEQ ID NO: 142359 - RNA, 18 nt, Artificial Sequence
  Description of Artificial Sequence: Synthetic oligonucleotide
cuucaggucggccaccug

SEQ ID NO: 142360 - RNA, 18 nt, Artificial Sequence
  Description of Artificial Sequence: Synthetic oligonucleotide
aaggccuucaggucggcc

SEQ ID NO: 142361 - RNA, 18 nt, Artificial Sequence
  Description of Artificial Sequence: Synthetic oligonucleotide
uggagaaggccuucaggu

SEQ ID NO: 142362 - RNA, 18 nt, Artificial Sequence
  Description of Artificial Sequence: Synthetic oligonucleotide
gugcuuggagaaggccuu

SEQ ID NO: 142363 - RNA, 18 nt, Artificial Sequence
  Description of Artificial Sequence: Synthetic oligonucleotide
uagaugugcuuggagaag

SEQ ID NO: 142364 - RNA, 18 nt, Artificial Sequence
  Description of Artificial Sequence: Synthetic oligonucleotide
cauuguagaugugcuugg

SEQ ID NO: 142365 - RNA, 18 nt, Artificial Sequence
  Description of Artificial Sequence: Synthetic oligonucleotide
guaggcauuguagaugug

SEQ ID NO: 142366 - RNA, 18 nt, Artificial Sequence
  Description of Artificial Sequence: Synthetic oligonucleotide
uucagguaggcauuguag

SEQ ID NO: 142367 - RNA, 18 nt, Artificial Sequence
  Description of Artificial Sequence: Synthetic oligonucleotide
aguuuuucagguaggcau

SEQ ID NO: 142368 - RNA, 18 nt, Artificial Sequence
  Description of Artificial Sequence: Synthetic oligonucleotide
guugaaguuuuucaggua

SEQ ID NO: 142369 - RNA, 18 nt, Artificial Sequence
  Description of Artificial Sequence: Synthetic oligonucleotide
gucauguugaaguuuuuc

SEQ ID NO: 142370 - RNA, 18 nt, Artificial Sequence
  Description of Artificial Sequence: Synthetic oligonucleotide
uuuuggucauguugaagu

SEQ ID NO: 142371 - RNA, 18 nt, Artificial Sequence
  Description of Artificial Sequence: Synthetic oligonucleotide
cuucuuuuuggucauguu

SEQ ID NO: 142372 - RNA, 18 nt, Artificial Sequence
  Description of Artificial Sequence: Synthetic oligonucleotide
cgggccuucuuuuugguc

SEQ ID NO: 142373 - RNA, 18 nt, Artificial Sequence
  Description of Artificial Sequence: Synthetic oligonucleotide
ugcugcgggccuucuuuu

SEQ ID NO: 142374 - RNA, 18 nt, Artificial Sequence
  Description of Artificial Sequence: Synthetic oligonucleotide
gaggaugcugcgggccuu

SEQ ID NO: 142375 - RNA, 18 nt, Artificial Sequence
  Description of Artificial Sequence: Synthetic oligonucleotide
ccggugaggaugcugcgg

SEQ ID NO: 142376 - RNA, 18 nt, Artificial Sequence
  Description of Artificial Sequence: Synthetic oligonucleotide
cuuugccggugaggaugc

SEQ ID NO: 142377 - RNA, 18 nt, Artificial Sequence
  Description of Artificial Sequence: Synthetic oligonucleotide
gcuggcuuugccggugag

SEQ ID NO: 142378 - RNA, 18 nt, Artificial Sequence
  Description of Artificial Sequence: Synthetic oligonucleotide
guguggcuggcuuugccg

SEQ ID NO: 142379 - RNA, 18 nt, Artificial Sequence
  Description of Artificial Sequence: Synthetic oligonucleotide
cauccgaccaaaacggau

SEQ ID NO: 142380 - RNA, 18 nt, Artificial Sequence
  Description of Artificial Sequence: Synthetic oligonucleotide
uccggcauccgaccaaaa

SEQ ID NO: 142381 - RNA, 18 nt, Artificial Sequence
  Description of Artificial Sequence: Synthetic oligonucleotide
cagccuccggcauccgac

SEQ ID NO: 142382 - RNA, 18 nt, Artificial Sequence
  Description of Artificial Sequence: Synthetic oligonucleotide
cuucucagccuccggcau

SEQ ID NO: 142383 - RNA, 18 nt, Artificial Sequence
  Description of Artificial Sequence: Synthetic oligonucleotide
uuccucuucucagccucc

SEQ ID NO: 142384 - RNA, 18 nt, Artificial Sequence
  Description of Artificial Sequence: Synthetic oligonucleotide
ccagcuuccucuucucag

SEQ ID NO: 142385 - RNA, 18 nt, Artificial Sequence
  Description of Artificial Sequence: Synthetic oligonucleotide
ugccaccagcuuccucuu

SEQ ID NO: 142386 - RNA, 18 nt, Artificial Sequence
  Description of Artificial Sequence: Synthetic oligonucleotide
agcccugccaccagcuuc

SEQ ID NO: 142387 - RNA, 18 nt, Artificial Sequence
  Description of Artificial Sequence: Synthetic oligonucleotide
cagucagcccugccacca

SEQ ID NO: 142388 - RNA, 18 nt, Artificial Sequence
  Description of Artificial Sequence: Synthetic oligonucleotide
guuugcagucagcccugc

SEQ ID NO: 142389 - RNA, 18 nt, Artificial Sequence
  Description of Artificial Sequence: Synthetic oligonucleotide
cccucguuugcagucagc

SEQ ID NO: 142390 - RNA, 18 nt, Artificial Sequence
  Description of Artificial Sequence: Synthetic oligonucleotide
ggcuccccucguuugcag

SEQ ID NO: 142391 - RNA, 18 nt, Artificial Sequence
  Description of Artificial Sequence: Synthetic oligonucleotide
guacuggcuccccucguu

SEQ ID NO: 142392 - RNA, 18 nt, Artificial Sequence
  Description of Artificial Sequence: Synthetic oligonucleotide
ggguuguacuggcucccc

SEQ ID NO: 142393 - RNA, 18 nt, Artificial Sequence
  Description of Artificial Sequence: Synthetic oligonucleotide
ccuguggguuguacuggc

SEQ ID NO: 142394 - RNA, 18 nt, Artificial Sequence
  Description of Artificial Sequence: Synthetic oligonucleotide
ggccaccuguggguugua

SEQ ID NO: 142395 - RNA, 18 nt, Artificial Sequence
  Description of Artificial Sequence: Synthetic oligonucleotide
aggucggccaccuguggg

SEQ ID NO: 142396 - RNA, 18 nt, Artificial Sequence
  Description of Artificial Sequence: Synthetic oligonucleotide
ccuucaggucggccaccu

SEQ ID NO: 142397 - RNA, 18 nt, Artificial Sequence
  Description of Artificial Sequence: Synthetic oligonucleotide
gaaggccuucaggucggc

SEQ ID NO: 142398 - RNA, 18 nt, Artificial Sequence
  Description of Artificial Sequence: Synthetic oligonucleotide
uuggagaaggccuucagg

SEQ ID NO: 142399 - RNA, 18 nt, Artificial Sequence
  Description of Artificial Sequence: Synthetic oligonucleotide
ugugcuuggagaaggccu

SEQ ID NO: 142400 - RNA, 18 nt, Artificial Sequence
  Description of Artificial Sequence: Synthetic oligonucleotide
guagaugugcuuggagaa

SEQ ID NO: 142401 - RNA, 18 nt, Artificial Sequence
  Description of Artificial Sequence: Synthetic oligonucleotide
gcauuguagaugugcuug

SEQ ID NO: 142402 - RNA, 18 nt, Artificial Sequence
  Description of Artificial Sequence: Synthetic oligonucleotide
gguaggcauuguagaugu

SEQ ID NO: 142403 - RNA, 18 nt, Artificial Sequence
  Description of Artificial Sequence: Synthetic oligonucleotide
uuucagguaggcauugua

SEQ ID NO: 142404 - RNA, 18 nt, Artificial Sequence
  Description of Artificial Sequence: Synthetic oligonucleotide
aaguuuuucagguaggca

SEQ ID NO: 142405 - RNA, 18 nt, Artificial Sequence
  Description of Artificial Sequence: Synthetic oligonucleotide
uguugaaguuuuucaggu

SEQ ID NO: 142406 - RNA, 18 nt, Artificial Sequence
  Description of Artificial Sequence: Synthetic oligonucleotide
ggucauguugaaguuuuu

SEQ ID NO: 142407 - RNA, 18 nt, Artificial Sequence
  Description of Artificial Sequence: Synthetic oligonucleotide
uuuuuggucauguugaag

SEQ ID NO: 142408 - RNA, 18 nt, Artificial Sequence
  Description of Artificial Sequence: Synthetic oligonucleotide
ccuucuuuuuggucaugu

SEQ ID NO: 142409 - RNA, 18 nt, Artificial Sequence
  Description of Artificial Sequence: Synthetic oligonucleotide
gcgggccuucuuuuuggu

SEQ ID NO: 142410 - RNA, 18 nt, Artificial Sequence
  Description of Artificial Sequence: Synthetic oligonucleotide
augcugcgggccuucuuu

SEQ ID NO: 142411 - RNA, 18 nt, Artificial Sequence
  Description of Artificial Sequence: Synthetic oligonucleotide
ugaggaugcugcgggccu

SEQ ID NO: 142412 - RNA, 18 nt, Artificial Sequence
  Description of Artificial Sequence: Synthetic oligonucleotide
gccggugaggaugcugcg

SEQ ID NO: 142413 - RNA, 18 nt, Artificial Sequence
  Description of Artificial Sequence: Synthetic oligonucleotide
gcuuugccggugaggaug

SEQ ID NO: 142414 - RNA, 18 nt, Artificial Sequence
  Description of Artificial Sequence: Synthetic oligonucleotide
ggcuggcuuugccgguga

SEQ ID NO: 142415 - RNA, 18 nt, Artificial Sequence
  Description of Artificial Sequence: Synthetic oligonucleotide
cguguggcuggcuuugcc

SEQ ID NO: 142416 - RNA, 18 nt, Artificial Sequence
  Description of Artificial Sequence: Synthetic oligonucleotide
ggccaagcagcagcaaca

SEQ ID NO: 142417 - RNA, 18 nt, Artificial Sequence
  Description of Artificial Sequence: Synthetic oligonucleotide
ugccaggccaagcagcag

SEQ ID NO: 142418 - RNA, 18 nt, Artificial Sequence
  Description of Artificial Sequence: Synthetic oligonucleotide
gaugcugccaggccaagc

SEQ ID NO: 142419 - RNA, 18 nt, Artificial Sequence
  Description of Artificial Sequence: Synthetic oligonucleotide
cccaggaugcugccaggc

SEQ ID NO: 142420 - RNA, 18 nt, Artificial Sequence
  Description of Artificial Sequence: Synthetic oligonucleotide
cagagcccaggaugcugc

SEQ ID NO: 142421 - RNA, 18 nt, Artificial Sequence
  Description of Artificial Sequence: Synthetic oligonucleotide
ggacccagagcccaggau

SEQ ID NO: 142422 - RNA, 18 nt, Artificial Sequence
  Description of Artificial Sequence: Synthetic oligonucleotide
cagugggacccagagccc

SEQ ID NO: 142423 - RNA, 18 nt, Artificial Sequence
  Description of Artificial Sequence: Synthetic oligonucleotide
ggcggcagugggacccag

SEQ ID NO: 142424 - RNA, 18 nt, Artificial Sequence
  Description of Artificial Sequence: Synthetic oligonucleotide
aggcaggcggcaguggga

SEQ ID NO: 142425 - RNA, 18 nt, Artificial Sequence
  Description of Artificial Sequence: Synthetic oligonucleotide
gagucaggcaggcggcag

SEQ ID NO: 142426 - RNA, 18 nt, Artificial Sequence
  Description of Artificial Sequence: Synthetic oligonucleotide
ucccggagucaggcaggc

SEQ ID NO: 142427 - RNA, 18 nt, Artificial Sequence
  Description of Artificial Sequence: Synthetic oligonucleotide
ggcucucccggagucagg

SEQ ID NO: 142428 - RNA, 18 nt, Artificial Sequence
  Description of Artificial Sequence: Synthetic oligonucleotide
ggccuggcucucccggag

SEQ ID NO: 142429 - RNA, 18 nt, Artificial Sequence
  Description of Artificial Sequence: Synthetic oligonucleotide
gagaaggccuggcucucc

SEQ ID NO: 142430 - RNA, 18 nt, Artificial Sequence
  Description of Artificial Sequence: Synthetic oligonucleotide
ggagggagaaggccuggc

SEQ ID NO: 142431 - RNA, 18 nt, Artificial Sequence
  Description of Artificial Sequence: Synthetic oligonucleotide
uugagggagggagaaggc

SEQ ID NO: 142432 - RNA, 18 nt, Artificial Sequence
  Description of Artificial Sequence: Synthetic oligonucleotide
ugaaguugagggagggag

SEQ ID NO: 142433 - RNA, 18 nt, Artificial Sequence
  Description of Artificial Sequence: Synthetic oligonucleotide
caccaugaaguugaggga

SEQ ID NO: 142434 - RNA, 18 nt, Artificial Sequence
  Description of Artificial Sequence: Synthetic oligonucleotide
gccugcaccaugaaguug

SEQ ID NO: 142435 - RNA, 18 nt, Artificial Sequence
  Description of Artificial Sequence: Synthetic oligonucleotide
cccuugccugcaccauga

SEQ ID NO: 142436 - RNA, 18 nt, Artificial Sequence
  Description of Artificial Sequence: Synthetic oligonucleotide
cuggcucucccggaguca

SEQ ID NO: 142437 - RNA, 18 nt, Artificial Sequence
  Description of Artificial Sequence: Synthetic oligonucleotide
aaggccuggcucucccgg

SEQ ID NO: 142438 - RNA, 18 nt, Artificial Sequence
  Description of Artificial Sequence: Synthetic oligonucleotide
gggagaaggccuggcucu

SEQ ID NO: 142439 - RNA, 18 nt, Artificial Sequence
  Description of Artificial Sequence: Synthetic oligonucleotide
agggagggagaaggccug

SEQ ID NO: 142440 - RNA, 18 nt, Artificial Sequence
  Description of Artificial Sequence: Synthetic oligonucleotide
aguugagggagggagaag

SEQ ID NO: 142441 - RNA, 18 nt, Artificial Sequence
  Description of Artificial Sequence: Synthetic oligonucleotide
caugaaguugagggaggg

SEQ ID NO: 142442 - RNA, 18 nt, Artificial Sequence
  Description of Artificial Sequence: Synthetic oligonucleotide
ugcaccaugaaguugagg

SEQ ID NO: 142443 - RNA, 18 nt, Artificial Sequence
  Description of Artificial Sequence: Synthetic oligonucleotide
uugccugcaccaugaagu

SEQ ID NO: 142444 - RNA, 18 nt, Artificial Sequence
  Description of Artificial Sequence: Synthetic oligonucleotide
gucccuugccugcaccau

SEQ ID NO: 142445 - RNA, 18 nt, Artificial Sequence
  Description of Artificial Sequence: Synthetic oligonucleotide
cccaugucccuugccugc

SEQ ID NO: 142446 - RNA, 18 nt, Artificial Sequence
  Description of Artificial Sequence: Synthetic oligonucleotide
ugcuccccaugucccuug

SEQ ID NO: 142447 - RNA, 18 nt, Artificial Sequence
  Description of Artificial Sequence: Synthetic oligonucleotide
cccugugcuccccauguc

SEQ ID NO: 142448 - RNA, 18 nt, Artificial Sequence
  Description of Artificial Sequence: Synthetic oligonucleotide
ccccacccugugcucccc

SEQ ID NO: 142449 - RNA, 18 nt, Artificial Sequence
  Description of Artificial Sequence: Synthetic oligonucleotide
gagacccccacccugugc

SEQ ID NO: 142450 - RNA, 18 nt, Artificial Sequence
  Description of Artificial Sequence: Synthetic oligonucleotide
cucgggagacccccaccc

SEQ ID NO: 142451 - RNA, 18 nt, Artificial Sequence
  Description of Artificial Sequence: Synthetic oligonucleotide
caggccucgggagacccc

SEQ ID NO: 142452 - RNA, 18 nt, Artificial Sequence
  Description of Artificial Sequence: Synthetic oligonucleotide
gagaucaggccucgggag

SEQ ID NO: 142453 - RNA, 18 nt, Artificial Sequence
  Description of Artificial Sequence: Synthetic oligonucleotide
cguuagagaucaggccuc

SEQ ID NO: 142454 - RNA, 18 nt, Artificial Sequence
  Description of Artificial Sequence: Synthetic oligonucleotide
ugucguggaucacaaagg

SEQ ID NO: 142455 - RNA, 18 nt, Artificial Sequence
  Description of Artificial Sequence: Synthetic oligonucleotide
cucgaugucguggaucac

SEQ ID NO: 142456 - RNA, 18 nt, Artificial Sequence
  Description of Artificial Sequence: Synthetic oligonucleotide
aaugucucgaugucgugg

SEQ ID NO: 142457 - RNA, 18 nt, Artificial Sequence
  Description of Artificial Sequence: Synthetic oligonucleotide
gccacaaugucucgaugu

SEQ ID NO: 142458 - RNA, 18 nt, Artificial Sequence
  Description of Artificial Sequence: Synthetic oligonucleotide
ugccugccacaaugucuc

SEQ ID NO: 142459 - RNA, 18 nt, Artificial Sequence
  Description of Artificial Sequence: Synthetic oligonucleotide
uucucugccugccacaau

SEQ ID NO: 142460 - RNA, 18 nt, Artificial Sequence
  Description of Artificial Sequence: Synthetic oligonucleotide
gccccuucucugccugcc

SEQ ID NO: 142461 - RNA, 18 nt, Artificial Sequence
  Description of Artificial Sequence: Synthetic oligonucleotide
caccagccccuucucugc

SEQ ID NO: 142462 - RNA, 18 nt, Artificial Sequence
  Description of Artificial Sequence: Synthetic oligonucleotide
uuccacaccagccccuuc

SEQ ID NO: 142463 - RNA, 18 nt, Artificial Sequence
  Description of Artificial Sequence: Synthetic oligonucleotide
acugcuuccacaccagcc

SEQ ID NO: 142464 - RNA, 18 nt, Artificial Sequence
  Description of Artificial Sequence: Synthetic oligonucleotide
caccaacugcuuccacac

SEQ ID NO: 142465 - RNA, 18 nt, Artificial Sequence
  Description of Artificial Sequence: Synthetic oligonucleotide
ccauucaccaacugcuuc

SEQ ID NO: 142466 - RNA, 18 nt, Artificial Sequence
  Description of Artificial Sequence: Synthetic oligonucleotide
gcaggccauucaccaacu

SEQ ID NO: 142467 - RNA, 18 nt, Artificial Sequence
  Description of Artificial Sequence: Synthetic oligonucleotide
gggaggcaggccauucac

SEQ ID NO: 142468 - RNA, 18 nt, Artificial Sequence
  Description of Artificial Sequence: Synthetic oligonucleotide
uuguagggaggcaggcca

SEQ ID NO: 142469 - RNA, 18 nt, Artificial Sequence
  Description of Artificial Sequence: Synthetic oligonucleotide
ucuccuuguagggaggca

SEQ ID NO: 142470 - RNA, 18 nt, Artificial Sequence
  Description of Artificial Sequence: Synthetic oligonucleotide
gcugaucuccuuguaggg

SEQ ID NO: 142471 - RNA, 18 nt, Artificial Sequence
  Description of Artificial Sequence: Synthetic oligonucleotide
ugcacgcugaucuccuug

SEQ ID NO: 142472 - RNA, 18 nt, Artificial Sequence
  Description of Artificial Sequence: Synthetic oligonucleotide
agacgugcacgcugaucu

SEQ ID NO: 142473 - RNA, 18 nt, Artificial Sequence
  Description of Artificial Sequence: Synthetic oligonucleotide
guagaagacgugcacgcu

SEQ ID NO: 142474 - RNA, 18 nt, Artificial Sequence
  Description of Artificial Sequence: Synthetic oligonucleotide
cagcgguagaagacgugc

SEQ ID NO: 142475 - RNA, 18 nt, Artificial Sequence
  Description of Artificial Sequence: Synthetic oligonucleotide
acuggcagcgguagaaga

SEQ ID NO: 142476 - RNA, 18 nt, Artificial Sequence
  Description of Artificial Sequence: Synthetic oligonucleotide
ggugcacuggcagcggua

SEQ ID NO: 142477 - RNA, 18 nt, Artificial Sequence
  Description of Artificial Sequence: Synthetic oligonucleotide
acuguggugcacuggcag

SEQ ID NO: 142478 - RNA, 18 nt, Artificial Sequence
  Description of Artificial Sequence: Synthetic oligonucleotide
ucuccacuguggugcacu

SEQ ID NO: 142479 - RNA, 18 nt, Artificial Sequence
  Description of Artificial Sequence: Synthetic oligonucleotide
cacggucuccacuguggu

SEQ ID NO: 142480 - RNA, 18 nt, Artificial Sequence
  Description of Artificial Sequence: Synthetic oligonucleotide
ucccgcacggucuccacu

SEQ ID NO: 142481 - RNA, 18 nt, Artificial Sequence
  Description of Artificial Sequence: Synthetic oligonucleotide
ugagcucccgcacggucu

SEQ ID NO: 142482 - RNA, 18 nt, Artificial Sequence
  Description of Artificial Sequence: Synthetic oligonucleotide
cucagugagcucccgcac

SEQ ID NO: 142483 - RNA, 18 nt, Artificial Sequence
  Description of Artificial Sequence: Synthetic oligonucleotide
gcgaacucagugagcucc

SEQ ID NO: 142484 - RNA, 18 nt, Artificial Sequence
  Description of Artificial Sequence: Synthetic oligonucleotide
ucuuggcgaacucaguga

SEQ ID NO: 142485 - RNA, 18 nt, Artificial Sequence
  Description of Artificial Sequence: Synthetic oligonucleotide
gaugcucuuggcgaacuc

SEQ ID NO: 142486 - RNA, 18 nt, Artificial Sequence
  Description of Artificial Sequence: Synthetic oligonucleotide
gggaugcucuuggcgaac

SEQ ID NO: 142487 - RNA, 18 nt, Artificial Sequence
  Description of Artificial Sequence: Synthetic oligonucleotide
gaggcugcugaagcuggg

SEQ ID NO: 142488 - RNA, 18 nt, Artificial Sequence
  Description of Artificial Sequence: Synthetic oligonucleotide
aggaagaggcugcugaag

SEQ ID NO: 142489 - RNA, 18 nt, Artificial Sequence
  Description of Artificial Sequence: Synthetic oligonucleotide
cguugaggaagaggcugc

SEQ ID NO: 142490 - RNA, 18 nt, Artificial Sequence
  Description of Artificial Sequence: Synthetic oligonucleotide
cuggucguugaggaagag

SEQ ID NO: 142491 - RNA, 18 nt, Artificial Sequence
  Description of Artificial Sequence: Synthetic oligonucleotide
guaaccuggucguugagg

SEQ ID NO: 142492 - RNA, 18 nt, Artificial Sequence
  Description of Artificial Sequence: Synthetic oligonucleotide
gaaggguaaccuggucgu

SEQ ID NO: 142493 - RNA, 18 nt, Artificial Sequence
  Description of Artificial Sequence: Synthetic oligonucleotide
cuugagaaggguaaccug

SEQ ID NO: 142494 - RNA, 18 nt, Artificial Sequence
  Description of Artificial Sequence: Synthetic oligonucleotide
ccauacuugagaagggua

SEQ ID NO: 142495 - RNA, 18 nt, Artificial Sequence
  Description of Artificial Sequence: Synthetic oligonucleotide
gcacgccauacuugagaa

SEQ ID NO: 142496 - RNA, 18 nt, Artificial Sequence
  Description of Artificial Sequence: Synthetic oligonucleotide
cucgugcacgccauacuu

SEQ ID NO: 142497 - RNA, 18 nt, Artificial Sequence
  Description of Artificial Sequence: Synthetic oligonucleotide
auggccucgugcacgcca

SEQ ID NO: 142498 - RNA, 18 nt, Artificial Sequence
  Description of Artificial Sequence: Synthetic oligonucleotide
cgaagauggccucgugca

SEQ ID NO: 142499 - RNA, 18 nt, Artificial Sequence
  Description of Artificial Sequence: Synthetic oligonucleotide
cauggcgaagauggccuc

SEQ ID NO: 142500 - RNA, 18 nt, Artificial Sequence
  Description of Artificial Sequence: Synthetic oligonucleotide
gccagcauggcgaagaug

SEQ ID NO: 142501 - RNA, 18 nt, Artificial Sequence
  Description of Artificial Sequence: Synthetic oligonucleotide
uagaggccagcauggcga

SEQ ID NO: 142502 - RNA, 18 nt, Artificial Sequence
  Description of Artificial Sequence: Synthetic oligonucleotide
gacgauagaggccagcau

SEQ ID NO: 142503 - RNA, 18 nt, Artificial Sequence
  Description of Artificial Sequence: Synthetic oligonucleotide
uuguugacgauagaggcc

SEQ ID NO: 142504 - RNA, 18 nt, Artificial Sequence
  Description of Artificial Sequence: Synthetic oligonucleotide
cguccuuguugacgauag

SEQ ID NO: 142505 - RNA, 18 nt, Artificial Sequence
  Description of Artificial Sequence: Synthetic oligonucleotide
cagcccguccuuguugac

SEQ ID NO: 142506 - RNA, 18 nt, Artificial Sequence
  Description of Artificial Sequence: Synthetic oligonucleotide
accagcagcccguccuug

SEQ ID NO: 142507 - RNA, 18 nt, Artificial Sequence
  Description of Artificial Sequence: Synthetic oligonucleotide
uggcuaccagcagcccgu

SEQ ID NO: 142508 - RNA, 18 nt, Artificial Sequence
  Description of Artificial Sequence: Synthetic oligonucleotide
gccguuggcuaccagcag

SEQ ID NO: 142509 - RNA, 18 nt, Artificial Sequence
  Description of Artificial Sequence: Synthetic oligonucleotide
ccacugccguuggcuacc

SEQ ID NO: 142510 - RNA, 18 nt, Artificial Sequence
  Description of Artificial Sequence: Synthetic oligonucleotide
caaagccacugccguugg

SEQ ID NO: 142511 - RNA, 18 nt, Artificial Sequence
  Description of Artificial Sequence: Synthetic oligonucleotide
ggugacaaagccacugcc

SEQ ID NO: 142512 - RNA, 18 nt, Artificial Sequence
  Description of Artificial Sequence: Synthetic oligonucleotide
ucacgggugacaaagcca

SEQ ID NO: 142513 - RNA, 18 nt, Artificial Sequence
  Description of Artificial Sequence: Synthetic oligonucleotide
ggaacucacgggugacaa

SEQ ID NO: 142514 - RNA, 18 nt, Artificial Sequence
  Description of Artificial Sequence: Synthetic oligonucleotide
gcgcaggaacucacgggu

SEQ ID NO: 142515 - RNA, 18 nt, Artificial Sequence
  Description of Artificial Sequence: Synthetic oligonucleotide
aggcugcgcaggaacuca

SEQ ID NO: 142516 - RNA, 18 nt, Artificial Sequence
  Description of Artificial Sequence: Synthetic oligonucleotide
ugcggaggcugcgcagga

SEQ ID NO: 142517 - RNA, 18 nt, Artificial Sequence
  Description of Artificial Sequence: Synthetic oligonucleotide
ggguuugcggaggcugcg

SEQ ID NO: 142518 - RNA, 18 nt, Artificial Sequence
  Description of Artificial Sequence: Synthetic oligonucleotide
cugaaggguuugcggagg

SEQ ID NO: 142519 - RNA, 18 nt, Artificial Sequence
  Description of Artificial Sequence: Synthetic oligonucleotide
uaucacugaaggguuugc

SEQ ID NO: 142520 - RNA, 18 nt, Artificial Sequence
  Description of Artificial Sequence: Synthetic oligonucleotide
aaugauaucacugaaggg

SEQ ID NO: 142521 - RNA, 18 nt, Artificial Sequence
  Description of Artificial Sequence: Synthetic oligonucleotide
ggcucaaugauaucacug

SEQ ID NO: 142522 - RNA, 18 nt, Artificial Sequence
  Description of Artificial Sequence: Synthetic oligonucleotide
acuuaggcucaaugauau

SEQ ID NO: 142523 - RNA, 18 nt, Artificial Sequence
  Description of Artificial Sequence: Synthetic oligonucleotide
uucaaacuuaggcucaau

SEQ ID NO: 142524 - RNA, 18 nt, Artificial Sequence
  Description of Artificial Sequence: Synthetic oligonucleotide
gcaaauucaaacuuaggc

SEQ ID NO: 142525 - RNA, 18 nt, Artificial Sequence
  Description of Artificial Sequence: Synthetic oligonucleotide
ugacagcaaauucaaacu

SEQ ID NO: 142526 - RNA, 18 nt, Artificial Sequence
  Description of Artificial Sequence: Synthetic oligonucleotide
gaacuugacagcaaauuc

SEQ ID NO: 142527 - RNA, 18 nt, Artificial Sequence
  Description of Artificial Sequence: Synthetic oligonucleotide
gcguugaacuugacagca

SEQ ID NO: 142528 - RNA, 18 nt, Artificial Sequence
  Description of Artificial Sequence: Synthetic oligonucleotide
ccagggcguugaacuuga

SEQ ID NO: 142529 - RNA, 18 nt, Artificial Sequence
  Description of Artificial Sequence: Synthetic oligonucleotide
aaguuccagggcguugaa

SEQ ID NO: 142530 - RNA, 18 nt, Artificial Sequence
  Description of Artificial Sequence: Synthetic oligonucleotide
ucaucaaguuccagggcg

SEQ ID NO: 142531 - RNA, 18 nt, Artificial Sequence
  Description of Artificial Sequence: Synthetic oligonucleotide
cacugucaucaaguucca

SEQ ID NO: 142532 - RNA, 18 nt, Artificial Sequence
  Description of Artificial Sequence: Synthetic oligonucleotide
caggucacugucaucaag

SEQ ID NO: 142533 - RNA, 18 nt, Artificial Sequence
  Description of Artificial Sequence: Synthetic oligonucleotide
agggccaggucacuguca

SEQ ID NO: 142534 - RNA, 18 nt, Artificial Sequence
  Description of Artificial Sequence: Synthetic oligonucleotide
ugaauagggccaggucac

SEQ ID NO: 142535 - RNA, 18 nt, Artificial Sequence
  Description of Artificial Sequence: Synthetic oligonucleotide
cgcaaugaauagggccag

SEQ ID NO: 142536 - RNA, 18 nt, Artificial Sequence
  Description of Artificial Sequence: Synthetic oligonucleotide
auggccgcaaugaauagg

SEQ ID NO: 142537 - RNA, 18 nt, Artificial Sequence
  Description of Artificial Sequence: Synthetic oligonucleotide
gaaugauggccgcaauga

SEQ ID NO: 142538 - RNA, 18 nt, Artificial Sequence
  Description of Artificial Sequence: Synthetic oligonucleotide
acacagaaugauggccgc

SEQ ID NO: 142539 - RNA, 18 nt, Artificial Sequence
  Description of Artificial Sequence: Synthetic oligonucleotide
ccuccacacagaaugaug

SEQ ID NO: 142540 - RNA, 18 nt, Artificial Sequence
  Description of Artificial Sequence: Synthetic oligonucleotide
acucaccuccacacagaa

SEQ ID NO: 142541 - RNA, 18 nt, Artificial Sequence
  Description of Artificial Sequence: Synthetic oligonucleotide
cucucacucaccuccaca

SEQ ID NO: 142542 - RNA, 18 nt, Artificial Sequence
  Description of Artificial Sequence: Synthetic oligonucleotide
ccccacucucacucaccu

SEQ ID NO: 142543 - RNA, 18 nt, Artificial Sequence
  Description of Artificial Sequence: Synthetic oligonucleotide
accugccccacucucacu

SEQ ID NO: 142544 - RNA, 18 nt, Artificial Sequence
  Description of Artificial Sequence: Synthetic oligonucleotide
agcccaccugccccacuc

SEQ ID NO: 142545 - RNA, 18 nt, Artificial Sequence
  Description of Artificial Sequence: Synthetic oligonucleotide
aggccagcccaccugccc

SEQ ID NO: 142546 - RNA, 18 nt, Artificial Sequence
  Description of Artificial Sequence: Synthetic oligonucleotide
gugccaggccagcccacc

SEQ ID NO: 142547 - RNA, 18 nt, Artificial Sequence
  Description of Artificial Sequence: Synthetic oligonucleotide
ugggugugccaggccagc

SEQ ID NO: 142548 - RNA, 18 nt, Artificial Sequence
  Description of Artificial Sequence: Synthetic oligonucleotide
acgacugggugugccagg

SEQ ID NO: 142549 - RNA, 18 nt, Artificial Sequence
  Description of Artificial Sequence: Synthetic oligonucleotide
ccaggacgacugggugug

SEQ ID NO: 142550 - RNA, 18 nt, Artificial Sequence
  Description of Artificial Sequence: Synthetic oligonucleotide
aacccccaggacgacugg

SEQ ID NO: 142551 - RNA, 18 nt, Artificial Sequence
  Description of Artificial Sequence: Synthetic oligonucleotide
gggccaacccccaggacg

SEQ ID NO: 142552 - RNA, 18 nt, Artificial Sequence
  Description of Artificial Sequence: Synthetic oligonucleotide
agugagggccaaccccca

SEQ ID NO: 142553 - RNA, 18 nt, Artificial Sequence
  Description of Artificial Sequence: Synthetic oligonucleotide
ccugcagugagggccaac

SEQ ID NO: 142554 - RNA, 18 nt, Artificial Sequence
  Description of Artificial Sequence: Synthetic oligonucleotide
agugcccugcagugaggg

SEQ ID NO: 142555 - RNA, 18 nt, Artificial Sequence
  Description of Artificial Sequence: Synthetic oligonucleotide
ggcacagugcccugcagu

SEQ ID NO: 142556 - RNA, 18 nt, Artificial Sequence
  Description of Artificial Sequence: Synthetic oligonucleotide
gcucaggcacagugcccu

SEQ ID NO: 142557 - RNA, 18 nt, Artificial Sequence
  Description of Artificial Sequence: Synthetic oligonucleotide
ucagagcucaggcacagu

SEQ ID NO: 142558 - RNA, 18 nt, Artificial Sequence
  Description of Artificial Sequence: Synthetic oligonucleotide
cacugucagagcucaggc

SEQ ID NO: 142559 - RNA, 18 nt, Artificial Sequence
  Description of Artificial Sequence: Synthetic oligonucleotide
ccccacacugucagagcu

SEQ ID NO: 142560 - RNA, 18 nt, Artificial Sequence
  Description of Artificial Sequence: Synthetic oligonucleotide
cacuuccccacacuguca

SEQ ID NO: 142561 - RNA, 18 nt, Artificial Sequence
  Description of Artificial Sequence: Synthetic oligonucleotide
agggacacuuccccacac

SEQ ID NO: 142562 - RNA, 18 nt, Artificial Sequence
  Description of Artificial Sequence: Synthetic oligonucleotide
aucacagggacacuuccc

SEQ ID NO: 142563 - RNA, 18 nt, Artificial Sequence
  Description of Artificial Sequence: Synthetic oligonucleotide
ccaagaucacagggacac

SEQ ID NO: 142564 - RNA, 18 nt, Artificial Sequence
  Description of Artificial Sequence: Synthetic oligonucleotide
cacugccaagaucacagg

SEQ ID NO: 142565 - RNA, 18 nt, Artificial Sequence
  Description of Artificial Sequence: Synthetic oligonucleotide
uguuccacugccaagauc

SEQ ID NO: 142566 - RNA, 18 nt, Artificial Sequence
  Description of Artificial Sequence: Synthetic oligonucleotide
uugcauguuccacugcca

SEQ ID NO: 142567 - RNA, 18 nt, Artificial Sequence
  Description of Artificial Sequence: Synthetic oligonucleotide
gugccuugcauguuccac

SEQ ID NO: 142568 - RNA, 18 nt, Artificial Sequence
  Description of Artificial Sequence: Synthetic oligonucleotide
agucagugccuugcaugu

SEQ ID NO: 142569 - RNA, 18 nt, Artificial Sequence
  Description of Artificial Sequence: Synthetic oligonucleotide
ugcucagucagugccuug

SEQ ID NO: 142570 - RNA, 18 nt, Artificial Sequence
  Description of Artificial Sequence: Synthetic oligonucleotide
cugcaugcucagucagug

SEQ ID NO: 142571 - RNA, 18 nt, Artificial Sequence
  Description of Artificial Sequence: Synthetic oligonucleotide
ugauccugcaugcucagu

SEQ ID NO: 142572 - RNA, 18 nt, Artificial Sequence
  Description of Artificial Sequence: Synthetic oligonucleotide
ggagcugauccugcaugc

SEQ ID NO: 142573 - RNA, 18 nt, Artificial Sequence
  Description of Artificial Sequence: Synthetic oligonucleotide
gagauggagcugauccug

SEQ ID NO: 142574 - RNA, 18 nt, Artificial Sequence
  Description of Artificial Sequence: Synthetic oligonucleotide
auaaugagauggagcuga

SEQ ID NO: 142575 - RNA, 18 nt, Artificial Sequence
  Description of Artificial Sequence: Synthetic oligonucleotide
cguacauaaugagaugga

SEQ ID NO: 142576 - RNA, 18 nt, Artificial Sequence
  Description of Artificial Sequence: Synthetic oligonucleotide
aucuacguacauaaugag

SEQ ID NO: 142577 - RNA, 18 nt, Artificial Sequence
  Description of Artificial Sequence: Synthetic oligonucleotide
ccucuaucuacguacaua

SEQ ID NO: 142578 - RNA, 18 nt, Artificial Sequence
  Description of Artificial Sequence: Synthetic oligonucleotide
cuccaccucuaucuacgu

SEQ ID NO: 142579 - RNA, 18 nt, Artificial Sequence
  Description of Artificial Sequence: Synthetic oligonucleotide
ccugucuccaccucuauc

SEQ ID NO: 142580 - RNA, 18 nt, Artificial Sequence
  Description of Artificial Sequence: Synthetic oligonucleotide
uuuuuccugucuccaccu

SEQ ID NO: 142581 - RNA, 18 nt, Artificial Sequence
  Description of Artificial Sequence: Synthetic oligonucleotide
uagucuuuuuccugucuc

SEQ ID NO: 142582 - RNA, 18 nt, Artificial Sequence
  Description of Artificial Sequence: Synthetic oligonucleotide
uggcuuagucuuuuuccu

SEQ ID NO: 142583 - RNA, 18 nt, Artificial Sequence
  Description of Artificial Sequence: Synthetic oligonucleotide
acgucuggcuuagucuuu

SEQ ID NO: 142584 - RNA, 18 nt, Artificial Sequence
  Description of Artificial Sequence: Synthetic oligonucleotide
ccaccacgucuggcuuag

SEQ ID NO: 142585 - RNA, 18 nt, Artificial Sequence
  Description of Artificial Sequence: Synthetic oligonucleotide
gugagccaccacgucugg

SEQ ID NO: 142586 - RNA, 18 nt, Artificial Sequence
  Description of Artificial Sequence: Synthetic oligonucleotide
caggugugagccaccacg

SEQ ID NO: 142587 - RNA, 18 nt, Artificial Sequence
  Description of Artificial Sequence: Synthetic oligonucleotide
gauuacaggugugagcca

SEQ ID NO: 142588 - RNA, 18 nt, Artificial Sequence
  Description of Artificial Sequence: Synthetic oligonucleotide
gcugggauuacaggugug

SEQ ID NO: 142589 - RNA, 18 nt, Artificial Sequence
  Description of Artificial Sequence: Synthetic oligonucleotide
aaagugcugggauuacag

SEQ ID NO: 142590 - RNA, 18 nt, Artificial Sequence
  Description of Artificial Sequence: Synthetic oligonucleotide
cugccaaagugcugggau

SEQ ID NO: 142591 - RNA, 18 nt, Artificial Sequence
  Description of Artificial Sequence: Synthetic oligonucleotide
ucggccugccaaagugcu

SEQ ID NO: 142592 - RNA, 18 nt, Artificial Sequence
  Description of Artificial Sequence: Synthetic oligonucleotide
ccgccucggccugccaaa

SEQ ID NO: 142593 - RNA, 18 nt, Artificial Sequence
  Description of Artificial Sequence: Synthetic oligonucleotide
uccacccgccucggccug

SEQ ID NO: 142594 - RNA, 18 nt, Artificial Sequence
  Description of Artificial Sequence: Synthetic oligonucleotide
agugauccacccgccucg

SEQ ID NO: 142595 - RNA, 18 nt, Artificial Sequence
  Description of Artificial Sequence: Synthetic oligonucleotide
ccucaagugauccacccg

SEQ ID NO: 142596 - RNA, 18 nt, Artificial Sequence
  Description of Artificial Sequence: Synthetic oligonucleotide
ccugaccucaagugaucc

SEQ ID NO: 142597 - RNA, 18 nt, Artificial Sequence
  Description of Artificial Sequence: Synthetic oligonucleotide
gaacuccugaccucaagu

SEQ ID NO: 142598 - RNA, 18 nt, Artificial Sequence
  Description of Artificial Sequence: Synthetic oligonucleotide
guuucgaacuccugaccu

SEQ ID NO: 142599 - RNA, 18 nt, Artificial Sequence
  Description of Artificial Sequence: Synthetic oligonucleotide
ggcugguuucgaacuccu

SEQ ID NO: 142600 - RNA, 18 nt, Artificial Sequence
  Description of Artificial Sequence: Synthetic oligonucleotide
ggccaggcugguuucgaa

SEQ ID NO: 142601 - RNA, 18 nt, Artificial Sequence
  Description of Artificial Sequence: Synthetic oligonucleotide
auguuggccaggcugguu

SEQ ID NO: 142602 - RNA, 18 nt, Artificial Sequence
  Description of Artificial Sequence: Synthetic oligonucleotide
ucaccauguuggccaggc

SEQ ID NO: 142603 - RNA, 18 nt, Artificial Sequence
  Description of Artificial Sequence: Synthetic oligonucleotide
ggguuucaccauguuggc

SEQ ID NO: 142604 - RNA, 18 nt, Artificial Sequence
  Description of Artificial Sequence: Synthetic oligonucleotide
uuguauuuuuaguagaga

SEQ ID NO: 142605 - RNA, 18 nt, Artificial Sequence
  Description of Artificial Sequence: Synthetic oligonucleotide
auuuuuuguauuuuuagu

SEQ ID NO: 142606 - RNA, 18 nt, Artificial Sequence
  Description of Artificial Sequence: Synthetic oligonucleotide
ggcuaauuuuuuguauuu

SEQ ID NO: 142607 - RNA, 18 nt, Artificial Sequence
  Description of Artificial Sequence: Synthetic oligonucleotide
caucuggcuaauuuuuug

SEQ ID NO: 142608 - RNA, 18 nt, Artificial Sequence
  Description of Artificial Sequence: Synthetic oligonucleotide
caccacaucuggcuaauu

SEQ ID NO: 142609 - RNA, 18 nt, Artificial Sequence
  Description of Artificial Sequence: Synthetic oligonucleotide
cgugccaccacaucuggc

SEQ ID NO: 142610 - RNA, 18 nt, Artificial Sequence
  Description of Artificial Sequence: Synthetic oligonucleotide
aggcgcgugccaccacau

SEQ ID NO: 142611 - RNA, 18 nt, Artificial Sequence
  Description of Artificial Sequence: Synthetic oligonucleotide
auuacaggcgcgugccac

SEQ ID NO: 142612 - RNA, 18 nt, Artificial Sequence
  Description of Artificial Sequence: Synthetic oligonucleotide
cugggauuacaggcgcgu

SEQ ID NO: 142613 - RNA, 18 nt, Artificial Sequence
  Description of Artificial Sequence: Synthetic oligonucleotide
aguagcugggauuacagg

SEQ ID NO: 142614 - RNA, 18 nt, Artificial Sequence
  Description of Artificial Sequence: Synthetic oligonucleotide
ucccaaguagcugggauu

SEQ ID NO: 142615 - RNA, 18 nt, Artificial Sequence
  Description of Artificial Sequence: Synthetic oligonucleotide
cagccucccaaguagcug

SEQ ID NO: 142616 - RNA, 18 nt, Artificial Sequence
  Description of Artificial Sequence: Synthetic oligonucleotide
uggcucagccucccaagu

SEQ ID NO: 142617 - RNA, 18 nt, Artificial Sequence
  Description of Artificial Sequence: Synthetic oligonucleotide
ucuccuggcucagccucc

SEQ ID NO: 142618 - RNA, 18 nt, Artificial Sequence
  Description of Artificial Sequence: Synthetic oligonucleotide
gcgauucuccuggcucag

SEQ ID NO: 142619 - RNA, 18 nt, Artificial Sequence
  Description of Artificial Sequence: Synthetic oligonucleotide
uucaagcgauucuccugg

SEQ ID NO: 142620 - RNA, 18 nt, Artificial Sequence
  Description of Artificial Sequence: Synthetic oligonucleotide
ucggguucaagcgauucu

SEQ ID NO: 142621 - RNA, 18 nt, Artificial Sequence
  Description of Artificial Sequence: Synthetic oligonucleotide
accucucggguucaagcg

SEQ ID NO: 142622 - RNA, 18 nt, Artificial Sequence
  Description of Artificial Sequence: Synthetic oligonucleotide
ccuccaccucucggguuc

SEQ ID NO: 142623 - RNA, 18 nt, Artificial Sequence
  Description of Artificial Sequence: Synthetic oligonucleotide
ugcaaccuccaccucucg

SEQ ID NO: 142624 - RNA, 18 nt, Artificial Sequence
  Description of Artificial Sequence: Synthetic oligonucleotide
cucacugcaaccuccacc

SEQ ID NO: 142625 - RNA, 18 nt, Artificial Sequence
  Description of Artificial Sequence: Synthetic oligonucleotide
uuuggcucacugcaaccu

SEQ ID NO: 142626 - RNA, 18 nt, Artificial Sequence
  Description of Artificial Sequence: Synthetic oligonucleotide
gggauuuuggcucacugc

SEQ ID NO: 142627 - RNA, 18 nt, Artificial Sequence
  Description of Artificial Sequence: Synthetic oligonucleotide
guggugggauuuuggcuc

SEQ ID NO: 142628 - RNA, 18 nt, Artificial Sequence
  Description of Artificial Sequence: Synthetic oligonucleotide
gugcaguggugggauuuu

SEQ ID NO: 142629 - RNA, 18 nt, Artificial Sequence
  Description of Artificial Sequence: Synthetic oligonucleotide
cuggagugcagugguggg

SEQ ID NO: 142630 - RNA, 18 nt, Artificial Sequence
  Description of Artificial Sequence: Synthetic oligonucleotide
ccaggcuggagugcagug

SEQ ID NO: 142631 - RNA, 18 nt, Artificial Sequence
  Description of Artificial Sequence: Synthetic oligonucleotide
gucacccaggcuggagug

SEQ ID NO: 142632 - RNA, 18 nt, Artificial Sequence
  Description of Artificial Sequence: Synthetic oligonucleotide
acucugucacccaggcug

SEQ ID NO: 142633 - RNA, 18 nt, Artificial Sequence
  Description of Artificial Sequence: Synthetic oligonucleotide
gucucacucugucaccca

SEQ ID NO: 142634 - RNA, 18 nt, Artificial Sequence
  Description of Artificial Sequence: Synthetic oligonucleotide
acagggucucacucuguc

SEQ ID NO: 142635 - RNA, 18 nt, Artificial Sequence
  Description of Artificial Sequence: Synthetic oligonucleotide
uugagacagggucucacu

SEQ ID NO: 142636 - RNA, 18 nt, Artificial Sequence
  Description of Artificial Sequence: Synthetic oligonucleotide
uuuuuuugagacaggguc

SEQ ID NO: 142637 - RNA, 18 nt, Artificial Sequence
  Description of Artificial Sequence: Synthetic oligonucleotide
uuccuuuuuuuugagaca

SEQ ID NO: 142638 - RNA, 18 nt, Artificial Sequence
  Description of Artificial Sequence: Synthetic oligonucleotide
uccuuuuccuuuuuuuug

SEQ ID NO: 142639 - RNA, 18 nt, Artificial Sequence
  Description of Artificial Sequence: Synthetic oligonucleotide
guuaguccuuuuccuuuu

SEQ ID NO: 142640 - RNA, 18 nt, Artificial Sequence
  Description of Artificial Sequence: Synthetic oligonucleotide
ugccuguuaguccuuuuc

SEQ ID NO: 142641 - RNA, 18 nt, Artificial Sequence
  Description of Artificial Sequence: Synthetic oligonucleotide
cauacugccuguuagucc

SEQ ID NO: 142642 - RNA, 18 nt, Artificial Sequence
  Description of Artificial Sequence: Synthetic oligonucleotide
gacagcauacugccuguu

SEQ ID NO: 142643 - RNA, 18 nt, Artificial Sequence
  Description of Artificial Sequence: Synthetic oligonucleotide
aacaugacagcauacugc

SEQ ID NO: 142644 - RNA, 18 nt, Artificial Sequence
  Description of Artificial Sequence: Synthetic oligonucleotide
acauuaacaugacagcau

SEQ ID NO: 142645 - RNA, 18 nt, Artificial Sequence
  Description of Artificial Sequence: Synthetic oligonucleotide
accccacauuaacaugac

SEQ ID NO: 142646 - RNA, 18 nt, Artificial Sequence
  Description of Artificial Sequence: Synthetic oligonucleotide
uuuccaccccacauuaac

SEQ ID NO: 142647 - RNA, 18 nt, Artificial Sequence
  Description of Artificial Sequence: Synthetic oligonucleotide
caauuuuuccaccccaca

SEQ ID NO: 142648 - RNA, 18 nt, Artificial Sequence
  Description of Artificial Sequence: Synthetic oligonucleotide
gcagacaauuuuuccacc

SEQ ID NO: 142649 - RNA, 18 nt, Artificial Sequence
  Description of Artificial Sequence: Synthetic oligonucleotide
aaaaugcagacaauuuuu

SEQ ID NO: 142650 - RNA, 18 nt, Artificial Sequence
  Description of Artificial Sequence: Synthetic oligonucleotide
cagaaaaaaugcagacaa

SEQ ID NO: 142651 - RNA, 18 nt, Artificial Sequence
  Description of Artificial Sequence: Synthetic oligonucleotide
aaaugcagaaaaaaugca

SEQ ID NO: 142652 - RNA, 18 nt, Artificial Sequence
  Description of Artificial Sequence: Synthetic oligonucleotide
uuuaaaaaugcagaaaaa

SEQ ID NO: 142653 - RNA, 18 nt, Artificial Sequence
  Description of Artificial Sequence: Synthetic oligonucleotide
ggaauuuuaaaaaugcag

SEQ ID NO: 142654 - RNA, 18 nt, Artificial Sequence
  Description of Artificial Sequence: Synthetic oligonucleotide
guguuggaauuuuaaaaa

SEQ ID NO: 142655 - RNA, 18 nt, Artificial Sequence
  Description of Artificial Sequence: Synthetic oligonucleotide
uuauuguguuggaauuuu

SEQ ID NO: 142656 - RNA, 18 nt, Artificial Sequence
  Description of Artificial Sequence: Synthetic oligonucleotide
uguauuuauuguguugga

SEQ ID NO: 142657 - RNA, 18 nt, Artificial Sequence
  Description of Artificial Sequence: Synthetic oligonucleotide
auuauuguauuuauugug

SEQ ID NO: 142658 - RNA, 18 nt, Artificial Sequence
  Description of Artificial Sequence: Synthetic oligonucleotide
uaguuauuauuguauuua

SEQ ID NO: 142659 - RNA, 18 nt, Artificial Sequence
  Description of Artificial Sequence: Synthetic oligonucleotide
uagcauaguuauuauugu

SEQ ID NO: 142660 - RNA, 18 nt, Artificial Sequence
  Description of Artificial Sequence: Synthetic oligonucleotide
gaugucguggaucacaaa

SEQ ID NO: 142661 - RNA, 18 nt, Artificial Sequence
  Description of Artificial Sequence: Synthetic oligonucleotide
gucucgaugucguggauc

SEQ ID NO: 142662 - RNA, 18 nt, Artificial Sequence
  Description of Artificial Sequence: Synthetic oligonucleotide
acaaugucucgaugucgu

SEQ ID NO: 142663 - RNA, 18 nt, Artificial Sequence
  Description of Artificial Sequence: Synthetic oligonucleotide
cugccacaaugucucgau

SEQ ID NO: 142664 - RNA, 18 nt, Artificial Sequence
  Description of Artificial Sequence: Synthetic oligonucleotide
ucugccugccacaauguc

SEQ ID NO: 142665 - RNA, 18 nt, Artificial Sequence
  Description of Artificial Sequence: Synthetic oligonucleotide
ccuucucugccugccaca

SEQ ID NO: 142666 - RNA, 18 nt, Artificial Sequence
  Description of Artificial Sequence: Synthetic oligonucleotide
cagccccuucucugccug

SEQ ID NO: 142667 - RNA, 18 nt, Artificial Sequence
  Description of Artificial Sequence: Synthetic oligonucleotide
cacaccagccccuucucu

SEQ ID NO: 142668 - RNA, 18 nt, Artificial Sequence
  Description of Artificial Sequence: Synthetic oligonucleotide
gcuuccacaccagccccu

SEQ ID NO: 142669 - RNA, 18 nt, Artificial Sequence
  Description of Artificial Sequence: Synthetic oligonucleotide
caacugcuuccacaccag

SEQ ID NO: 142670 - RNA, 18 nt, Artificial Sequence
  Description of Artificial Sequence: Synthetic oligonucleotide
uucaccaacugcuuccac

SEQ ID NO: 142671 - RNA, 18 nt, Artificial Sequence
  Description of Artificial Sequence: Synthetic oligonucleotide
ggccauucaccaacugcu

SEQ ID NO: 142672 - RNA, 18 nt, Artificial Sequence
  Description of Artificial Sequence: Synthetic oligonucleotide
aggcaggccauucaccaa

SEQ ID NO: 142673 - RNA, 18 nt, Artificial Sequence
  Description of Artificial Sequence: Synthetic oligonucleotide
uagggaggcaggccauuc

SEQ ID NO: 142674 - RNA, 18 nt, Artificial Sequence
  Description of Artificial Sequence: Synthetic oligonucleotide
ccuuguagggaggcaggc

SEQ ID NO: 142675 - RNA, 18 nt, Artificial Sequence
  Description of Artificial Sequence: Synthetic oligonucleotide
gaucuccuuguagggagg

SEQ ID NO: 142676 - RNA, 18 nt, Artificial Sequence
  Description of Artificial Sequence: Synthetic oligonucleotide
acgcugaucuccuuguag

SEQ ID NO: 142677 - RNA, 18 nt, Artificial Sequence
  Description of Artificial Sequence: Synthetic oligonucleotide
cgugcacgcugaucuccu

SEQ ID NO: 142678 - RNA, 18 nt, Artificial Sequence
  Description of Artificial Sequence: Synthetic oligonucleotide
gaagacgugcacgcugau

SEQ ID NO: 142679 - RNA, 18 nt, Artificial Sequence
  Description of Artificial Sequence: Synthetic oligonucleotide
cgguagaagacgugcacg

SEQ ID NO: 142680 - RNA, 18 nt, Artificial Sequence
  Description of Artificial Sequence: Synthetic oligonucleotide
ggcagcgguagaagacgu

SEQ ID NO: 142681 - RNA, 18 nt, Artificial Sequence
  Description of Artificial Sequence: Synthetic oligonucleotide
gcacuggcagcgguagaa

SEQ ID NO: 142682 - RNA, 18 nt, Artificial Sequence
  Description of Artificial Sequence: Synthetic oligonucleotide
guggugcacuggcagcgg

SEQ ID NO: 142683 - RNA, 18 nt, Artificial Sequence
  Description of Artificial Sequence: Synthetic oligonucleotide
ccacuguggugcacuggc

SEQ ID NO: 142684 - RNA, 18 nt, Artificial Sequence
  Description of Artificial Sequence: Synthetic oligonucleotide
ggucuccacuguggugca

SEQ ID NO: 142685 - RNA, 18 nt, Artificial Sequence
  Description of Artificial Sequence: Synthetic oligonucleotide
cgcacggucuccacugug

SEQ ID NO: 142686 - RNA, 18 nt, Artificial Sequence
  Description of Artificial Sequence: Synthetic oligonucleotide
gcucccgcacggucucca

SEQ ID NO: 142687 - RNA, 18 nt, Artificial Sequence
  Description of Artificial Sequence: Synthetic oligonucleotide
agugagcucccgcacggu

SEQ ID NO: 142688 - RNA, 18 nt, Artificial Sequence
  Description of Artificial Sequence: Synthetic oligonucleotide
aacucagugagcucccgc

SEQ ID NO: 142689 - RNA, 18 nt, Artificial Sequence
  Description of Artificial Sequence: Synthetic oligonucleotide
uggcgaacucagugagcu

SEQ ID NO: 142690 - RNA, 18 nt, Artificial Sequence
  Description of Artificial Sequence: Synthetic oligonucleotide
gcucuuggcgaacucagu

SEQ ID NO: 142691 - RNA, 18 nt, Artificial Sequence
  Description of Artificial Sequence: Synthetic oligonucleotide
gggaugcucuuggcgaac

SEQ ID NO: 142692 - RNA, 18 nt, Artificial Sequence
  Description of Artificial Sequence: Synthetic oligonucleotide
gaggcugcugaagcuggg

SEQ ID NO: 142693 - RNA, 18 nt, Artificial Sequence
  Description of Artificial Sequence: Synthetic oligonucleotide
agaggcugcugaagcugg

SEQ ID NO: 142694 - RNA, 18 nt, Artificial Sequence
  Description of Artificial Sequence: Synthetic oligonucleotide
gaggaagaggcugcugaa

SEQ ID NO: 142695 - RNA, 18 nt, Artificial Sequence
  Description of Artificial Sequence: Synthetic oligonucleotide
ucguugaggaagaggcug

SEQ ID NO: 142696 - RNA, 18 nt, Artificial Sequence
  Description of Artificial Sequence: Synthetic oligonucleotide
ccuggucguugaggaaga

SEQ ID NO: 142697 - RNA, 18 nt, Artificial Sequence
  Description of Artificial Sequence: Synthetic oligonucleotide
gguaaccuggucguugag

SEQ ID NO: 142698 - RNA, 18 nt, Artificial Sequence
  Description of Artificial Sequence: Synthetic oligonucleotide
agaaggguaaccuggucg

SEQ ID NO: 142699 - RNA, 18 nt, Artificial Sequence
  Description of Artificial Sequence: Synthetic oligonucleotide
acuugagaaggguaaccu

SEQ ID NO: 142700 - RNA, 18 nt, Artificial Sequence
  Description of Artificial Sequence: Synthetic oligonucleotide
gccauacuugagaagggu

SEQ ID NO: 142701 - RNA, 18 nt, Artificial Sequence
  Description of Artificial Sequence: Synthetic oligonucleotide
ugcacgccauacuugaga

SEQ ID NO: 142702 - RNA, 18 nt, Artificial Sequence
  Description of Artificial Sequence: Synthetic oligonucleotide
ccucgugcacgccauacu

SEQ ID NO: 142703 - RNA, 18 nt, Artificial Sequence
  Description of Artificial Sequence: Synthetic oligonucleotide
gauggccucgugcacgcc

SEQ ID NO: 142704 - RNA, 18 nt, Artificial Sequence
  Description of Artificial Sequence: Synthetic oligonucleotide
gcgaagauggccucgugc

SEQ ID NO: 142705 - RNA, 18 nt, Artificial Sequence
  Description of Artificial Sequence: Synthetic oligonucleotide
gcauggcgaagauggccu

SEQ ID NO: 142706 - RNA, 18 nt, Artificial Sequence
  Description of Artificial Sequence: Synthetic oligonucleotide
ggccagcauggcgaagau

SEQ ID NO: 142707 - RNA, 18 nt, Artificial Sequence
  Description of Artificial Sequence: Synthetic oligonucleotide
auagaggccagcauggcg

SEQ ID NO: 142708 - RNA, 18 nt, Artificial Sequence
  Description of Artificial Sequence: Synthetic oligonucleotide
ugacgauagaggccagca

SEQ ID NO: 142709 - RNA, 18 nt, Artificial Sequence
  Description of Artificial Sequence: Synthetic oligonucleotide
cuuguugacgauagaggc

SEQ ID NO: 142710 - RNA, 18 nt, Artificial Sequence
  Description of Artificial Sequence: Synthetic oligonucleotide
ccguccuuguugacgaua

SEQ ID NO: 142711 - RNA, 18 nt, Artificial Sequence
  Description of Artificial Sequence: Synthetic oligonucleotide
gcagcccguccuuguuga

SEQ ID NO: 142712 - RNA, 18 nt, Artificial Sequence
  Description of Artificial Sequence: Synthetic oligonucleotide
uaccagcagcccguccuu

SEQ ID NO: 142713 - RNA, 18 nt, Artificial Sequence
  Description of Artificial Sequence: Synthetic oligonucleotide
uuggcuaccagcagcccg

SEQ ID NO: 142714 - RNA, 18 nt, Artificial Sequence
  Description of Artificial Sequence: Synthetic oligonucleotide
ugccguuggcuaccagca

SEQ ID NO: 142715 - RNA, 18 nt, Artificial Sequence
  Description of Artificial Sequence: Synthetic oligonucleotide
gccacugccguuggcuac

SEQ ID NO: 142716 - RNA, 18 nt, Artificial Sequence
  Description of Artificial Sequence: Synthetic oligonucleotide
acaaagccacugccguug

SEQ ID NO: 142717 - RNA, 18 nt, Artificial Sequence
  Description of Artificial Sequence: Synthetic oligonucleotide
gggugacaaagccacugc

SEQ ID NO: 142718 - RNA, 18 nt, Artificial Sequence
  Description of Artificial Sequence: Synthetic oligonucleotide
cucacgggugacaaagcc

SEQ ID NO: 142719 - RNA, 18 nt, Artificial Sequence
  Description of Artificial Sequence: Synthetic oligonucleotide
aggaacucacgggugaca

SEQ ID NO: 142720 - RNA, 18 nt, Artificial Sequence
  Description of Artificial Sequence: Synthetic oligonucleotide
ugcgcaggaacucacggg

SEQ ID NO: 142721 - RNA, 18 nt, Artificial Sequence
  Description of Artificial Sequence: Synthetic oligonucleotide
gaggcugcgcaggaacuc

SEQ ID NO: 142722 - RNA, 18 nt, Artificial Sequence
  Description of Artificial Sequence: Synthetic oligonucleotide
uugcggaggcugcgcagg

SEQ ID NO: 142723 - RNA, 18 nt, Artificial Sequence
  Description of Artificial Sequence: Synthetic oligonucleotide
aggguuugcggaggcugc

SEQ ID NO: 142724 - RNA, 18 nt, Artificial Sequence
  Description of Artificial Sequence: Synthetic oligonucleotide
acugaaggguuugcggag

SEQ ID NO: 142725 - RNA, 18 nt, Artificial Sequence
  Description of Artificial Sequence: Synthetic oligonucleotide
auaucacugaaggguuug

SEQ ID NO: 142726 - RNA, 18 nt, Artificial Sequence
  Description of Artificial Sequence: Synthetic oligonucleotide
caaugauaucacugaagg

SEQ ID NO: 142727 - RNA, 18 nt, Artificial Sequence
  Description of Artificial Sequence: Synthetic oligonucleotide
aggcucaaugauaucacu

SEQ ID NO: 142728 - RNA, 18 nt, Artificial Sequence
  Description of Artificial Sequence: Synthetic oligonucleotide
aacuuaggcucaaugaua

SEQ ID NO: 142729 - RNA, 18 nt, Artificial Sequence
  Description of Artificial Sequence: Synthetic oligonucleotide
auucaaacuuaggcucaa

SEQ ID NO: 142730 - RNA, 18 nt, Artificial Sequence
  Description of Artificial Sequence: Synthetic oligonucleotide
agcaaauucaaacuuagg

SEQ ID NO: 142731 - RNA, 18 nt, Artificial Sequence
  Description of Artificial Sequence: Synthetic oligonucleotide
uugacagcaaauucaaac

SEQ ID NO: 142732 - RNA, 18 nt, Artificial Sequence
  Description of Artificial Sequence: Synthetic oligonucleotide
ugaacuugacagcaaauu

SEQ ID NO: 142733 - RNA, 18 nt, Artificial Sequence
  Description of Artificial Sequence: Synthetic oligonucleotide
ggcguugaacuugacagc

SEQ ID NO: 142734 - RNA, 18 nt, Artificial Sequence
  Description of Artificial Sequence: Synthetic oligonucleotide
uccagggcguugaacuug

SEQ ID NO: 142735 - RNA, 18 nt, Artificial Sequence
  Description of Artificial Sequence: Synthetic oligonucleotide
caaguuccagggcguuga

SEQ ID NO: 142736 - RNA, 18 nt, Artificial Sequence
  Description of Artificial Sequence: Synthetic oligonucleotide
gucaucaaguuccagggc

SEQ ID NO: 142737 - RNA, 18 nt, Artificial Sequence
  Description of Artificial Sequence: Synthetic oligonucleotide
ucacugucaucaaguucc

SEQ ID NO: 142738 - RNA, 18 nt, Artificial Sequence
  Description of Artificial Sequence: Synthetic oligonucleotide
ccaggucacugucaucaa

SEQ ID NO: 142739 - RNA, 18 nt, Artificial Sequence
  Description of Artificial Sequence: Synthetic oligonucleotide
uagggccaggucacuguc

SEQ ID NO: 142740 - RNA, 18 nt, Artificial Sequence
  Description of Artificial Sequence: Synthetic oligonucleotide
augaauagggccagguca

SEQ ID NO: 142741 - RNA, 18 nt, Artificial Sequence
  Description of Artificial Sequence: Synthetic oligonucleotide
ccgcaaugaauagggcca

SEQ ID NO: 142742 - RNA, 18 nt, Artificial Sequence
  Description of Artificial Sequence: Synthetic oligonucleotide
gauggccgcaaugaauag

SEQ ID NO: 142743 - RNA, 18 nt, Artificial Sequence
  Description of Artificial Sequence: Synthetic oligonucleotide
agaaugauggccgcaaug

SEQ ID NO: 142744 - RNA, 18 nt, Artificial Sequence
  Description of Artificial Sequence: Synthetic oligonucleotide
cacacagaaugauggccg

SEQ ID NO: 142745 - RNA, 18 nt, Artificial Sequence
  Description of Artificial Sequence: Synthetic oligonucleotide
ccaccugccccacucuca

SEQ ID NO: 142746 - RNA, 18 nt, Artificial Sequence
  Description of Artificial Sequence: Synthetic oligonucleotide
ccagcccaccugccccac

SEQ ID NO: 142747 - RNA, 18 nt, Artificial Sequence
  Description of Artificial Sequence: Synthetic oligonucleotide
ccaggccagcccaccugc

SEQ ID NO: 142748 - RNA, 18 nt, Artificial Sequence
  Description of Artificial Sequence: Synthetic oligonucleotide
gugugccaggccagccca

SEQ ID NO: 142749 - RNA, 18 nt, Artificial Sequence
  Description of Artificial Sequence: Synthetic oligonucleotide
acugggugugccaggcca

SEQ ID NO: 142750 - RNA, 18 nt, Artificial Sequence
  Description of Artificial Sequence: Synthetic oligonucleotide
ggacgacugggugugcca

SEQ ID NO: 142751 - RNA, 18 nt, Artificial Sequence
  Description of Artificial Sequence: Synthetic oligonucleotide
ccccaggacgacugggug

SEQ ID NO: 142752 - RNA, 18 nt, Artificial Sequence
  Description of Artificial Sequence: Synthetic oligonucleotide
ccaacccccaggacgacu

SEQ ID NO: 142753 - RNA, 18 nt, Artificial Sequence
  Description of Artificial Sequence: Synthetic oligonucleotide
gagggccaacccccagga

SEQ ID NO: 142754 - RNA, 18 nt, Artificial Sequence
  Description of Artificial Sequence: Synthetic oligonucleotide
gcagugagggccaacccc

SEQ ID NO: 142755 - RNA, 18 nt, Artificial Sequence
  Description of Artificial Sequence: Synthetic oligonucleotide
gcccugcagugagggcca

SEQ ID NO: 142756 - RNA, 18 nt, Artificial Sequence
  Description of Artificial Sequence: Synthetic oligonucleotide
acagugcccugcagugag

SEQ ID NO: 142757 - RNA, 18 nt, Artificial Sequence
  Description of Artificial Sequence: Synthetic oligonucleotide
caggcacagugcccugca

SEQ ID NO: 142758 - RNA, 18 nt, Artificial Sequence
  Description of Artificial Sequence: Synthetic oligonucleotide
gagcucaggcacagugcc

SEQ ID NO: 142759 - RNA, 18 nt, Artificial Sequence
  Description of Artificial Sequence: Synthetic oligonucleotide
ugucagagcucaggcaca

SEQ ID NO: 142760 - RNA, 18 nt, Artificial Sequence
  Description of Artificial Sequence: Synthetic oligonucleotide
cacacugucagagcucag

SEQ ID NO: 142761 - RNA, 18 nt, Artificial Sequence
  Description of Artificial Sequence: Synthetic oligonucleotide
uuccccacacugucagag

SEQ ID NO: 142762 - RNA, 18 nt, Artificial Sequence
  Description of Artificial Sequence: Synthetic oligonucleotide
gacacuuccccacacugu

SEQ ID NO: 142763 - RNA, 18 nt, Artificial Sequence
  Description of Artificial Sequence: Synthetic oligonucleotide
acagggacacuuccccac

SEQ ID NO: 142764 - RNA, 18 nt, Artificial Sequence
  Description of Artificial Sequence: Synthetic oligonucleotide
agaucacagggacacuuc

SEQ ID NO: 142765 - RNA, 18 nt, Artificial Sequence
  Description of Artificial Sequence: Synthetic oligonucleotide
ugccaagaucacagggac

SEQ ID NO: 142766 - RNA, 18 nt, Artificial Sequence
  Description of Artificial Sequence: Synthetic oligonucleotide
uccacugccaagaucaca

SEQ ID NO: 142767 - RNA, 18 nt, Artificial Sequence
  Description of Artificial Sequence: Synthetic oligonucleotide
cauguuccacugccaaga

SEQ ID NO: 142768 - RNA, 18 nt, Artificial Sequence
  Description of Artificial Sequence: Synthetic oligonucleotide
ccuugcauguuccacugc

SEQ ID NO: 142769 - RNA, 18 nt, Artificial Sequence
  Description of Artificial Sequence: Synthetic oligonucleotide
cagugccuugcauguucc

SEQ ID NO: 142770 - RNA, 18 nt, Artificial Sequence
  Description of Artificial Sequence: Synthetic oligonucleotide
ucagucagugccuugcau

SEQ ID NO: 142771 - RNA, 18 nt, Artificial Sequence
  Description of Artificial Sequence: Synthetic oligonucleotide
caugcucagucagugccu

SEQ ID NO: 142772 - RNA, 18 nt, Artificial Sequence
  Description of Artificial Sequence: Synthetic oligonucleotide
uccugcaugcucagucag

SEQ ID NO: 142773 - RNA, 18 nt, Artificial Sequence
  Description of Artificial Sequence: Synthetic oligonucleotide
gcugauccugcaugcuca

SEQ ID NO: 142774 - RNA, 18 nt, Artificial Sequence
  Description of Artificial Sequence: Synthetic oligonucleotide
auggagcugauccugcau

SEQ ID NO: 142775 - RNA, 18 nt, Artificial Sequence
  Description of Artificial Sequence: Synthetic oligonucleotide
augagauggagcugaucc

SEQ ID NO: 142776 - RNA, 18 nt, Artificial Sequence
  Description of Artificial Sequence: Synthetic oligonucleotide
acauaaugagauggagcu

SEQ ID NO: 142777 - RNA, 18 nt, Artificial Sequence
  Description of Artificial Sequence: Synthetic oligonucleotide
uacguacauaaugagaug

SEQ ID NO: 142778 - RNA, 18 nt, Artificial Sequence
  Description of Artificial Sequence: Synthetic oligonucleotide
cuaucuacguacauaaug

SEQ ID NO: 142779 - RNA, 18 nt, Artificial Sequence
  Description of Artificial Sequence: Synthetic oligonucleotide
caccucuaucuacguaca

SEQ ID NO: 142780 - RNA, 18 nt, Artificial Sequence
  Description of Artificial Sequence: Synthetic oligonucleotide
gucuccaccucuaucuac

SEQ ID NO: 142781 - RNA, 18 nt, Artificial Sequence
  Description of Artificial Sequence: Synthetic oligonucleotide
uuccugucuccaccucua

SEQ ID NO: 142782 - RNA, 18 nt, Artificial Sequence
  Description of Artificial Sequence: Synthetic oligonucleotide
ucuuuuuccugucuccac

SEQ ID NO: 142783 - RNA, 18 nt, Artificial Sequence
  Description of Artificial Sequence: Synthetic oligonucleotide
cuuagucuuuuuccuguc

SEQ ID NO: 142784 - RNA, 18 nt, Artificial Sequence
  Description of Artificial Sequence: Synthetic oligonucleotide
ucuggcuuagucuuuuuc

SEQ ID NO: 142785 - RNA, 18 nt, Artificial Sequence
  Description of Artificial Sequence: Synthetic oligonucleotide
ccacgucuggcuuagucu

SEQ ID NO: 142786 - RNA, 18 nt, Artificial Sequence
  Description of Artificial Sequence: Synthetic oligonucleotide
agccaccacgucuggcuu

SEQ ID NO: 142787 - RNA, 18 nt, Artificial Sequence
  Description of Artificial Sequence: Synthetic oligonucleotide
gugugagccaccacgucu

SEQ ID NO: 142788 - RNA, 18 nt, Artificial Sequence
  Description of Artificial Sequence: Synthetic oligonucleotide
uacaggugugagccacca

SEQ ID NO: 142789 - RNA, 18 nt, Artificial Sequence
  Description of Artificial Sequence: Synthetic oligonucleotide
gggauuacaggugugagc

SEQ ID NO: 142790 - RNA, 18 nt, Artificial Sequence
  Description of Artificial Sequence: Synthetic oligonucleotide
gugcugggauuacaggug

SEQ ID NO: 142791 - RNA, 18 nt, Artificial Sequence
  Description of Artificial Sequence: Synthetic oligonucleotide
ccaaagugcugggauuac

SEQ ID NO: 142792 - RNA, 18 nt, Artificial Sequence
  Description of Artificial Sequence: Synthetic oligonucleotide
gccugccaaagugcuggg

SEQ ID NO: 142793 - RNA, 18 nt, Artificial Sequence
  Description of Artificial Sequence: Synthetic oligonucleotide
ccucggccugccaaagug

SEQ ID NO: 142794 - RNA, 18 nt, Artificial Sequence
  Description of Artificial Sequence: Synthetic oligonucleotide
acccgccucggccugcca

SEQ ID NO: 142795 - RNA, 18 nt, Artificial Sequence
  Description of Artificial Sequence: Synthetic oligonucleotide
gauccacccgccucggcc

SEQ ID NO: 142796 - RNA, 18 nt, Artificial Sequence
  Description of Artificial Sequence: Synthetic oligonucleotide
caagugauccacccgccu

SEQ ID NO: 142797 - RNA, 18 nt, Artificial Sequence
  Description of Artificial Sequence: Synthetic oligonucleotide
gaccucaagugauccacc

SEQ ID NO: 142798 - RNA, 18 nt, Artificial Sequence
  Description of Artificial Sequence: Synthetic oligonucleotide
cuccugaccucaagugau

SEQ ID NO: 142799 - RNA, 18 nt, Artificial Sequence
  Description of Artificial Sequence: Synthetic oligonucleotide
ucgaacuccugaccucaa

SEQ ID NO: 142800 - RNA, 18 nt, Artificial Sequence
  Description of Artificial Sequence: Synthetic oligonucleotide
ugguuucgaacuccugac

SEQ ID NO: 142801 - RNA, 18 nt, Artificial Sequence
  Description of Artificial Sequence: Synthetic oligonucleotide
caggcugguuucgaacuc

SEQ ID NO: 142802 - RNA, 18 nt, Artificial Sequence
  Description of Artificial Sequence: Synthetic oligonucleotide
uuggccaggcugguuucg

SEQ ID NO: 142803 - RNA, 18 nt, Artificial Sequence
  Description of Artificial Sequence: Synthetic oligonucleotide
ccauguuggccaggcugg

SEQ ID NO: 142804 - RNA, 18 nt, Artificial Sequence
  Description of Artificial Sequence: Synthetic oligonucleotide
uuucaccauguuggccag

SEQ ID NO: 142805 - RNA, 18 nt, Artificial Sequence
  Description of Artificial Sequence: Synthetic oligonucleotide
ggguuucaccauguuggc

SEQ ID NO: 142806 - RNA, 18 nt, Artificial Sequence
  Description of Artificial Sequence: Synthetic oligonucleotide
auuuuuaguagagacggg

SEQ ID NO: 142807 - RNA, 18 nt, Artificial Sequence
  Description of Artificial Sequence: Synthetic oligonucleotide
uuuguauuuuuaguagag

SEQ ID NO: 142808 - RNA, 18 nt, Artificial Sequence
  Description of Artificial Sequence: Synthetic oligonucleotide
aauuuuuuguauuuuuag

SEQ ID NO: 142809 - RNA, 18 nt, Artificial Sequence
  Description of Artificial Sequence: Synthetic oligonucleotide
uggcuaauuuuuuguauu

SEQ ID NO: 142810 - RNA, 18 nt, Artificial Sequence
  Description of Artificial Sequence: Synthetic oligonucleotide
acaucuggcuaauuuuuu

SEQ ID NO: 142811 - RNA, 18 nt, Artificial Sequence
  Description of Artificial Sequence: Synthetic oligonucleotide
ccaccacaucuggcuaau

SEQ ID NO: 142812 - RNA, 18 nt, Artificial Sequence
  Description of Artificial Sequence: Synthetic oligonucleotide
gcgugccaccacaucugg

SEQ ID NO: 142813 - RNA, 18 nt, Artificial Sequence
  Description of Artificial Sequence: Synthetic oligonucleotide
caggcgcgugccaccaca

SEQ ID NO: 142814 - RNA, 18 nt, Artificial Sequence
  Description of Artificial Sequence: Synthetic oligonucleotide
gauuacaggcgcgugcca

SEQ ID NO: 142815 - RNA, 18 nt, Artificial Sequence
  Description of Artificial Sequence: Synthetic oligonucleotide
gcugggauuacaggcgcg

SEQ ID NO: 142816 - RNA, 18 nt, Artificial Sequence
  Description of Artificial Sequence: Synthetic oligonucleotide
aaguagcugggauuacag

SEQ ID NO: 142817 - RNA, 18 nt, Artificial Sequence
  Description of Artificial Sequence: Synthetic oligonucleotide
cucccaaguagcugggau

SEQ ID NO: 142818 - RNA, 18 nt, Artificial Sequence
  Description of Artificial Sequence: Synthetic oligonucleotide
ucagccucccaaguagcu

SEQ ID NO: 142819 - RNA, 18 nt, Artificial Sequence
  Description of Artificial Sequence: Synthetic oligonucleotide
cuggcucagccucccaag

SEQ ID NO: 142820 - RNA, 18 nt, Artificial Sequence
  Description of Artificial Sequence: Synthetic oligonucleotide
uucuccuggcucagccuc

SEQ ID NO: 142821 - RNA, 18 nt, Artificial Sequence
  Description of Artificial Sequence: Synthetic oligonucleotide
agcgauucuccuggcuca

SEQ ID NO: 142822 - RNA, 18 nt, Artificial Sequence
  Description of Artificial Sequence: Synthetic oligonucleotide
guucaagcgauucuccug

SEQ ID NO: 142823 - RNA, 18 nt, Artificial Sequence
  Description of Artificial Sequence: Synthetic oligonucleotide
cucggguucaagcgauuc

SEQ ID NO: 142824 - RNA, 18 nt, Artificial Sequence
  Description of Artificial Sequence: Synthetic oligonucleotide
caccucucggguucaagc

SEQ ID NO: 142825 - RNA, 18 nt, Artificial Sequence
  Description of Artificial Sequence: Synthetic oligonucleotide
accuccaccucucggguu

SEQ ID NO: 142826 - RNA, 18 nt, Artificial Sequence
  Description of Artificial Sequence: Synthetic oligonucleotide
cugcaaccuccaccucuc

SEQ ID NO: 142827 - RNA, 18 nt, Artificial Sequence
  Description of Artificial Sequence: Synthetic oligonucleotide
gcucacugcaaccuccac

SEQ ID NO: 142828 - RNA, 18 nt, Artificial Sequence
  Description of Artificial Sequence: Synthetic oligonucleotide
uuuuggcucacugcaacc

SEQ ID NO: 142829 - RNA, 18 nt, Artificial Sequence
  Description of Artificial Sequence: Synthetic oligonucleotide
ugggauuuuggcucacug

SEQ ID NO: 142830 - RNA, 18 nt, Artificial Sequence
  Description of Artificial Sequence: Synthetic oligonucleotide
aguggugggauuuuggcu

SEQ ID NO: 142831 - RNA, 18 nt, Artificial Sequence
  Description of Artificial Sequence: Synthetic oligonucleotide
agugcaguggugggauuu

SEQ ID NO: 142832 - RNA, 18 nt, Artificial Sequence
  Description of Artificial Sequence: Synthetic oligonucleotide
gcuggagugcaguggugg

SEQ ID NO: 142833 - RNA, 18 nt, Artificial Sequence
  Description of Artificial Sequence: Synthetic oligonucleotide
cccaggcuggagugcagu

SEQ ID NO: 142834 - RNA, 18 nt, Artificial Sequence
  Description of Artificial Sequence: Synthetic oligonucleotide
ugucacccaggcuggagu

SEQ ID NO: 142835 - RNA, 18 nt, Artificial Sequence
  Description of Artificial Sequence: Synthetic oligonucleotide
cacucugucacccaggcu

SEQ ID NO: 142836 - RNA, 18 nt, Artificial Sequence
  Description of Artificial Sequence: Synthetic oligonucleotide
ggucucacucugucaccc

SEQ ID NO: 142837 - RNA, 18 nt, Artificial Sequence
  Description of Artificial Sequence: Synthetic oligonucleotide
gacagggucucacucugu

SEQ ID NO: 142838 - RNA, 18 nt, Artificial Sequence
  Description of Artificial Sequence: Synthetic oligonucleotide
uuugagacagggucucac

SEQ ID NO: 142839 - RNA, 18 nt, Artificial Sequence
  Description of Artificial Sequence: Synthetic oligonucleotide
uuuuuuuugagacagggu

SEQ ID NO: 142840 - RNA, 18 nt, Artificial Sequence
  Description of Artificial Sequence: Synthetic oligonucleotide
uuuccuuuuuuuugagac

SEQ ID NO: 142841 - RNA, 18 nt, Artificial Sequence
  Description of Artificial Sequence: Synthetic oligonucleotide
guccuuuuccuuuuuuuu

SEQ ID NO: 142842 - RNA, 18 nt, Artificial Sequence
  Description of Artificial Sequence: Synthetic oligonucleotide
uguuaguccuuuuccuuu

SEQ ID NO: 142843 - RNA, 18 nt, Artificial Sequence
  Description of Artificial Sequence: Synthetic oligonucleotide
auuuuuccaccccacauu

SEQ ID NO: 142844 - RNA, 18 nt, Artificial Sequence
  Description of Artificial Sequence: Synthetic oligonucleotide
agacaauuuuuccacccc

SEQ ID NO: 142845 - RNA, 18 nt, Artificial Sequence
  Description of Artificial Sequence: Synthetic oligonucleotide
aaugcagacaauuuuucc

SEQ ID NO: 142846 - RNA, 18 nt, Artificial Sequence
  Description of Artificial Sequence: Synthetic oligonucleotide
gaaaaaaugcagacaauu

SEQ ID NO: 142847 - RNA, 18 nt, Artificial Sequence
  Description of Artificial Sequence: Synthetic oligonucleotide
augcagaaaaaaugcaga

SEQ ID NO: 142848 - RNA, 18 nt, Artificial Sequence
  Description of Artificial Sequence: Synthetic oligonucleotide
uaaaaaugcagaaaaaau

SEQ ID NO: 142849 - RNA, 18 nt, Artificial Sequence
  Description of Artificial Sequence: Synthetic oligonucleotide
aauuuuaaaaaugcagaa

SEQ ID NO: 142850 - RNA, 18 nt, Artificial Sequence
  Description of Artificial Sequence: Synthetic oligonucleotide
guuggaauuuuaaaaaug

SEQ ID NO: 142851 - RNA, 18 nt, Artificial Sequence
  Description of Artificial Sequence: Synthetic oligonucleotide
auuguguuggaauuuuaa

SEQ ID NO: 142852 - RNA, 18 nt, Artificial Sequence
  Description of Artificial Sequence: Synthetic oligonucleotide
uauuuauuguguuggaau

SEQ ID NO: 142853 - RNA, 18 nt, Artificial Sequence
  Description of Artificial Sequence: Synthetic oligonucleotide
uauuguauuuauuguguu

SEQ ID NO: 142854 - RNA, 18 nt, Artificial Sequence
  Description of Artificial Sequence: Synthetic oligonucleotide
guuauuauuguauuuauu

SEQ ID NO: 142855 - RNA, 18 nt, Artificial Sequence
  Description of Artificial Sequence: Synthetic oligonucleotide
gcauaguuauuauuguau

SEQ ID NO: 142856 - RNA, 18 nt, Artificial Sequence
  Description of Artificial Sequence: Synthetic oligonucleotide
aguuagcauaguuauuau

SEQ ID NO: 142857 - RNA, 18 nt, Artificial Sequence
  Description of Artificial Sequence: Synthetic oligonucleotide
cuguuaguuagcauaguu

SEQ ID NO: 142858 - RNA, 18 nt, Artificial Sequence
  Description of Artificial Sequence: Synthetic oligonucleotide
gaccacuguuaguuagca

SEQ ID NO: 142859 - RNA, 18 nt, Artificial Sequence
  Description of Artificial Sequence: Synthetic oligonucleotide
cucuagaccacuguuagu

SEQ ID NO: 142860 - RNA, 18 nt, Artificial Sequence
  Description of Artificial Sequence: Synthetic oligonucleotide
guaagcucuagaccacug

SEQ ID NO: 142861 - RNA, 18 nt, Artificial Sequence
  Description of Artificial Sequence: Synthetic oligonucleotide
augaaguaagcucuagac

SEQ ID NO: 142862 - RNA, 18 nt, Artificial Sequence
  Description of Artificial Sequence: Synthetic oligonucleotide
cuggcaugaaguaagcuc

SEQ ID NO: 142863 - RNA, 18 nt, Artificial Sequence
  Description of Artificial Sequence: Synthetic oligonucleotide
agugccuggcaugaagua

SEQ ID NO: 142864 - RNA, 18 nt, Artificial Sequence
  Description of Artificial Sequence: Synthetic oligonucleotide
agaacagugccuggcaug

SEQ ID NO: 142865 - RNA, 18 nt, Artificial Sequence
  Description of Artificial Sequence: Synthetic oligonucleotide
ugaaaagaacagugccug

SEQ ID NO: 142866 - RNA, 18 nt, Artificial Sequence
  Description of Artificial Sequence: Synthetic oligonucleotide
aucgaugaaaagaacagu

SEQ ID NO: 142867 - RNA, 18 nt, Artificial Sequence
  Description of Artificial Sequence: Synthetic oligonucleotide
ucaucaucgaugaaaaga

SEQ ID NO: 142868 - RNA, 18 nt, Artificial Sequence
  Description of Artificial Sequence: Synthetic oligonucleotide
gugagucaucaucgauga

SEQ ID NO: 142869 - RNA, 18 nt, Artificial Sequence
  Description of Artificial Sequence: Synthetic oligonucleotide
aucaagugagucaucauc

SEQ ID NO: 142870 - RNA, 18 nt, Artificial Sequence
  Description of Artificial Sequence: Synthetic oligonucleotide
ugaggaucaagugaguca

SEQ ID NO: 142871 - RNA, 18 nt, Artificial Sequence
  Description of Artificial Sequence: Synthetic oligonucleotide
uguugugaggaucaagug

SEQ ID NO: 142872 - RNA, 18 nt, Artificial Sequence
  Description of Artificial Sequence: Synthetic oligonucleotide
aggguuguugugaggauc

SEQ ID NO: 142873 - RNA, 18 nt, Artificial Sequence
  Description of Artificial Sequence: Synthetic oligonucleotide
ugcacaggguuguuguga

SEQ ID NO: 142874 - RNA, 18 nt, Artificial Sequence
  Description of Artificial Sequence: Synthetic oligonucleotide
cuuccugcacaggguugu

SEQ ID NO: 142875 - RNA, 18 nt, Artificial Sequence
  Description of Artificial Sequence: Synthetic oligonucleotide
acauucuuccugcacagg

SEQ ID NO: 142876 - RNA, 18 nt, Artificial Sequence
  Description of Artificial Sequence: Synthetic oligonucleotide
acaaaacauucuuccugc

SEQ ID NO: 142877 - RNA, 18 nt, Artificial Sequence
  Description of Artificial Sequence: Synthetic oligonucleotide
gagacacaaaacauucuu

SEQ ID NO: 142878 - RNA, 18 nt, Artificial Sequence
  Description of Artificial Sequence: Synthetic oligonucleotide
aaauggagacacaaaaca

SEQ ID NO: 142879 - RNA, 18 nt, Artificial Sequence
  Description of Artificial Sequence: Synthetic oligonucleotide
guguaaaauggagacaca

SEQ ID NO: 142880 - RNA, 18 nt, Artificial Sequence
  Description of Artificial Sequence: Synthetic oligonucleotide
cugauguguaaaauggag

SEQ ID NO: 142881 - RNA, 18 nt, Artificial Sequence
  Description of Artificial Sequence: Synthetic oligonucleotide
ccucucugauguguaaaa

SEQ ID NO: 142882 - RNA, 18 nt, Artificial Sequence
  Description of Artificial Sequence: Synthetic oligonucleotide
uucagccucucugaugug

SEQ ID NO: 142883 - RNA, 18 nt, Artificial Sequence
  Description of Artificial Sequence: Synthetic oligonucleotide
ggucauucagccucucug

SEQ ID NO: 142884 - RNA, 18 nt, Artificial Sequence
  Description of Artificial Sequence: Synthetic oligonucleotide
aggcaggucauucagccu

SEQ ID NO: 142885 - RNA, 18 nt, Artificial Sequence
  Description of Artificial Sequence: Synthetic oligonucleotide
gcuauaggcaggucauuc

SEQ ID NO: 142886 - RNA, 18 nt, Artificial Sequence
  Description of Artificial Sequence: Synthetic oligonucleotide
gugaggcuauaggcaggu

SEQ ID NO: 142887 - RNA, 18 nt, Artificial Sequence
  Description of Artificial Sequence: Synthetic oligonucleotide
ugccugugaggcuauagg

SEQ ID NO: 142888 - RNA, 18 nt, Artificial Sequence
  Description of Artificial Sequence: Synthetic oligonucleotide
gugucugccugugaggcu

SEQ ID NO: 142889 - RNA, 18 nt, Artificial Sequence
  Description of Artificial Sequence: Synthetic oligonucleotide
auccugugucugccugug

SEQ ID NO: 142890 - RNA, 18 nt, Artificial Sequence
  Description of Artificial Sequence: Synthetic oligonucleotide
uucaaauccugugucugc

SEQ ID NO: 142891 - RNA, 18 nt, Artificial Sequence
  Description of Artificial Sequence: Synthetic oligonucleotide
cuuaauucaaauccugug

SEQ ID NO: 142892 - RNA, 18 nt, Artificial Sequence
  Description of Artificial Sequence: Synthetic oligonucleotide
caaugcuuaauucaaauc

SEQ ID NO: 142893 - RNA, 18 nt, Artificial Sequence
  Description of Artificial Sequence: Synthetic oligonucleotide
agacucaaugcuuaauuc

SEQ ID NO: 142894 - RNA, 18 nt, Artificial Sequence
  Description of Artificial Sequence: Synthetic oligonucleotide
uuaagagacucaaugcuu

SEQ ID NO: 142895 - RNA, 18 nt, Artificial Sequence
  Description of Artificial Sequence: Synthetic oligonucleotide
ugugguuaagagacucaa

SEQ ID NO: 142896 - RNA, 18 nt, Artificial Sequence
  Description of Artificial Sequence: Synthetic oligonucleotide
aguauugugguuaagaga

SEQ ID NO: 142897 - RNA, 18 nt, Artificial Sequence
  Description of Artificial Sequence: Synthetic oligonucleotide
aacguaguauugugguua

SEQ ID NO: 142898 - RNA, 18 nt, Artificial Sequence
  Description of Artificial Sequence: Synthetic oligonucleotide
uaggcaacguaguauugu

SEQ ID NO: 142899 - RNA, 18 nt, Artificial Sequence
  Description of Artificial Sequence: Synthetic oligonucleotide
ccgauuaggcaacguagu

SEQ ID NO: 142900 - RNA, 18 nt, Artificial Sequence
  Description of Artificial Sequence: Synthetic oligonucleotide
cccccccgauuaggcaac

SEQ ID NO: 142901 - RNA, 18 nt, Artificial Sequence
  Description of Artificial Sequence: Synthetic oligonucleotide
caccucccccccgauuag

SEQ ID NO: 142902 - RNA, 18 nt, Artificial Sequence
  Description of Artificial Sequence: Synthetic oligonucleotide
guccccaccucccccccg

SEQ ID NO: 142903 - RNA, 18 nt, Artificial Sequence
  Description of Artificial Sequence: Synthetic oligonucleotide
aauuuguccccaccuccc

SEQ ID NO: 142904 - RNA, 18 nt, Artificial Sequence
  Description of Artificial Sequence: Synthetic oligonucleotide
uugccaauuuguccccac

SEQ ID NO: 142905 - RNA, 18 nt, Artificial Sequence
  Description of Artificial Sequence: Synthetic oligonucleotide
guuuuuugccaauuuguc

SEQ ID NO: 142906 - RNA, 18 nt, Artificial Sequence
  Description of Artificial Sequence: Synthetic oligonucleotide
cuuuuguuuuuugccaau

SEQ ID NO: 142907 - RNA, 18 nt, Artificial Sequence
  Description of Artificial Sequence: Synthetic oligonucleotide
cacuucuuuuguuuuuug

SEQ ID NO: 142908 - RNA, 18 nt, Artificial Sequence
  Description of Artificial Sequence: Synthetic oligonucleotide
uaauccacuucuuuuguu

SEQ ID NO: 142909 - RNA, 18 nt, Artificial Sequence
  Description of Artificial Sequence: Synthetic oligonucleotide
ggucuuaauccacuucuu

SEQ ID NO: 142910 - RNA, 18 nt, Artificial Sequence
  Description of Artificial Sequence: Synthetic oligonucleotide
ccccuggucuuaauccac

SEQ ID NO: 142911 - RNA, 18 nt, Artificial Sequence
  Description of Artificial Sequence: Synthetic oligonucleotide
cccuaccccuggucuuaa

SEQ ID NO: 142912 - RNA, 18 nt, Artificial Sequence
  Description of Artificial Sequence: Synthetic oligonucleotide
aaucucccuaccccuggu

SEQ ID NO: 142913 - RNA, 18 nt, Artificial Sequence
  Description of Artificial Sequence: Synthetic oligonucleotide
guucuaaucucccuaccc

SEQ ID NO: 142914 - RNA, 18 nt, Artificial Sequence
  Description of Artificial Sequence: Synthetic oligonucleotide
uggguguucuaaucuccc

SEQ ID NO: 142915 - RNA, 18 nt, Artificial Sequence
  Description of Artificial Sequence: Synthetic oligonucleotide
uccacuggguguucuaau

SEQ ID NO: 142916 - RNA, 18 nt, Artificial Sequence
  Description of Artificial Sequence: Synthetic oligonucleotide
aaugcuccacuggguguu

SEQ ID NO: 142917 - RNA, 18 nt, Artificial Sequence
  Description of Artificial Sequence: Synthetic oligonucleotide
ucagcaaugcuccacugg

SEQ ID NO: 142918 - RNA, 18 nt, Artificial Sequence
  Description of Artificial Sequence: Synthetic oligonucleotide
ucccaucagcaaugcucc

SEQ ID NO: 142919 - RNA, 18 nt, Artificial Sequence
  Description of Artificial Sequence: Synthetic oligonucleotide
cccugucccaucagcaau

SEQ ID NO: 142920 - RNA, 18 nt, Artificial Sequence
  Description of Artificial Sequence: Synthetic oligonucleotide
ccaagcccugucccauca

SEQ ID NO: 142921 - RNA, 18 nt, Artificial Sequence
  Description of Artificial Sequence: Synthetic oligonucleotide
acagaccaagcccugucc

SEQ ID NO: 142922 - RNA, 18 nt, Artificial Sequence
  Description of Artificial Sequence: Synthetic oligonucleotide
ccgugacagaccaagccc

SEQ ID NO: 142923 - RNA, 18 nt, Artificial Sequence
  Description of Artificial Sequence: Synthetic oligonucleotide
cuuggccgugacagacca

SEQ ID NO: 142924 - RNA, 18 nt, Artificial Sequence
  Description of Artificial Sequence: Synthetic oligonucleotide
gccuccuuggccgugaca

SEQ ID NO: 142925 - RNA, 18 nt, Artificial Sequence
  Description of Artificial Sequence: Synthetic oligonucleotide
ggcaggccuccuuggccg

SEQ ID NO: 142926 - RNA, 18 nt, Artificial Sequence
  Description of Artificial Sequence: Synthetic oligonucleotide
gggacggcaggccuccuu

SEQ ID NO: 142927 - RNA, 18 nt, Artificial Sequence
  Description of Artificial Sequence: Synthetic oligonucleotide
aggugacuuggcccaggg

SEQ ID NO: 142928 - RNA, 18 nt, Artificial Sequence
  Description of Artificial Sequence: Synthetic oligonucleotide
agaggugacuuggcccag

SEQ ID NO: 142929 - RNA, 18 nt, Artificial Sequence
  Description of Artificial Sequence: Synthetic oligonucleotide
ccccaagaggugacuugg

SEQ ID NO: 142930 - RNA, 18 nt, Artificial Sequence
  Description of Artificial Sequence: Synthetic oligonucleotide
uuccaccccaagagguga

SEQ ID NO: 142931 - RNA, 18 nt, Artificial Sequence
  Description of Artificial Sequence: Synthetic oligonucleotide
ccuacuuccaccccaaga

SEQ ID NO: 142932 - RNA, 18 nt, Artificial Sequence
  Description of Artificial Sequence: Synthetic oligonucleotide
gcuccccuacuuccaccc

SEQ ID NO: 142933 - RNA, 18 nt, Artificial Sequence
  Description of Artificial Sequence: Synthetic oligonucleotide
guggagcuccccuacuuc

SEQ ID NO: 142934 - RNA, 18 nt, Artificial Sequence
  Description of Artificial Sequence: Synthetic oligonucleotide
aggcaguggagcuccccu

SEQ ID NO: 142935 - RNA, 18 nt, Artificial Sequence
  Description of Artificial Sequence: Synthetic oligonucleotide
cagaaaggcaguggagcu

SEQ ID NO: 142936 - RNA, 18 nt, Artificial Sequence
  Description of Artificial Sequence: Synthetic oligonucleotide
gagcucagaaaggcagug

SEQ ID NO: 142937 - RNA, 18 nt, Artificial Sequence
  Description of Artificial Sequence: Synthetic oligonucleotide
ccagggagcucagaaagg

SEQ ID NO: 142938 - RNA, 18 nt, Artificial Sequence
  Description of Artificial Sequence: Synthetic oligonucleotide
gcacgccagggagcucag

SEQ ID NO: 142939 - RNA, 18 nt, Artificial Sequence
  Description of Artificial Sequence: Synthetic oligonucleotide
uucaugaggccuggccgg

SEQ ID NO: 142940 - RNA, 18 nt, Artificial Sequence
  Description of Artificial Sequence: Synthetic oligonucleotide
gaacguucaugaggccug

SEQ ID NO: 142941 - RNA, 18 nt, Artificial Sequence
  Description of Artificial Sequence: Synthetic oligonucleotide
ccguggaacguucaugag

SEQ ID NO: 142942 - RNA, 18 nt, Artificial Sequence
  Description of Artificial Sequence: Synthetic oligonucleotide
uccacccguggaacguuc

SEQ ID NO: 142943 - RNA, 18 nt, Artificial Sequence
  Description of Artificial Sequence: Synthetic oligonucleotide
uagccuccacccguggaa

SEQ ID NO: 142944 - RNA, 18 nt, Artificial Sequence
  Description of Artificial Sequence: Synthetic oligonucleotide
cuggauagccuccacccg

SEQ ID NO: 142945 - RNA, 18 nt, Artificial Sequence
  Description of Artificial Sequence: Synthetic oligonucleotide
guguccuggauagccucc

SEQ ID NO: 142946 - RNA, 18 nt, Artificial Sequence
  Description of Artificial Sequence: Synthetic oligonucleotide
ggaugguguccuggauag

SEQ ID NO: 142947 - RNA, 18 nt, Artificial Sequence
  Description of Artificial Sequence: Synthetic oligonucleotide
acgcaggaugguguccug

SEQ ID NO: 142948 - RNA, 18 nt, Artificial Sequence
  Description of Artificial Sequence: Synthetic oligonucleotide
agggcacgcaggauggug

SEQ ID NO: 142949 - RNA, 18 nt, Artificial Sequence
  Description of Artificial Sequence: Synthetic oligonucleotide
auucgagggcacgcagga

SEQ ID NO: 142950 - RNA, 18 nt, Artificial Sequence
  Description of Artificial Sequence: Synthetic oligonucleotide
guggaauucgagggcacg

SEQ ID NO: 142951 - RNA, 18 nt, Artificial Sequence
  Description of Artificial Sequence: Synthetic oligonucleotide
ugcagguggaauucgagg

SEQ ID NO: 142952 - RNA, 18 nt, Artificial Sequence
  Description of Artificial Sequence: Synthetic oligonucleotide
uggccugcagguggaauu

SEQ ID NO: 142953 - RNA, 18 nt, Artificial Sequence
  Description of Artificial Sequence: Synthetic oligonucleotide
gugguuggccugcaggug

SEQ ID NO: 142954 - RNA, 18 nt, Artificial Sequence
  Description of Artificial Sequence: Synthetic oligonucleotide
ucagggugguuggccugc

SEQ ID NO: 142955 - RNA, 18 nt, Artificial Sequence
  Description of Artificial Sequence: Synthetic oligonucleotide
gggcaucagggugguugg

SEQ ID NO: 142956 - RNA, 18 nt, Artificial Sequence
  Description of Artificial Sequence: Synthetic oligonucleotide
guacugggcaucagggug

SEQ ID NO: 142957 - RNA, 18 nt, Artificial Sequence
  Description of Artificial Sequence: Synthetic oligonucleotide
aagagguacugggcauca

SEQ ID NO: 142958 - RNA, 18 nt, Artificial Sequence
  Description of Artificial Sequence: Synthetic oligonucleotide
gggaagagguacugggca

SEQ ID NO: 142959 - RNA, 18 nt, Artificial Sequence
  Description of Artificial Sequence: Synthetic oligonucleotide
cuucugcagcagcuuggg

SEQ ID NO: 142960 - RNA, 18 nt, Artificial Sequence
  Description of Artificial Sequence: Synthetic oligonucleotide
gccaucuucugcagcagc

SEQ ID NO: 142961 - RNA, 18 nt, Artificial Sequence
  Description of Artificial Sequence: Synthetic oligonucleotide
ggucagccaucuucugca

SEQ ID NO: 142962 - RNA, 18 nt, Artificial Sequence
  Description of Artificial Sequence: Synthetic oligonucleotide
ccgcaggucagccaucuu

SEQ ID NO: 142963 - RNA, 18 nt, Artificial Sequence
  Description of Artificial Sequence: Synthetic oligonucleotide
aguugccgcaggucagcc

SEQ ID NO: 142964 - RNA, 18 nt, Artificial Sequence
  Description of Artificial Sequence: Synthetic oligonucleotide
ugaccaguugccgcaggu

SEQ ID NO: 142965 - RNA, 18 nt, Artificial Sequence
  Description of Artificial Sequence: Synthetic oligonucleotide
cucggugaccaguugccg

SEQ ID NO: 142966 - RNA, 18 nt, Artificial Sequence
  Description of Artificial Sequence: Synthetic oligonucleotide
gcgugcucggugaccagu

SEQ ID NO: 142967 - RNA, 18 nt, Artificial Sequence
  Description of Artificial Sequence: Synthetic oligonucleotide
ucugggcgugcucgguga

SEQ ID NO: 142968 - RNA, 18 nt, Artificial Sequence
  Description of Artificial Sequence: Synthetic oligonucleotide
caucaucugggcgugcuc

SEQ ID NO: 142969 - RNA, 18 nt, Artificial Sequence
  Description of Artificial Sequence: Synthetic oligonucleotide
cgcugcaucaucugggcg

SEQ ID NO: 142970 - RNA, 18 nt, Artificial Sequence
  Description of Artificial Sequence: Synthetic oligonucleotide
ugauccgcugcaucaucu

SEQ ID NO: 142971 - RNA, 18 nt, Artificial Sequence
  Description of Artificial Sequence: Synthetic oligonucleotide
cuucuugauccgcugcau

SEQ ID NO: 142972 - RNA, 18 nt, Artificial Sequence
  Description of Artificial Sequence: Synthetic oligonucleotide
ucggucuucuugauccgc

SEQ ID NO: 142973 - RNA, 18 nt, Artificial Sequence
  Description of Artificial Sequence: Synthetic oligonucleotide
cgguuucggucuucuuga

SEQ ID NO: 142974 - RNA, 18 nt, Artificial Sequence
  Description of Artificial Sequence: Synthetic oligonucleotide
ggucucgguuucggucuu

SEQ ID NO: 142975 - RNA, 18 nt, Artificial Sequence
  Description of Artificial Sequence: Synthetic oligonucleotide
agcgaggucucgguuucg

SEQ ID NO: 142976 - RNA, 18 nt, Artificial Sequence
  Description of Artificial Sequence: Synthetic oligonucleotide
ggugcagcgaggucucgg

SEQ ID NO: 142977 - RNA, 18 nt, Artificial Sequence
  Description of Artificial Sequence: Synthetic oligonucleotide
cagagggugcagcgaggu

SEQ ID NO: 142978 - RNA, 18 nt, Artificial Sequence
  Description of Artificial Sequence: Synthetic oligonucleotide
uggagcagagggugcagc

SEQ ID NO: 142979 - RNA, 18 nt, Artificial Sequence
  Description of Artificial Sequence: Synthetic oligonucleotide
ucuccuggagcagagggu

SEQ ID NO: 142980 - RNA, 18 nt, Artificial Sequence
  Description of Artificial Sequence: Synthetic oligonucleotide
guagaucuccuggagcag

SEQ ID NO: 142981 - RNA, 18 nt, Artificial Sequence
  Description of Artificial Sequence: Synthetic oligonucleotide
uccuuguagaucuccugg

SEQ ID NO: 142982 - RNA, 18 nt, Artificial Sequence
  Description of Artificial Sequence: Synthetic oligonucleotide
acauguccuuguagaucu

SEQ ID NO: 142983 - RNA, 18 nt, Artificial Sequence
  Description of Artificial Sequence: Synthetic oligonucleotide
uuaguacauguccuugua

SEQ ID NO: 142984 - RNA, 18 nt, Artificial Sequence
  Description of Artificial Sequence: Synthetic oligonucleotide
cgccguuaguacaugucc

SEQ ID NO: 142985 - RNA, 18 nt, Artificial Sequence
  Description of Artificial Sequence: Synthetic oligonucleotide
ggugccgccguuaguaca

SEQ ID NO: 142986 - RNA, 18 nt, Artificial Sequence
  Description of Artificial Sequence: Synthetic oligonucleotide
gccugggugccgccguua

SEQ ID NO: 142987 - RNA, 18 nt, Artificial Sequence
  Description of Artificial Sequence: Synthetic oligonucleotide
gggaggccugggugccgc

SEQ ID NO: 142988 - RNA, 18 nt, Artificial Sequence
  Description of Artificial Sequence: Synthetic oligonucleotide
cugcagggaggccugggu

SEQ ID NO: 142989 - RNA, 18 nt, Artificial Sequence
  Description of Artificial Sequence: Synthetic oligonucleotide
ggagucugcagggaggcc

SEQ ID NO: 142990 - RNA, 18 nt, Artificial Sequence
  Description of Artificial Sequence: Synthetic oligonucleotide
ccauuggagucugcaggg

SEQ ID NO: 142991 - RNA, 18 nt, Artificial Sequence
  Description of Artificial Sequence: Synthetic oligonucleotide
uggccccauuggagucug

SEQ ID NO: 142992 - RNA, 18 nt, Artificial Sequence
  Description of Artificial Sequence: Synthetic oligonucleotide
agugcuggccccauugga

SEQ ID NO: 142993 - RNA, 18 nt, Artificial Sequence
  Description of Artificial Sequence: Synthetic oligonucleotide
ccuccagugcuggcccca

SEQ ID NO: 142994 - RNA, 18 nt, Artificial Sequence
  Description of Artificial Sequence: Synthetic oligonucleotide
gggccccuccagugcugg

SEQ ID NO: 142995 - RNA, 18 nt, Artificial Sequence
  Description of Artificial Sequence: Synthetic oligonucleotide
ugggugggccccuccagu

SEQ ID NO: 142996 - RNA, 18 nt, Artificial Sequence
  Description of Artificial Sequence: Synthetic oligonucleotide
ucaugugggugggccccu

SEQ ID NO: 142997 - RNA, 18 nt, Artificial Sequence
  Description of Artificial Sequence: Synthetic oligonucleotide
aaaagucauguggguggg

SEQ ID NO: 142998 - RNA, 18 nt, Artificial Sequence
  Description of Artificial Sequence: Synthetic oligonucleotide
aauggaaaagucaugugg

SEQ ID NO: 142999 - RNA, 18 nt, Artificial Sequence
  Description of Artificial Sequence: Synthetic oligonucleotide
uggucaauggaaaaguca

SEQ ID NO: 143000 - RNA, 18 nt, Artificial Sequence
  Description of Artificial Sequence: Synthetic oligonucleotide
agggcuggucaauggaaa

SEQ ID NO: 143001 - RNA, 18 nt, Artificial Sequence
  Description of Artificial Sequence: Synthetic oligonucleotide
gcucaagggcuggucaau

SEQ ID NO: 143002 - RNA, 18 nt, Artificial Sequence
  Description of Artificial Sequence: Synthetic oligonucleotide
cgggugcucaagggcugg

SEQ ID NO: 143003 - RNA, 18 nt, Artificial Sequence
  Description of Artificial Sequence: Synthetic oligonucleotide
caggccgggugcucaagg

SEQ ID NO: 143004 - RNA, 18 nt, Artificial Sequence
  Description of Artificial Sequence: Synthetic oligonucleotide
ugcuccaggccgggugcu

SEQ ID NO: 143005 - RNA, 18 nt, Artificial Sequence
  Description of Artificial Sequence: Synthetic oligonucleotide
ucugcugcuccaggccgg

SEQ ID NO: 143006 - RNA, 18 nt, Artificial Sequence
  Description of Artificial Sequence: Synthetic oligonucleotide
gggacucugcugcuccag

SEQ ID NO: 143007 - RNA, 18 nt, Artificial Sequence
  Description of Artificial Sequence: Synthetic oligonucleotide
aucgugggacucugcugc

SEQ ID NO: 143008 - RNA, 18 nt, Artificial Sequence
  Description of Artificial Sequence: Synthetic oligonucleotide
gggcgaucgugggacucu

SEQ ID NO: 143009 - RNA, 18 nt, Artificial Sequence
  Description of Artificial Sequence: Synthetic oligonucleotide
ucugagggcgaucguggg

SEQ ID NO: 143010 - RNA, 18 nt, Artificial Sequence
  Description of Artificial Sequence: Synthetic oligonucleotide
augugucugagggcgauc

SEQ ID NO: 143011 - RNA, 18 nt, Artificial Sequence
  Description of Artificial Sequence: Synthetic oligonucleotide
gugucaugugucugaggg

SEQ ID NO: 143012 - RNA, 18 nt, Artificial Sequence
  Description of Artificial Sequence: Synthetic oligonucleotide
cgugggugucaugugucu

SEQ ID NO: 143013 - RNA, 18 nt, Artificial Sequence
  Description of Artificial Sequence: Synthetic oligonucleotide
gaggccgugggugucaug

SEQ ID NO: 143014 - RNA, 18 nt, Artificial Sequence
  Description of Artificial Sequence: Synthetic oligonucleotide
agccagaggccgugggug

SEQ ID NO: 143015 - RNA, 18 nt, Artificial Sequence
  Description of Artificial Sequence: Synthetic oligonucleotide
cagggagccagaggccgu

SEQ ID NO: 143016 - RNA, 18 nt, Artificial Sequence
  Description of Artificial Sequence: Synthetic oligonucleotide
gggcacagggagccagag

SEQ ID NO: 143017 - RNA, 18 nt, Artificial Sequence
  Description of Artificial Sequence: Synthetic oligonucleotide
agagagggcacagggagc

SEQ ID NO: 143018 - RNA, 18 nt, Artificial Sequence
  Description of Artificial Sequence: Synthetic oligonucleotide
gcgggagagagggcacag

SEQ ID NO: 143019 - RNA, 18 nt, Artificial Sequence
  Description of Artificial Sequence: Synthetic oligonucleotide
aggaagcgggagagaggg

SEQ ID NO: 143020 - RNA, 18 nt, Artificial Sequence
  Description of Artificial Sequence: Synthetic oligonucleotide
gcuggaggaagcgggaga

SEQ ID NO: 143021 - RNA, 18 nt, Artificial Sequence
  Description of Artificial Sequence: Synthetic oligonucleotide
agcuggcuggaggaagcg

SEQ ID NO: 143022 - RNA, 18 nt, Artificial Sequence
  Description of Artificial Sequence: Synthetic oligonucleotide
aagagagcuggcuggagg

SEQ ID NO: 143023 - RNA, 18 nt, Artificial Sequence
  Description of Artificial Sequence: Synthetic oligonucleotide
acaggaagagagcuggcu

SEQ ID NO: 143024 - RNA, 18 nt, Artificial Sequence
  Description of Artificial Sequence: Synthetic oligonucleotide
caaagacaggaagagagc

SEQ ID NO: 143025 - RNA, 18 nt, Artificial Sequence
  Description of Artificial Sequence: Synthetic oligonucleotide
gacaacaaagacaggaag

SEQ ID NO: 143026 - RNA, 18 nt, Artificial Sequence
  Description of Artificial Sequence: Synthetic oligonucleotide
agggagacaacaaagaca

SEQ ID NO: 143027 - RNA, 18 nt, Artificial Sequence
  Description of Artificial Sequence: Synthetic oligonucleotide
gaaagagggagacaacaa

SEQ ID NO: 143028 - RNA, 18 nt, Artificial Sequence
  Description of Artificial Sequence: Synthetic oligonucleotide
acugagaaagagggagac

SEQ ID NO: 143029 - RNA, 18 nt, Artificial Sequence
  Description of Artificial Sequence: Synthetic oligonucleotide
gaggaacugagaaagagg

SEQ ID NO: 143030 - RNA, 18 nt, Artificial Sequence
  Description of Artificial Sequence: Synthetic oligonucleotide
agaaagaggaacugagaa

SEQ ID NO: 143031 - RNA, 18 nt, Artificial Sequence
  Description of Artificial Sequence: Synthetic oligonucleotide
agaaaagaaagaggaacu

SEQ ID NO: 143032 - RNA, 18 nt, Artificial Sequence
  Description of Artificial Sequence: Synthetic oligonucleotide
gaauuagaaaagaaagag

SEQ ID NO: 143033 - RNA, 18 nt, Artificial Sequence
  Description of Artificial Sequence: Synthetic oligonucleotide
aacaggaauuagaaaaga

SEQ ID NO: 143034 - RNA, 18 nt, Artificial Sequence
  Description of Artificial Sequence: Synthetic oligonucleotide
agagcaacaggaauuaga

SEQ ID NO: 143035 - RNA, 18 nt, Artificial Sequence
  Description of Artificial Sequence: Synthetic oligonucleotide
gaaacagagcaacaggaa

SEQ ID NO: 143036 - RNA, 18 nt, Artificial Sequence
  Description of Artificial Sequence: Synthetic oligonucleotide
aggaagaaacagagcaac

SEQ ID NO: 143037 - RNA, 18 nt, Artificial Sequence
  Description of Artificial Sequence: Synthetic oligonucleotide
cagaaaggaagaaacaga

SEQ ID NO: 143038 - RNA, 18 nt, Artificial Sequence
  Description of Artificial Sequence: Synthetic oligonucleotide
accuacagaaaggaagaa

SEQ ID NO: 143039 - RNA, 18 nt, Artificial Sequence
  Description of Artificial Sequence: Synthetic oligonucleotide
gagaaaccuacagaaagg

SEQ ID NO: 143040 - RNA, 18 nt, Artificial Sequence
  Description of Artificial Sequence: Synthetic oligonucleotide
gaagagagaaaccuacag

SEQ ID NO: 143041 - RNA, 18 nt, Artificial Sequence
  Description of Artificial Sequence: Synthetic oligonucleotide
gaagggaagagagaaacc

SEQ ID NO: 143042 - RNA, 18 nt, Artificial Sequence
  Description of Artificial Sequence: Synthetic oligonucleotide
agggagaagggaagagag

SEQ ID NO: 143043 - RNA, 18 nt, Artificial Sequence
  Description of Artificial Sequence: Synthetic oligonucleotide
gggcaagggagaagggaa

SEQ ID NO: 143044 - RNA, 18 nt, Artificial Sequence
  Description of Artificial Sequence: Synthetic oligonucleotide
agggagggcaagggagaa

SEQ ID NO: 143045 - RNA, 18 nt, Artificial Sequence
  Description of Artificial Sequence: Synthetic oligonucleotide
gagaaagggagggcaagg

SEQ ID NO: 143046 - RNA, 18 nt, Artificial Sequence
  Description of Artificial Sequence: Synthetic oligonucleotide
ggagagagaaagggaggg

SEQ ID NO: 143047 - RNA, 18 nt, Artificial Sequence
  Description of Artificial Sequence: Synthetic oligonucleotide
ggguggagagagaaaggg

SEQ ID NO: 143048 - RNA, 18 nt, Artificial Sequence
  Description of Artificial Sequence: Synthetic oligonucleotide
aaggaggacagacguggg

SEQ ID NO: 143049 - RNA, 18 nt, Artificial Sequence
  Description of Artificial Sequence: Synthetic oligonucleotide
uaagaaaggaggacagac

SEQ ID NO: 143050 - RNA, 18 nt, Artificial Sequence
  Description of Artificial Sequence: Synthetic oligonucleotide
cagaauaagaaaggagga

SEQ ID NO: 143051 - RNA, 18 nt, Artificial Sequence
  Description of Artificial Sequence: Synthetic oligonucleotide
ucucacagaauaagaaag

SEQ ID NO: 143052 - RNA, 18 nt, Artificial Sequence
  Description of Artificial Sequence: Synthetic oligonucleotide
aaacaucucacagaauaa

SEQ ID NO: 143053 - RNA, 18 nt, Artificial Sequence
  Description of Artificial Sequence: Synthetic oligonucleotide
auacaaaacaucucacag

SEQ ID NO: 143054 - RNA, 18 nt, Artificial Sequence
  Description of Artificial Sequence: Synthetic oligonucleotide
aaauaauacaaaacaucu

SEQ ID NO: 143055 - RNA, 18 nt, Artificial Sequence
  Description of Artificial Sequence: Synthetic oligonucleotide
uggugaaauaauacaaaa

SEQ ID NO: 143056 - RNA, 18 nt, Artificial Sequence
  Description of Artificial Sequence: Synthetic oligonucleotide
gcugcuggugaaauaaua

SEQ ID NO: 143057 - RNA, 18 nt, Artificial Sequence
  Description of Artificial Sequence: Synthetic oligonucleotide
ucuaugcugcuggugaaa

SEQ ID NO: 143058 - RNA, 18 nt, Artificial Sequence
  Description of Artificial Sequence: Synthetic oligonucleotide
ccuguucuaugcugcugg

SEQ ID NO: 143059 - RNA, 18 nt, Artificial Sequence
  Description of Artificial Sequence: Synthetic oligonucleotide
gagguccuguucuaugcu

SEQ ID NO: 143060 - RNA, 18 nt, Artificial Sequence
  Description of Artificial Sequence: Synthetic oligonucleotide
aagcagagguccuguucu

SEQ ID NO: 143061 - RNA, 18 nt, Artificial Sequence
  Description of Artificial Sequence: Synthetic oligonucleotide
ugcaaaagcagagguccu

SEQ ID NO: 143062 - RNA, 18 nt, Artificial Sequence
  Description of Artificial Sequence: Synthetic oligonucleotide
aggugugcaaaagcagag

SEQ ID NO: 143063 - RNA, 18 nt, Artificial Sequence
  Description of Artificial Sequence: Synthetic oligonucleotide
ggaaaaggugugcaaaag

SEQ ID NO: 143064 - RNA, 18 nt, Artificial Sequence
  Description of Artificial Sequence: Synthetic oligonucleotide
gggaaaaggugugcaaaa

SEQ ID NO: 143065 - RNA, 18 nt, Artificial Sequence
  Description of Artificial Sequence: Synthetic oligonucleotide
cucucuucugcuccuggg

SEQ ID NO: 143066 - RNA, 18 nt, Artificial Sequence
  Description of Artificial Sequence: Synthetic oligonucleotide
ccccacucucuucugcuc

SEQ ID NO: 143067 - RNA, 18 nt, Artificial Sequence
  Description of Artificial Sequence: Synthetic oligonucleotide
gcaggccccacucucuuc

SEQ ID NO: 143068 - RNA, 18 nt, Artificial Sequence
  Description of Artificial Sequence: Synthetic oligonucleotide
agagggcaggccccacuc

SEQ ID NO: 143069 - RNA, 18 nt, Artificial Sequence
  Description of Artificial Sequence: Synthetic oligonucleotide
gggcagagggcaggcccc

SEQ ID NO: 143070 - RNA, 18 nt, Artificial Sequence
  Description of Artificial Sequence: Synthetic oligonucleotide
ugcaggugcaaugauggg

SEQ ID NO: 143071 - RNA, 18 nt, Artificial Sequence
  Description of Artificial Sequence: Synthetic oligonucleotide
aagccugcaggugcaaug

SEQ ID NO: 143072 - RNA, 18 nt, Artificial Sequence
  Description of Artificial Sequence: Synthetic oligonucleotide
gaccuaagccugcaggug

SEQ ID NO: 143073 - RNA, 18 nt, Artificial Sequence
  Description of Artificial Sequence: Synthetic oligonucleotide
gugaggaccuaagccugc

SEQ ID NO: 143074 - RNA, 18 nt, Artificial Sequence
  Description of Artificial Sequence: Synthetic oligonucleotide
cagaagugaggaccuaag

SEQ ID NO: 143075 - RNA, 18 nt, Artificial Sequence
  Description of Artificial Sequence: Synthetic oligonucleotide
ggagacagaagugaggac

SEQ ID NO: 143076 - RNA, 18 nt, Artificial Sequence
  Description of Artificial Sequence: Synthetic oligonucleotide
agacaggagacagaagug

SEQ ID NO: 143077 - RNA, 18 nt, Artificial Sequence
  Description of Artificial Sequence: Synthetic oligonucleotide
ucugaagacaggagacag

SEQ ID NO: 143078 - RNA, 18 nt, Artificial Sequence
  Description of Artificial Sequence: Synthetic oligonucleotide
uuugcucugaagacagga

SEQ ID NO: 143079 - RNA, 18 nt, Artificial Sequence
  Description of Artificial Sequence: Synthetic oligonucleotide
agucuuuugcucugaaga

SEQ ID NO: 143080 - RNA, 18 nt, Artificial Sequence
  Description of Artificial Sequence: Synthetic oligonucleotide
gcucaagucuuuugcucu

SEQ ID NO: 143081 - RNA, 18 nt, Artificial Sequence
  Description of Artificial Sequence: Synthetic oligonucleotide
ggauggcucaagucuuuu

SEQ ID NO: 143082 - RNA, 18 nt, Artificial Sequence
  Description of Artificial Sequence: Synthetic oligonucleotide
ucuuuggauggcucaagu

SEQ ID NO: 143083 - RNA, 18 nt, Artificial Sequence
  Description of Artificial Sequence: Synthetic oligonucleotide
guguuucuuuggauggcu

SEQ ID NO: 143084 - RNA, 18 nt, Artificial Sequence
  Description of Artificial Sequence: Synthetic oligonucleotide
gcuuaguguuucuuugga

SEQ ID NO: 143085 - RNA, 18 nt, Artificial Sequence
  Description of Artificial Sequence: Synthetic oligonucleotide
agagagcuuaguguuucu

SEQ ID NO: 143086 - RNA, 18 nt, Artificial Sequence
  Description of Artificial Sequence: Synthetic oligonucleotide
ggcccagagagcuuagug

SEQ ID NO: 143087 - RNA, 18 nt, Artificial Sequence
  Description of Artificial Sequence: Synthetic oligonucleotide
acccaggcccagagagcu

SEQ ID NO: 143088 - RNA, 18 nt, Artificial Sequence
  Description of Artificial Sequence: Synthetic oligonucleotide
cuggaacccaggcccaga

SEQ ID NO: 143089 - RNA, 18 nt, Artificial Sequence
  Description of Artificial Sequence: Synthetic oligonucleotide
cuucccuggaacccaggc

SEQ ID NO: 143090 - RNA, 18 nt, Artificial Sequence
  Description of Artificial Sequence: Synthetic oligonucleotide
uuagccuucccuggaacc

SEQ ID NO: 143091 - RNA, 18 nt, Artificial Sequence
  Description of Artificial Sequence: Synthetic oligonucleotide
caugcuuagccuucccug

SEQ ID NO: 143092 - RNA, 18 nt, Artificial Sequence
  Description of Artificial Sequence: Synthetic oligonucleotide
caggccaugcuuagccuu

SEQ ID NO: 143093 - RNA, 18 nt, Artificial Sequence
  Description of Artificial Sequence: Synthetic oligonucleotide
caguccaggccaugcuua

SEQ ID NO: 143094 - RNA, 18 nt, Artificial Sequence
  Description of Artificial Sequence: Synthetic oligonucleotide
gcagucaguccaggccau

SEQ ID NO: 143095 - RNA, 18 nt, Artificial Sequence
  Description of Artificial Sequence: Synthetic oligonucleotide
gggcugcagucaguccag

SEQ ID NO: 143096 - RNA, 18 nt, Artificial Sequence
  Description of Artificial Sequence: Synthetic oligonucleotide
agggaccccaugacuaua

SEQ ID NO: 143097 - RNA, 18 nt, Artificial Sequence
  Description of Artificial Sequence: Synthetic oligonucleotide
gcagcagggaccccauga

SEQ ID NO: 143098 - RNA, 18 nt, Artificial Sequence
  Description of Artificial Sequence: Synthetic oligonucleotide
ccuuugcagcagggaccc

SEQ ID NO: 143099 - RNA, 18 nt, Artificial Sequence
  Description of Artificial Sequence: Synthetic oligonucleotide
acuguccuuugcagcagg

SEQ ID NO: 143100 - RNA, 18 nt, Artificial Sequence
  Description of Artificial Sequence: Synthetic oligonucleotide
ugcccacuguccuuugca

SEQ ID NO: 143101 - RNA, 18 nt, Artificial Sequence
  Description of Artificial Sequence: Synthetic oligonucleotide
ccuccugcccacuguccu

SEQ ID NO: 143102 - RNA, 18 nt, Artificial Sequence
  Description of Artificial Sequence: Synthetic oligonucleotide
gggccuccugcccacugu

SEQ ID NO: 143103 - RNA, 18 nt, Artificial Sequence
  Description of Artificial Sequence: Synthetic oligonucleotide
ucuggcucucagccuggg

SEQ ID NO: 143104 - RNA, 18 nt, Artificial Sequence
  Description of Artificial Sequence: Synthetic oligonucleotide
aggcaucuggcucucagc

SEQ ID NO: 143105 - RNA, 18 nt, Artificial Sequence
  Description of Artificial Sequence: Synthetic oligonucleotide
gggaggcaucuggcucuc

SEQ ID NO: 143106 - RNA, 18 nt, Artificial Sequence
  Description of Artificial Sequence: Synthetic oligonucleotide
ggcaaugacagucuuggg

SEQ ID NO: 143107 - RNA, 18 nt, Artificial Sequence
  Description of Artificial Sequence: Synthetic oligonucleotide
gggcaaugacagucuugg

SEQ ID NO: 143108 - RNA, 18 nt, Artificial Sequence
  Description of Artificial Sequence: Synthetic oligonucleotide
ggccucagcaucggaggg

SEQ ID NO: 143109 - RNA, 18 nt, Artificial Sequence
  Description of Artificial Sequence: Synthetic oligonucleotide
uggguggccucagcaucg

SEQ ID NO: 143110 - RNA, 18 nt, Artificial Sequence
  Description of Artificial Sequence: Synthetic oligonucleotide
gucaguggguggccucag

SEQ ID NO: 143111 - RNA, 18 nt, Artificial Sequence
  Description of Artificial Sequence: Synthetic oligonucleotide
guugggucaguggguggc

SEQ ID NO: 143112 - RNA, 18 nt, Artificial Sequence
  Description of Artificial Sequence: Synthetic oligonucleotide
gaucaguugggucagugg

SEQ ID NO: 143113 - RNA, 18 nt, Artificial Sequence
  Description of Artificial Sequence: Synthetic oligonucleotide
agcaggaucaguuggguc

SEQ ID NO: 143114 - RNA, 18 nt, Artificial Sequence
  Description of Artificial Sequence: Synthetic oligonucleotide
gcuggagcaggaucaguu

SEQ ID NO: 143115 - RNA, 18 nt, Artificial Sequence
  Description of Artificial Sequence: Synthetic oligonucleotide
gugcugcuggagcaggau

SEQ ID NO: 143116 - RNA, 18 nt, Artificial Sequence
  Description of Artificial Sequence: Synthetic oligonucleotide
gaggugugcugcuggagc

SEQ ID NO: 143117 - RNA, 18 nt, Artificial Sequence
  Description of Artificial Sequence: Synthetic oligonucleotide
gggcugaggugugcugcu

SEQ ID NO: 143118 - RNA, 18 nt, Artificial Sequence
  Description of Artificial Sequence: Synthetic oligonucleotide
aaggacacugggugucag

SEQ ID NO: 143119 - RNA, 18 nt, Artificial Sequence
  Description of Artificial Sequence: Synthetic oligonucleotide
gauggaaggacacugggu

SEQ ID NO: 143120 - RNA, 18 nt, Artificial Sequence
  Description of Artificial Sequence: Synthetic oligonucleotide
gugaagauggaaggacac

SEQ ID NO: 143121 - RNA, 18 nt, Artificial Sequence
  Description of Artificial Sequence: Synthetic oligonucleotide
ccagugugaagauggaag

SEQ ID NO: 143122 - RNA, 18 nt, Artificial Sequence
  Description of Artificial Sequence: Synthetic oligonucleotide
gcaaaccagugugaagau

SEQ ID NO: 143123 - RNA, 18 nt, Artificial Sequence
  Description of Artificial Sequence: Synthetic oligonucleotide
gccuggcaaaccagugug

SEQ ID NO: 143124 - RNA, 18 nt, Artificial Sequence
  Description of Artificial Sequence: Synthetic oligonucleotide
cauuggccuggcaaacca

SEQ ID NO: 143125 - RNA, 18 nt, Artificial Sequence
  Description of Artificial Sequence: Synthetic oligonucleotide
agcaacauuggccuggca

SEQ ID NO: 143126 - RNA, 18 nt, Artificial Sequence
  Description of Artificial Sequence: Synthetic oligonucleotide
ccaucagcaacauuggcc

SEQ ID NO: 143127 - RNA, 18 nt, Artificial Sequence
  Description of Artificial Sequence: Synthetic oligonucleotide
gggccaucagcaacauug

SEQ ID NO: 143128 - RNA, 18 nt, Artificial Sequence
  Description of Artificial Sequence: Synthetic oligonucleotide
ccagcggccagugcaggg

SEQ ID NO: 143129 - RNA, 18 nt, Artificial Sequence
  Description of Artificial Sequence: Synthetic oligonucleotide
gccguccagcggccagug

SEQ ID NO: 143130 - RNA, 18 nt, Artificial Sequence
  Description of Artificial Sequence: Synthetic oligonucleotide
agagugccguccagcggc

SEQ ID NO: 143131 - RNA, 18 nt, Artificial Sequence
  Description of Artificial Sequence: Synthetic oligonucleotide
cugggagagugccgucca

SEQ ID NO: 143132 - RNA, 18 nt, Artificial Sequence
  Description of Artificial Sequence: Synthetic oligonucleotide
ccaagcugggagagugcc

SEQ ID NO: 143133 - RNA, 18 nt, Artificial Sequence
  Description of Artificial Sequence: Synthetic oligonucleotide
uacuuccaagcugggaga

SEQ ID NO: 143134 - RNA, 18 nt, Artificial Sequence
  Description of Artificial Sequence: Synthetic oligonucleotide
cugccuacuuccaagcug

SEQ ID NO: 143135 - RNA, 18 nt, Artificial Sequence
  Description of Artificial Sequence: Synthetic oligonucleotide
gaacccugccuacuucca

SEQ ID NO: 143136 - RNA, 18 nt, Artificial Sequence
  Description of Artificial Sequence: Synthetic oligonucleotide
ggagggaacccugccuac

SEQ ID NO: 143137 - RNA, 18 nt, Artificial Sequence
  Description of Artificial Sequence: Synthetic oligonucleotide
caccuggagggaacccug

SEQ ID NO: 143138 - RNA, 18 nt, Artificial Sequence
  Description of Artificial Sequence: Synthetic oligonucleotide
gggcccaccuggagggaa

SEQ ID NO: 143139 - RNA, 18 nt, Artificial Sequence
  Description of Artificial Sequence: Synthetic oligonucleotide
gcuccucuucagugaggu

SEQ ID NO: 143140 - RNA, 18 nt, Artificial Sequence
  Description of Artificial Sequence: Synthetic oligonucleotide
gacuugcuccucuucagu

SEQ ID NO: 143141 - RNA, 18 nt, Artificial Sequence
  Description of Artificial Sequence: Synthetic oligonucleotide
cuugagacuugcuccucu

SEQ ID NO: 143142 - RNA, 18 nt, Artificial Sequence
  Description of Artificial Sequence: Synthetic oligonucleotide
cuucucuugagacuugcu

SEQ ID NO: 143143 - RNA, 18 nt, Artificial Sequence
  Description of Artificial Sequence: Synthetic oligonucleotide
cccuccuucucuugagac

SEQ ID NO: 143144 - RNA, 18 nt, Artificial Sequence
  Description of Artificial Sequence: Synthetic oligonucleotide
auccccccuccuucucuu

SEQ ID NO: 143145 - RNA, 18 nt, Artificial Sequence
  Description of Artificial Sequence: Synthetic oligonucleotide
caccaauccccccuccuu

SEQ ID NO: 143146 - RNA, 18 nt, Artificial Sequence
  Description of Artificial Sequence: Synthetic oligonucleotide
ccaaccaccaaucccccc

SEQ ID NO: 143147 - RNA, 18 nt, Artificial Sequence
  Description of Artificial Sequence: Synthetic oligonucleotide
uuccuccaaccaccaauc

SEQ ID NO: 143148 - RNA, 18 nt, Artificial Sequence
  Description of Artificial Sequence: Synthetic oligonucleotide
gcugcuuccuccaaccac

SEQ ID NO: 143149 - RNA, 18 nt, Artificial Sequence
  Description of Artificial Sequence: Synthetic oligonucleotide
ggugugcugcuuccucca

SEQ ID NO: 143150 - RNA, 18 nt, Artificial Sequence
  Description of Artificial Sequence: Synthetic oligonucleotide
aauugggugugcugcuuc

SEQ ID NO: 143151 - RNA, 18 nt, Artificial Sequence
  Description of Artificial Sequence: Synthetic oligonucleotide
ggcagaauugggugugcu

SEQ ID NO: 143152 - RNA, 18 nt, Artificial Sequence
  Description of Artificial Sequence: Synthetic oligonucleotide
gggcagaauugggugugc

SEQ ID NO: 143153 - RNA, 18 nt, Artificial Sequence
  Description of Artificial Sequence: Synthetic oligonucleotide
agaccccgaguccuaggg

SEQ ID NO: 143154 - RNA, 18 nt, Artificial Sequence
  Description of Artificial Sequence: Synthetic oligonucleotide
gacucagaccccgagucc

SEQ ID NO: 143155 - RNA, 18 nt, Artificial Sequence
  Description of Artificial Sequence: Synthetic oligonucleotide
cccaggacucagaccccg

SEQ ID NO: 143156 - RNA, 18 nt, Artificial Sequence
  Description of Artificial Sequence: Synthetic oligonucleotide
cugaccccaggacucaga

SEQ ID NO: 143157 - RNA, 18 nt, Artificial Sequence
  Description of Artificial Sequence: Synthetic oligonucleotide
cuggccugaccccaggac

SEQ ID NO: 143158 - RNA, 18 nt, Artificial Sequence
  Description of Artificial Sequence: Synthetic oligonucleotide
ucucccuggccugacccc

SEQ ID NO: 143159 - RNA, 18 nt, Artificial Sequence
  Description of Artificial Sequence: Synthetic oligonucleotide
cgagcucucccuggccug

SEQ ID NO: 143160 - RNA, 18 nt, Artificial Sequence
  Description of Artificial Sequence: Synthetic oligonucleotide
ugccccgagcucucccug

SEQ ID NO: 143161 - RNA, 18 nt, Artificial Sequence
  Description of Artificial Sequence: Synthetic oligonucleotide
aggccugccccgagcucu

SEQ ID NO: 143162 - RNA, 18 nt, Artificial Sequence
  Description of Artificial Sequence: Synthetic oligonucleotide
gcggaaggccugccccga

SEQ ID NO: 143163 - RNA, 18 nt, Artificial Sequence
  Description of Artificial Sequence: Synthetic oligonucleotide
ugcuggcggaaggccugc

SEQ ID NO: 143164 - RNA, 18 nt, Artificial Sequence
  Description of Artificial Sequence: Synthetic oligonucleotide
gggagugcuggcggaagg

SEQ ID NO: 143165 - RNA, 18 nt, Artificial Sequence
  Description of Artificial Sequence: Synthetic oligonucleotide
gcagugggagugcuggcg

SEQ ID NO: 143166 - RNA, 18 nt, Artificial Sequence
  Description of Artificial Sequence: Synthetic oligonucleotide
gggcagugggagugcugg

SEQ ID NO: 143167 - RNA, 18 nt, Artificial Sequence
  Description of Artificial Sequence: Synthetic oligonucleotide
ggcugcuacugggcaggg

SEQ ID NO: 143168 - RNA, 18 nt, Artificial Sequence
  Description of Artificial Sequence: Synthetic oligonucleotide
ugggcggcugcuacuggg

SEQ ID NO: 143169 - RNA, 18 nt, Artificial Sequence
  Description of Artificial Sequence: Synthetic oligonucleotide
caaugugggcggcugcua

SEQ ID NO: 143170 - RNA, 18 nt, Artificial Sequence
  Description of Artificial Sequence: Synthetic oligonucleotide
ugacacaaugugggcggc

SEQ ID NO: 143171 - RNA, 18 nt, Artificial Sequence
  Description of Artificial Sequence: Synthetic oligonucleotide
gaugcugacacaaugugg

SEQ ID NO: 143172 - RNA, 18 nt, Artificial Sequence
  Description of Artificial Sequence: Synthetic oligonucleotide
cccuggaugcugacacaa

SEQ ID NO: 143173 - RNA, 18 nt, Artificial Sequence
  Description of Artificial Sequence: Synthetic oligonucleotide
ccuggcccuggaugcuga

SEQ ID NO: 143174 - RNA, 18 nt, Artificial Sequence
  Description of Artificial Sequence: Synthetic oligonucleotide
caggcccuggcccuggau

SEQ ID NO: 143175 - RNA, 18 nt, Artificial Sequence
  Description of Artificial Sequence: Synthetic oligonucleotide
gaggccaggcccuggccc

SEQ ID NO: 143176 - RNA, 18 nt, Artificial Sequence
  Description of Artificial Sequence: Synthetic oligonucleotide
gaugugaggccaggcccu

SEQ ID NO: 143177 - RNA, 18 nt, Artificial Sequence
  Description of Artificial Sequence: Synthetic oligonucleotide
gggaugugaggccaggcc

SEQ ID NO: 143178 - RNA, 18 nt, Artificial Sequence
  Description of Artificial Sequence: Synthetic oligonucleotide
cuagagaaaggagcaggg

SEQ ID NO: 143179 - RNA, 18 nt, Artificial Sequence
  Description of Artificial Sequence: Synthetic oligonucleotide
gccagcuagagaaaggag

SEQ ID NO: 143180 - RNA, 18 nt, Artificial Sequence
  Description of Artificial Sequence: Synthetic oligonucleotide
guggagccagcuagagaa

SEQ ID NO: 143181 - RNA, 18 nt, Artificial Sequence
  Description of Artificial Sequence: Synthetic oligonucleotide
cucccguggagccagcua

SEQ ID NO: 143182 - RNA, 18 nt, Artificial Sequence
  Description of Artificial Sequence: Synthetic oligonucleotide
cugaacucccguggagcc

SEQ ID NO: 143183 - RNA, 18 nt, Artificial Sequence
  Description of Artificial Sequence: Synthetic oligonucleotide
gggccugaacucccgugg

SEQ ID NO: 143184 - RNA, 18 nt, Artificial Sequence
  Description of Artificial Sequence: Synthetic oligonucleotide
ugugugugugcuggaggg

SEQ ID NO: 143185 - RNA, 18 nt, Artificial Sequence
  Description of Artificial Sequence: Synthetic oligonucleotide
gcuuaugugugugugcug

SEQ ID NO: 143186 - RNA, 18 nt, Artificial Sequence
  Description of Artificial Sequence: Synthetic oligonucleotide
ucagugcuuaugugugug

SEQ ID NO: 143187 - RNA, 18 nt, Artificial Sequence
  Description of Artificial Sequence: Synthetic oligonucleotide
ugauuucagugcuuaugu

SEQ ID NO: 143188 - RNA, 18 nt, Artificial Sequence
  Description of Artificial Sequence: Synthetic oligonucleotide
uaaagugauuucagugcu

SEQ ID NO: 143189 - RNA, 18 nt, Artificial Sequence
  Description of Artificial Sequence: Synthetic oligonucleotide
gcagguaaagugauuuca

SEQ ID NO: 143190 - RNA, 18 nt, Artificial Sequence
  Description of Artificial Sequence: Synthetic oligonucleotide
agccugcagguaaaguga

SEQ ID NO: 143191 - RNA, 18 nt, Artificial Sequence
  Description of Artificial Sequence: Synthetic oligonucleotide
cauggagccugcagguaa

SEQ ID NO: 143192 - RNA, 18 nt, Artificial Sequence
  Description of Artificial Sequence: Synthetic oligonucleotide
aggugcauggagccugca

SEQ ID NO: 143193 - RNA, 18 nt, Artificial Sequence
  Description of Artificial Sequence: Synthetic oligonucleotide
aagggaggugcauggagc

SEQ ID NO: 143194 - RNA, 18 nt, Artificial Sequence
  Description of Artificial Sequence: Synthetic oligonucleotide
gagggaagggaggugcau

SEQ ID NO: 143195 - RNA, 18 nt, Artificial Sequence
  Description of Artificial Sequence: Synthetic oligonucleotide
ucagggagggaagggagg

SEQ ID NO: 143196 - RNA, 18 nt, Artificial Sequence
  Description of Artificial Sequence: Synthetic oligonucleotide
cugccucagggagggaag

SEQ ID NO: 143197 - RNA, 18 nt, Artificial Sequence
  Description of Artificial Sequence: Synthetic oligonucleotide
cucaccugccucagggag

SEQ ID NO: 143198 - RNA, 18 nt, Artificial Sequence
  Description of Artificial Sequence: Synthetic oligonucleotide
ggguucucaccugccuca

SEQ ID NO: 143199 - RNA, 18 nt, Artificial Sequence
  Description of Artificial Sequence: Synthetic oligonucleotide
ucucuggguucucaccug

SEQ ID NO: 143200 - RNA, 18 nt, Artificial Sequence
  Description of Artificial Sequence: Synthetic oligonucleotide
cccucucucuggguucuc

SEQ ID NO: 143201 - RNA, 18 nt, Artificial Sequence
  Description of Artificial Sequence: Synthetic oligonucleotide
caggccccucucucuggg

SEQ ID NO: 143202 - RNA, 18 nt, Artificial Sequence
  Description of Artificial Sequence: Synthetic oligonucleotide
accugcaggccccucucu

SEQ ID NO: 143203 - RNA, 18 nt, Artificial Sequence
  Description of Artificial Sequence: Synthetic oligonucleotide
ugcucaccugcaggcccc

SEQ ID NO: 143204 - RNA, 18 nt, Artificial Sequence
  Description of Artificial Sequence: Synthetic oligonucleotide
cugccugcucaccugcag

SEQ ID NO: 143205 - RNA, 18 nt, Artificial Sequence
  Description of Artificial Sequence: Synthetic oligonucleotide
cagcccugccugcucacc

SEQ ID NO: 143206 - RNA, 18 nt, Artificial Sequence
  Description of Artificial Sequence: Synthetic oligonucleotide
uggcccagcccugccugc

SEQ ID NO: 143207 - RNA, 18 nt, Artificial Sequence
  Description of Artificial Sequence: Synthetic oligonucleotide
agaccuggcccagcccug

SEQ ID NO: 143208 - RNA, 18 nt, Artificial Sequence
  Description of Artificial Sequence: Synthetic oligonucleotide
cccggagaccuggcccag

SEQ ID NO: 143209 - RNA, 18 nt, Artificial Sequence
  Description of Artificial Sequence: Synthetic oligonucleotide
gccuccccggagaccugg

SEQ ID NO: 143210 - RNA, 18 nt, Artificial Sequence
  Description of Artificial Sequence: Synthetic oligonucleotide
ccccugccuccccggaga

SEQ ID NO: 143211 - RNA, 18 nt, Artificial Sequence
  Description of Artificial Sequence: Synthetic oligonucleotide
caggaccccugccucccc

SEQ ID NO: 143212 - RNA, 18 nt, Artificial Sequence
  Description of Artificial Sequence: Synthetic oligonucleotide
accugcaggaccccugcc

SEQ ID NO: 143213 - RNA, 18 nt, Artificial Sequence
  Description of Artificial Sequence: Synthetic oligonucleotide
ccaggaccugcaggaccc

SEQ ID NO: 143214 - RNA, 18 nt, Artificial Sequence
  Description of Artificial Sequence: Synthetic oligonucleotide
acccaccaggaccugcag

SEQ ID NO: 143215 - RNA, 18 nt, Artificial Sequence
  Description of Artificial Sequence: Synthetic oligonucleotide
ggcugacccaccaggacc

SEQ ID NO: 143216 - RNA, 18 nt, Artificial Sequence
  Description of Artificial Sequence: Synthetic oligonucleotide
ugcugggcugacccacca

SEQ ID NO: 143217 - RNA, 18 nt, Artificial Sequence
  Description of Artificial Sequence: Synthetic oligonucleotide
gcaggugcugggcugacc

SEQ ID NO: 143218 - RNA, 18 nt, Artificial Sequence
  Description of Artificial Sequence: Synthetic oligonucleotide
ugggagcaggugcugggc

SEQ ID NO: 143219 - RNA, 18 nt, Artificial Sequence
  Description of Artificial Sequence: Synthetic oligonucleotide
cccacugggagcaggugc

SEQ ID NO: 143220 - RNA, 18 nt, Artificial Sequence
  Description of Artificial Sequence: Synthetic oligonucleotide
aagcucccacugggagca

SEQ ID NO: 143221 - RNA, 18 nt, Artificial Sequence
  Description of Artificial Sequence: Synthetic oligonucleotide
ccgggaagcucccacugg

SEQ ID NO: 143222 - RNA, 18 nt, Artificial Sequence
  Description of Artificial Sequence: Synthetic oligonucleotide
uuaucccgggaagcuccc

SEQ ID NO: 143223 - RNA, 18 nt, Artificial Sequence
  Description of Artificial Sequence: Synthetic oligonucleotide
ucaguuuaucccgggaag

SEQ ID NO: 143224 - RNA, 18 nt, Artificial Sequence
  Description of Artificial Sequence: Synthetic oligonucleotide
caggcucaguuuaucccg

SEQ ID NO: 143225 - RNA, 18 nt, Artificial Sequence
  Description of Artificial Sequence: Synthetic oligonucleotide
augaacaggcucaguuua

SEQ ID NO: 143226 - RNA, 18 nt, Artificial Sequence
  Description of Artificial Sequence: Synthetic oligonucleotide
ucagaaugaacaggcuca

SEQ ID NO: 143227 - RNA, 18 nt, Artificial Sequence
  Description of Artificial Sequence: Synthetic oligonucleotide
ggacaucagaaugaacag

SEQ ID NO: 143228 - RNA, 18 nt, Artificial Sequence
  Description of Artificial Sequence: Synthetic oligonucleotide
caaauggacaucagaaug

SEQ ID NO: 143229 - RNA, 18 nt, Artificial Sequence
  Description of Artificial Sequence: Synthetic oligonucleotide
ugggacaaauggacauca

SEQ ID NO: 143230 - RNA, 18 nt, Artificial Sequence
  Description of Artificial Sequence: Synthetic oligonucleotide
gcuauugggacaaaugga

SEQ ID NO: 143231 - RNA, 18 nt, Artificial Sequence
  Description of Artificial Sequence: Synthetic oligonucleotide
guagagcuauugggacaa

SEQ ID NO: 143232 - RNA, 18 nt, Artificial Sequence
  Description of Artificial Sequence: Synthetic oligonucleotide
gggcaguagagcuauugg

SEQ ID NO: 143233 - RNA, 18 nt, Artificial Sequence
  Description of Artificial Sequence: Synthetic oligonucleotide
gggagggcaguagagcua

SEQ ID NO: 143234 - RNA, 18 nt, Artificial Sequence
  Description of Artificial Sequence: Synthetic oligonucleotide
gcugggcugaguaaaggg

SEQ ID NO: 143235 - RNA, 18 nt, Artificial Sequence
  Description of Artificial Sequence: Synthetic oligonucleotide
ggccagcugggcugagua

SEQ ID NO: 143236 - RNA, 18 nt, Artificial Sequence
  Description of Artificial Sequence: Synthetic oligonucleotide
uagguggccagcugggcu

SEQ ID NO: 143237 - RNA, 18 nt, Artificial Sequence
  Description of Artificial Sequence: Synthetic oligonucleotide
acuucuagguggccagcu

SEQ ID NO: 143238 - RNA, 18 nt, Artificial Sequence
  Description of Artificial Sequence: Synthetic oligonucleotide
gggagacuucuagguggc

SEQ ID NO: 143239 - RNA, 18 nt, Artificial Sequence
  Description of Artificial Sequence: Synthetic oligonucleotide
gugcagggagacuucuag

SEQ ID NO: 143240 - RNA, 18 nt, Artificial Sequence
  Description of Artificial Sequence: Synthetic oligonucleotide
aggcugugcagggagacu

SEQ ID NO: 143241 - RNA, 18 nt, Artificial Sequence
  Description of Artificial Sequence: Synthetic oligonucleotide
acuagaggcugugcaggg

SEQ ID NO: 143242 - RNA, 18 nt, Artificial Sequence
  Description of Artificial Sequence: Synthetic oligonucleotide
cggacacuagaggcugug

SEQ ID NO: 143243 - RNA, 18 nt, Artificial Sequence
  Description of Artificial Sequence: Synthetic oligonucleotide
guccccggacacuagagg

SEQ ID NO: 143244 - RNA, 18 nt, Artificial Sequence
  Description of Artificial Sequence: Synthetic oligonucleotide
acaagguccccggacacu

SEQ ID NO: 143245 - RNA, 18 nt, Artificial Sequence
  Description of Artificial Sequence: Synthetic oligonucleotide
gucccacaagguccccgg

SEQ ID NO: 143246 - RNA, 18 nt, Artificial Sequence
  Description of Artificial Sequence: Synthetic oligonucleotide
gacuggucccacaagguc

SEQ ID NO: 143247 - RNA, 18 nt, Artificial Sequence
  Description of Artificial Sequence: Synthetic oligonucleotide
ugugggacuggucccaca

SEQ ID NO: 143248 - RNA, 18 nt, Artificial Sequence
  Description of Artificial Sequence: Synthetic oligonucleotide
agcggugugggacugguc

SEQ ID NO: 143249 - RNA, 18 nt, Artificial Sequence
  Description of Artificial Sequence: Synthetic oligonucleotide
ggaccagcggugugggac

SEQ ID NO: 143250 - RNA, 18 nt, Artificial Sequence
  Description of Artificial Sequence: Synthetic oligonucleotide
ggcagggaccagcggugu

SEQ ID NO: 143251 - RNA, 18 nt, Artificial Sequence
  Description of Artificial Sequence: Synthetic oligonucleotide
gggagggcagggaccagc

SEQ ID NO: 143252 - RNA, 18 nt, Artificial Sequence
  Description of Artificial Sequence: Synthetic oligonucleotide
gcaccucaaccugggagc

SEQ ID NO: 143253 - RNA, 18 nt, Artificial Sequence
  Description of Artificial Sequence: Synthetic oligonucleotide
ugagcgcaccucaaccug

SEQ ID NO: 143254 - RNA, 18 nt, Artificial Sequence
  Description of Artificial Sequence: Synthetic oligonucleotide
ugaggugagcgcaccuca

SEQ ID NO: 143255 - RNA, 18 nt, Artificial Sequence
  Description of Artificial Sequence: Synthetic oligonucleotide
ugcucugaggugagcgca

SEQ ID NO: 143256 - RNA, 18 nt, Artificial Sequence
  Description of Artificial Sequence: Synthetic oligonucleotide
ggcccugcucugagguga

SEQ ID NO: 143257 - RNA, 18 nt, Artificial Sequence
  Description of Artificial Sequence: Synthetic oligonucleotide
gcuuuggcccugcucuga

SEQ ID NO: 143258 - RNA, 18 nt, Artificial Sequence
  Description of Artificial Sequence: Synthetic oligonucleotide
gcugugcuuuggcccugc

SEQ ID NO: 143259 - RNA, 18 nt, Artificial Sequence
  Description of Artificial Sequence: Synthetic oligonucleotide
gcccagcugugcuuuggc

SEQ ID NO: 143260 - RNA, 18 nt, Artificial Sequence
  Description of Artificial Sequence: Synthetic oligonucleotide
ggcaugcccagcugugcu

SEQ ID NO: 143261 - RNA, 18 nt, Artificial Sequence
  Description of Artificial Sequence: Synthetic oligonucleotide
gacauggcaugcccagcu

SEQ ID NO: 143262 - RNA, 18 nt, Artificial Sequence
  Description of Artificial Sequence: Synthetic oligonucleotide
gcucagacauggcaugcc

SEQ ID NO: 143263 - RNA, 18 nt, Artificial Sequence
  Description of Artificial Sequence: Synthetic oligonucleotide
gcgccgcucagacauggc

SEQ ID NO: 143264 - RNA, 18 nt, Artificial Sequence
  Description of Artificial Sequence: Synthetic oligonucleotide
gcucugcgccgcucagac

SEQ ID NO: 143265 - RNA, 18 nt, Artificial Sequence
  Description of Artificial Sequence: Synthetic oligonucleotide
ggagggcucugcgccgcu

SEQ ID NO: 143266 - RNA, 18 nt, Artificial Sequence
  Description of Artificial Sequence: Synthetic oligonucleotide
ggccuggagggcucugcg

SEQ ID NO: 143267 - RNA, 18 nt, Artificial Sequence
  Description of Artificial Sequence: Synthetic oligonucleotide
cugcaggccuggagggcu

SEQ ID NO: 143268 - RNA, 18 nt, Artificial Sequence
  Description of Artificial Sequence: Synthetic oligonucleotide
ugccccugcaggccugga

SEQ ID NO: 143269 - RNA, 18 nt, Artificial Sequence
  Description of Artificial Sequence: Synthetic oligonucleotide
ccccuugccccugcaggc

SEQ ID NO: 143270 - RNA, 18 nt, Artificial Sequence
  Description of Artificial Sequence: Synthetic oligonucleotide
gccagccccuugccccug

SEQ ID NO: 143271 - RNA, 18 nt, Artificial Sequence
  Description of Artificial Sequence: Synthetic oligonucleotide
cuccagccagccccuugc

SEQ ID NO: 143272 - RNA, 18 nt, Artificial Sequence
  Description of Artificial Sequence: Synthetic oligonucleotide
ugagacuccagccagccc

SEQ ID NO: 143273 - RNA, 18 nt, Artificial Sequence
  Description of Artificial Sequence: Synthetic oligonucleotide
ugcucugagacuccagcc

SEQ ID NO: 143274 - RNA, 18 nt, Artificial Sequence
  Description of Artificial Sequence: Synthetic oligonucleotide
cucugugcucugagacuc

SEQ ID NO: 143275 - RNA, 18 nt, Artificial Sequence
  Description of Artificial Sequence: Synthetic oligonucleotide
ccuaccucugugcucuga

SEQ ID NO: 143276 - RNA, 18 nt, Artificial Sequence
  Description of Artificial Sequence: Synthetic oligonucleotide
guucuccuaccucugugc

SEQ ID NO: 143277 - RNA, 18 nt, Artificial Sequence
  Description of Artificial Sequence: Synthetic oligonucleotide
ccccaguucuccuaccuc

SEQ ID NO: 143278 - RNA, 18 nt, Artificial Sequence
  Description of Artificial Sequence: Synthetic oligonucleotide
uugaaccccaguucuccu

SEQ ID NO: 143279 - RNA, 18 nt, Artificial Sequence
  Description of Artificial Sequence: Synthetic oligonucleotide
ugggcuugaaccccaguu

SEQ ID NO: 143280 - RNA, 18 nt, Artificial Sequence
  Description of Artificial Sequence: Synthetic oligonucleotide
aagccugggcuugaaccc

SEQ ID NO: 143281 - RNA, 18 nt, Artificial Sequence
  Description of Artificial Sequence: Synthetic oligonucleotide
ccaggaagccugggcuug

SEQ ID NO: 143282 - RNA, 18 nt, Artificial Sequence
  Description of Artificial Sequence: Synthetic oligonucleotide
aggacccaggaagccugg

SEQ ID NO: 143283 - RNA, 18 nt, Artificial Sequence
  Description of Artificial Sequence: Synthetic oligonucleotide
caggcaggacccaggaag

SEQ ID NO: 143284 - RNA, 18 nt, Artificial Sequence
  Description of Artificial Sequence: Synthetic oligonucleotide
aggaccaggcaggaccca

SEQ ID NO: 143285 - RNA, 18 nt, Artificial Sequence
  Description of Artificial Sequence: Synthetic oligonucleotide
gagggaggaccaggcagg

SEQ ID NO: 143286 - RNA, 18 nt, Artificial Sequence
  Description of Artificial Sequence: Synthetic oligonucleotide
cuugggagggaggaccag

SEQ ID NO: 143287 - RNA, 18 nt, Artificial Sequence
  Description of Artificial Sequence: Synthetic oligonucleotide
ggcuccuugggagggagg

SEQ ID NO: 143288 - RNA, 18 nt, Artificial Sequence
  Description of Artificial Sequence: Synthetic oligonucleotide
agaauggcuccuugggag

SEQ ID NO: 143289 - RNA, 18 nt, Artificial Sequence
  Description of Artificial Sequence: Synthetic oligonucleotide
cacacagaauggcuccuu

SEQ ID NO: 143290 - RNA, 18 nt, Artificial Sequence
  Description of Artificial Sequence: Synthetic oligonucleotide
agucacacacagaauggc

SEQ ID NO: 143291 - RNA, 18 nt, Artificial Sequence
  Description of Artificial Sequence: Synthetic oligonucleotide
cccagagucacacacaga

SEQ ID NO: 143292 - RNA, 18 nt, Artificial Sequence
  Description of Artificial Sequence: Synthetic oligonucleotide
uuccacccagagucacac

SEQ ID NO: 143293 - RNA, 18 nt, Artificial Sequence
  Description of Artificial Sequence: Synthetic oligonucleotide
ggcacuuccacccagagu

SEQ ID NO: 143294 - RNA, 18 nt, Artificial Sequence
  Description of Artificial Sequence: Synthetic oligonucleotide
ggcugggcacuuccaccc

SEQ ID NO: 143295 - RNA, 18 nt, Artificial Sequence
  Description of Artificial Sequence: Synthetic oligonucleotide
gggcugggcacuuccacc

SEQ ID NO: 143296 - RNA, 18 nt, Artificial Sequence
  Description of Artificial Sequence: Synthetic oligonucleotide
gcugcagcgcccguaggg

SEQ ID NO: 143297 - RNA, 18 nt, Artificial Sequence
  Description of Artificial Sequence: Synthetic oligonucleotide
gggaggcugcagcgcccg

SEQ ID NO: 143298 - RNA, 18 nt, Artificial Sequence
  Description of Artificial Sequence: Synthetic oligonucleotide
uggaagggaggcugcagc

SEQ ID NO: 143299 - RNA, 18 nt, Artificial Sequence
  Description of Artificial Sequence: Synthetic oligonucleotide
gggcauggaagggaggcu

SEQ ID NO: 143300 - RNA, 18 nt, Artificial Sequence
  Description of Artificial Sequence: Synthetic oligonucleotide
gccagcagagagugaucc

SEQ ID NO: 143301 - RNA, 18 nt, Artificial Sequence
  Description of Artificial Sequence: Synthetic oligonucleotide
auccugccagcagagagu

SEQ ID NO: 143302 - RNA, 18 nt, Artificial Sequence
  Description of Artificial Sequence: Synthetic oligonucleotide
gaagaauccugccagcag

SEQ ID NO: 143303 - RNA, 18 nt, Artificial Sequence
  Description of Artificial Sequence: Synthetic oligonucleotide
agcgggaagaauccugcc

SEQ ID NO: 143304 - RNA, 18 nt, Artificial Sequence
  Description of Artificial Sequence: Synthetic oligonucleotide
gggagcgggaagaauccu

SEQ ID NO: 143305 - RNA, 18 nt, Artificial Sequence
  Description of Artificial Sequence: Synthetic oligonucleotide
aucagcuggguagguggg

SEQ ID NO: 143306 - RNA, 18 nt, Artificial Sequence
  Description of Artificial Sequence: Synthetic oligonucleotide
cccccaucagcuggguag

SEQ ID NO: 143307 - RNA, 18 nt, Artificial Sequence
  Description of Artificial Sequence: Synthetic oligonucleotide
cccaacccccaucagcug

SEQ ID NO: 143308 - RNA, 18 nt, Artificial Sequence
  Description of Artificial Sequence: Synthetic oligonucleotide
agcaccccaacccccauc

SEQ ID NO: 143309 - RNA, 18 nt, Artificial Sequence
  Description of Artificial Sequence: Synthetic oligonucleotide
aaggaagcaccccaaccc

SEQ ID NO: 143310 - RNA, 18 nt, Artificial Sequence
  Description of Artificial Sequence: Synthetic oligonucleotide
ccugaaaggaagcacccc

SEQ ID NO: 143311 - RNA, 18 nt, Artificial Sequence
  Description of Artificial Sequence: Synthetic oligonucleotide
cuuggccugaaaggaagc

SEQ ID NO: 143312 - RNA, 18 nt, Artificial Sequence
  Description of Artificial Sequence: Synthetic oligonucleotide
auagccuuggccugaaag

SEQ ID NO: 143313 - RNA, 18 nt, Artificial Sequence
  Description of Artificial Sequence: Synthetic oligonucleotide
ccuucauagccuuggccu

SEQ ID NO: 143314 - RNA, 18 nt, Artificial Sequence
  Description of Artificial Sequence: Synthetic oligonucleotide
cugucccuucauagccuu

SEQ ID NO: 143315 - RNA, 18 nt, Artificial Sequence
  Description of Artificial Sequence: Synthetic oligonucleotide
agcagcugucccuucaua

SEQ ID NO: 143316 - RNA, 18 nt, Artificial Sequence
  Description of Artificial Sequence: Synthetic oligonucleotide
gucccagcagcugucccu

SEQ ID NO: 143317 - RNA, 18 nt, Artificial Sequence
  Description of Artificial Sequence: Synthetic oligonucleotide
ggugggucccagcagcug

SEQ ID NO: 143318 - RNA, 18 nt, Artificial Sequence
  Description of Artificial Sequence: Synthetic oligonucleotide
gggaggugggucccagca

SEQ ID NO: 143319 - RNA, 18 nt, Artificial Sequence
  Description of Artificial Sequence: Synthetic oligonucleotide
acgcggcauguggccggg

SEQ ID NO: 143320 - RNA, 18 nt, Artificial Sequence
  Description of Artificial Sequence: Synthetic oligonucleotide
cagggacgcggcaugugg

SEQ ID NO: 143321 - RNA, 18 nt, Artificial Sequence
  Description of Artificial Sequence: Synthetic oligonucleotide
gggcagggacgcggcaug

SEQ ID NO: 143322 - RNA, 18 nt, Artificial Sequence
  Description of Artificial Sequence: Synthetic oligonucleotide
caccagacccgggucggg

SEQ ID NO: 143323 - RNA, 18 nt, Artificial Sequence
  Description of Artificial Sequence: Synthetic oligonucleotide
cucagcaccagacccggg

SEQ ID NO: 143324 - RNA, 18 nt, Artificial Sequence
  Description of Artificial Sequence: Synthetic oligonucleotide
guauccucagcaccagac

SEQ ID NO: 143325 - RNA, 18 nt, Artificial Sequence
  Description of Artificial Sequence: Synthetic oligonucleotide
gagcuguauccucagcac

SEQ ID NO: 143326 - RNA, 18 nt, Artificial Sequence
  Description of Artificial Sequence: Synthetic oligonucleotide
gagaagagcuguauccuc

SEQ ID NO: 143327 - RNA, 18 nt, Artificial Sequence
  Description of Artificial Sequence: Synthetic oligonucleotide
acacugagaagagcugua

SEQ ID NO: 143328 - RNA, 18 nt, Artificial Sequence
  Description of Artificial Sequence: Synthetic oligonucleotide
uucagacacugagaagag

SEQ ID NO: 143329 - RNA, 18 nt, Artificial Sequence
  Description of Artificial Sequence: Synthetic oligonucleotide
gauuguucagacacugag

SEQ ID NO: 143330 - RNA, 18 nt, Artificial Sequence
  Description of Artificial Sequence: Synthetic oligonucleotide
uuggagauuguucagaca

SEQ ID NO: 143331 - RNA, 18 nt, Artificial Sequence
  Description of Artificial Sequence: Synthetic oligonucleotide
caauuuuggagauuguuc

SEQ ID NO: 143332 - RNA, 18 nt, Artificial Sequence
  Description of Artificial Sequence: Synthetic oligonucleotide
cauuucaauuuuggagau

SEQ ID NO: 143333 - RNA, 18 nt, Artificial Sequence
  Description of Artificial Sequence: Synthetic oligonucleotide
auauacauuucaauuuug

SEQ ID NO: 143334 - RNA, 18 nt, Artificial Sequence
  Description of Artificial Sequence: Synthetic oligonucleotide
caaaaauauacauuucaa

SEQ ID NO: 143335 - RNA, 18 nt, Artificial Sequence
  Description of Artificial Sequence: Synthetic oligonucleotide
ccuagcaaaaauauacau

SEQ ID NO: 143336 - RNA, 18 nt, Artificial Sequence
  Description of Artificial Sequence: Synthetic oligonucleotide
gggcuccuagcaaaaaua

SEQ ID NO: 143337 - RNA, 18 nt, Artificial Sequence
  Description of Artificial Sequence: Synthetic oligonucleotide
auuaaaaacacaggaagc

SEQ ID NO: 143338 - RNA, 18 nt, Artificial Sequence
  Description of Artificial Sequence: Synthetic oligonucleotide
uuuauauuaaaaacacag

SEQ ID NO: 143339 - RNA, 18 nt, Artificial Sequence
  Description of Artificial Sequence: Synthetic oligonucleotide
cacuauuuauauuaaaaa

SEQ ID NO: 143340 - RNA, 18 nt, Artificial Sequence
  Description of Artificial Sequence: Synthetic oligonucleotide
guguacacuauuuauauu

SEQ ID NO: 143341 - RNA, 18 nt, Artificial Sequence
  Description of Artificial Sequence: Synthetic oligonucleotide
agucuguguacacuauuu

SEQ ID NO: 143342 - RNA, 18 nt, Artificial Sequence
  Description of Artificial Sequence: Synthetic oligonucleotide
ucgucagucuguguacac

SEQ ID NO: 143343 - RNA, 18 nt, Artificial Sequence
  Description of Artificial Sequence: Synthetic oligonucleotide
aaguuucgucagucugug

SEQ ID NO: 143344 - RNA, 18 nt, Artificial Sequence
  Description of Artificial Sequence: Synthetic oligonucleotide
auuuaaaguuucgucagu

SEQ ID NO: 143345 - RNA, 18 nt, Artificial Sequence
  Description of Artificial Sequence: Synthetic oligonucleotide
cauuuauuuaaaguuucg

SEQ ID NO: 143346 - RNA, 18 nt, Artificial Sequence
  Description of Artificial Sequence: Synthetic oligonucleotide
auucccauuuauuuaaag

SEQ ID NO: 143347 - RNA, 18 nt, Artificial Sequence
  Description of Artificial Sequence: Synthetic oligonucleotide
auuuaauucccauuuauu

SEQ ID NO: 143348 - RNA, 18 nt, Artificial Sequence
  Description of Artificial Sequence: Synthetic oligonucleotide
uaaauauuuaauucccau

SEQ ID NO: 143349 - RNA, 18 nt, Artificial Sequence
  Description of Artificial Sequence: Synthetic oligonucleotide
gcucuuaaauauuuaauu

SEQ ID NO: 143350 - RNA, 18 nt, Artificial Sequence
  Description of Artificial Sequence: Synthetic oligonucleotide
agucagcucuuaaauauu

SEQ ID NO: 143351 - RNA, 18 nt, Artificial Sequence
  Description of Artificial Sequence: Synthetic oligonucleotide
uacagggugguucccauc

SEQ ID NO: 143352 - RNA, 18 nt, Artificial Sequence
  Description of Artificial Sequence: Synthetic oligonucleotide
accucuacagggugguuc

SEQ ID NO: 143353 - RNA, 18 nt, Artificial Sequence
  Description of Artificial Sequence: Synthetic oligonucleotide
gauggaccucuacagggu

SEQ ID NO: 143354 - RNA, 18 nt, Artificial Sequence
  Description of Artificial Sequence: Synthetic oligonucleotide
acgcagauggaccucuac

SEQ ID NO: 143355 - RNA, 18 nt, Artificial Sequence
  Description of Artificial Sequence: Synthetic oligonucleotide
ucugaacgcagauggacc

SEQ ID NO: 143356 - RNA, 18 nt, Artificial Sequence
  Description of Artificial Sequence: Synthetic oligonucleotide
cugggucugaacgcagau

SEQ ID NO: 143357 - RNA, 18 nt, Artificial Sequence
  Description of Artificial Sequence: Synthetic oligonucleotide
aucgucugggucugaacg

SEQ ID NO: 143358 - RNA, 18 nt, Artificial Sequence
  Description of Artificial Sequence: Synthetic oligonucleotide
cuggcaucgucugggucu

SEQ ID NO: 143359 - RNA, 18 nt, Artificial Sequence
  Description of Artificial Sequence: Synthetic oligonucleotide
uagcucuggcaucgucug

SEQ ID NO: 143360 - RNA, 18 nt, Artificial Sequence
  Description of Artificial Sequence: Synthetic oligonucleotide
agucauagcucuggcauc

SEQ ID NO: 143361 - RNA, 18 nt, Artificial Sequence
  Description of Artificial Sequence: Synthetic oligonucleotide
ggcccagucauagcucug

SEQ ID NO: 143362 - RNA, 18 nt, Artificial Sequence
  Description of Artificial Sequence: Synthetic oligonucleotide
cugcaggcccagucauag

SEQ ID NO: 143363 - RNA, 18 nt, Artificial Sequence
  Description of Artificial Sequence: Synthetic oligonucleotide
cacaccugcaggcccagu

SEQ ID NO: 143364 - RNA, 18 nt, Artificial Sequence
  Description of Artificial Sequence: Synthetic oligonucleotide
ggcgccacaccugcaggc

SEQ ID NO: 143365 - RNA, 18 nt, Artificial Sequence
  Description of Artificial Sequence: Synthetic oligonucleotide
cccucggcgccacaccug

SEQ ID NO: 143366 - RNA, 18 nt, Artificial Sequence
  Description of Artificial Sequence: Synthetic oligonucleotide
aucuccccucggcgccac

SEQ ID NO: 143367 - RNA, 18 nt, Artificial Sequence
  Description of Artificial Sequence: Synthetic oligonucleotide
ggcugaucuccccucggc

SEQ ID NO: 143368 - RNA, 18 nt, Artificial Sequence
  Description of Artificial Sequence: Synthetic oligonucleotide
uccauggcugaucucccc

SEQ ID NO: 143369 - RNA, 18 nt, Artificial Sequence
  Description of Artificial Sequence: Synthetic oligonucleotide
gcugcuccauggcugauc

SEQ ID NO: 143370 - RNA, 18 nt, Artificial Sequence
  Description of Artificial Sequence: Synthetic oligonucleotide
cuguggcugcuccauggc

SEQ ID NO: 143371 - RNA, 18 nt, Artificial Sequence
  Description of Artificial Sequence: Synthetic oligonucleotide
uccuccuguggcugcucc

SEQ ID NO: 143372 - RNA, 18 nt, Artificial Sequence
  Description of Artificial Sequence: Synthetic oligonucleotide
gggcuuccuccuguggcu

SEQ ID NO: 143373 - RNA, 18 nt, Artificial Sequence
  Description of Artificial Sequence: Synthetic oligonucleotide
ucuucccggaccucaggg

SEQ ID NO: 143374 - RNA, 18 nt, Artificial Sequence
  Description of Artificial Sequence: Synthetic oligonucleotide
uccucuucccggaccuca

SEQ ID NO: 143375 - RNA, 18 nt, Artificial Sequence
  Description of Artificial Sequence: Synthetic oligonucleotide
ucuccuccucuucccgga

SEQ ID NO: 143376 - RNA, 18 nt, Artificial Sequence
  Description of Artificial Sequence: Synthetic oligonucleotide
cucuuucuccuccucuuc

SEQ ID NO: 143377 - RNA, 18 nt, Artificial Sequence
  Description of Artificial Sequence: Synthetic oligonucleotide
acuuccucuuucuccucc

SEQ ID NO: 143378 - RNA, 18 nt, Artificial Sequence
  Description of Artificial Sequence: Synthetic oligonucleotide
cugccacuuccucuuucu

SEQ ID NO: 143379 - RNA, 18 nt, Artificial Sequence
  Description of Artificial Sequence: Synthetic oligonucleotide
ugccucugccacuuccuc

SEQ ID NO: 143380 - RNA, 18 nt, Artificial Sequence
  Description of Artificial Sequence: Synthetic oligonucleotide
ccuucugccucugccacu

SEQ ID NO: 143381 - RNA, 18 nt, Artificial Sequence
  Description of Artificial Sequence: Synthetic oligonucleotide
gggcuccuucugccucug

SEQ ID NO: 143382 - RNA, 18 nt, Artificial Sequence
  Description of Artificial Sequence: Synthetic oligonucleotide
cccccauugagcucuggg

SEQ ID NO: 143383 - RNA, 18 nt, Artificial Sequence
  Description of Artificial Sequence: Synthetic oligonucleotide
gucccccauugagcucug

SEQ ID NO: 143384 - RNA, 18 nt, Artificial Sequence
  Description of Artificial Sequence: Synthetic oligonucleotide
cuguggucccccauugag

SEQ ID NO: 143385 - RNA, 18 nt, Artificial Sequence
  Description of Artificial Sequence: Synthetic oligonucleotide
gcaugcugugguccccca

SEQ ID NO: 143386 - RNA, 18 nt, Artificial Sequence
  Description of Artificial Sequence: Synthetic oligonucleotide
gaagugcaugcugugguc

SEQ ID NO: 143387 - RNA, 18 nt, Artificial Sequence
  Description of Artificial Sequence: Synthetic oligonucleotide
ggaaggaagugcaugcug

SEQ ID NO: 143388 - RNA, 18 nt, Artificial Sequence
  Description of Artificial Sequence: Synthetic oligonucleotide
cugcuggaaggaagugca

SEQ ID NO: 143389 - RNA, 18 nt, Artificial Sequence
  Description of Artificial Sequence: Synthetic oligonucleotide
uguagcugcuggaaggaa

SEQ ID NO: 143390 - RNA, 18 nt, Artificial Sequence
  Description of Artificial Sequence: Synthetic oligonucleotide
uccccugccaguccucuc

SEQ ID NO: 143391 - RNA, 18 nt, Artificial Sequence
  Description of Artificial Sequence: Synthetic oligonucleotide
ccguguccccugccaguc

SEQ ID NO: 143392 - RNA, 18 nt, Artificial Sequence
  Description of Artificial Sequence: Synthetic oligonucleotide
cugccccguguccccugc

SEQ ID NO: 143393 - RNA, 18 nt, Artificial Sequence
  Description of Artificial Sequence: Synthetic oligonucleotide
cuccucugccccgugucc

SEQ ID NO: 143394 - RNA, 18 nt, Artificial Sequence
  Description of Artificial Sequence: Synthetic oligonucleotide
ugugccuccucugccccg

SEQ ID NO: 143395 - RNA, 18 nt, Artificial Sequence
  Description of Artificial Sequence: Synthetic oligonucleotide
ugggcugugccuccucug

SEQ ID NO: 143396 - RNA, 18 nt, Artificial Sequence
  Description of Artificial Sequence: Synthetic oligonucleotide
ugcacugggcugugccuc

SEQ ID NO: 143397 - RNA, 18 nt, Artificial Sequence
  Description of Artificial Sequence: Synthetic oligonucleotide
cccacugcacugggcugu

SEQ ID NO: 143398 - RNA, 18 nt, Artificial Sequence
  Description of Artificial Sequence: Synthetic oligonucleotide
ggauccccacugcacugg

SEQ ID NO: 143399 - RNA, 18 nt, Artificial Sequence
  Description of Artificial Sequence: Synthetic oligonucleotide
ggccaggauccccacugc

SEQ ID NO: 143400 - RNA, 18 nt, Artificial Sequence
  Description of Artificial Sequence: Synthetic oligonucleotide
cagagggccaggaucccc

SEQ ID NO: 143401 - RNA, 18 nt, Artificial Sequence
  Description of Artificial Sequence: Synthetic oligonucleotide
guuugcagagggccagga

SEQ ID NO: 143402 - RNA, 18 nt, Artificial Sequence
  Description of Artificial Sequence: Synthetic oligonucleotide
auggcguuugcagagggc

SEQ ID NO: 143403 - RNA, 18 nt, Artificial Sequence
  Description of Artificial Sequence: Synthetic oligonucleotide
acaugauggcguuugcag

SEQ ID NO: 143404 - RNA, 18 nt, Artificial Sequence
  Description of Artificial Sequence: Synthetic oligonucleotide
gccccacaugauggcguu

SEQ ID NO: 143405 - RNA, 18 nt, Artificial Sequence
  Description of Artificial Sequence: Synthetic oligonucleotide
ucugcgccccacaugaug

SEQ ID NO: 143406 - RNA, 18 nt, Artificial Sequence
  Description of Artificial Sequence: Synthetic oligonucleotide
gcuacucugcgccccaca

SEQ ID NO: 143407 - RNA, 18 nt, Artificial Sequence
  Description of Artificial Sequence: Synthetic oligonucleotide
acucugcuacucugcgcc

SEQ ID NO: 143408 - RNA, 18 nt, Artificial Sequence
  Description of Artificial Sequence: Synthetic oligonucleotide
ucagcacucugcuacucu

SEQ ID NO: 143409 - RNA, 18 nt, Artificial Sequence
  Description of Artificial Sequence: Synthetic oligonucleotide
guccuucagcacucugcu

SEQ ID NO: 143410 - RNA, 18 nt, Artificial Sequence
  Description of Artificial Sequence: Synthetic oligonucleotide
cuccaguccuucagcacu

SEQ ID NO: 143411 - RNA, 18 nt, Artificial Sequence
  Description of Artificial Sequence: Synthetic oligonucleotide
uccggcuccaguccuuca

SEQ ID NO: 143412 - RNA, 18 nt, Artificial Sequence
  Description of Artificial Sequence: Synthetic oligonucleotide
aggcuuccggcuccaguc

SEQ ID NO: 143413 - RNA, 18 nt, Artificial Sequence
  Description of Artificial Sequence: Synthetic oligonucleotide
aacccaggcuuccggcuc

SEQ ID NO: 143414 - RNA, 18 nt, Artificial Sequence
  Description of Artificial Sequence: Synthetic oligonucleotide
gcgugaacccaggcuucc

SEQ ID NO: 143415 - RNA, 18 nt, Artificial Sequence
  Description of Artificial Sequence: Synthetic oligonucleotide
acugggcgugaacccagg

SEQ ID NO: 143416 - RNA, 18 nt, Artificial Sequence
  Description of Artificial Sequence: Synthetic oligonucleotide
accgcacugggcgugaac

SEQ ID NO: 143417 - RNA, 18 nt, Artificial Sequence
  Description of Artificial Sequence: Synthetic oligonucleotide
uccccaccgcacugggcg

SEQ ID NO: 143418 - RNA, 18 nt, Artificial Sequence
  Description of Artificial Sequence: Synthetic oligonucleotide
gcagauccccaccgcacu

SEQ ID NO: 143419 - RNA, 18 nt, Artificial Sequence
  Description of Artificial Sequence: Synthetic oligonucleotide
gcagagcagauccccacc

SEQ ID NO: 143420 - RNA, 18 nt, Artificial Sequence
  Description of Artificial Sequence: Synthetic oligonucleotide
gaguggcagagcagaucc

SEQ ID NO: 143421 - RNA, 18 nt, Artificial Sequence
  Description of Artificial Sequence: Synthetic oligonucleotide
cuggugaguggcagagca

SEQ ID NO: 143422 - RNA, 18 nt, Artificial Sequence
  Description of Artificial Sequence: Synthetic oligonucleotide
cacugcuggugaguggca

SEQ ID NO: 143423 - RNA, 18 nt, Artificial Sequence
  Description of Artificial Sequence: Synthetic oligonucleotide
ggccccacugcuggugag

SEQ ID NO: 143424 - RNA, 18 nt, Artificial Sequence
  Description of Artificial Sequence: Synthetic oligonucleotide
cuccaggccccacugcug

SEQ ID NO: 143425 - RNA, 18 nt, Artificial Sequence
  Description of Artificial Sequence: Synthetic oligonucleotide
gcuugcuccaggccccac

SEQ ID NO: 143426 - RNA, 18 nt, Artificial Sequence
  Description of Artificial Sequence: Synthetic oligonucleotide
gugcagcuugcuccaggc

SEQ ID NO: 143427 - RNA, 18 nt, Artificial Sequence
  Description of Artificial Sequence: Synthetic oligonucleotide
aaguggugcagcuugcuc

SEQ ID NO: 143428 - RNA, 18 nt, Artificial Sequence
  Description of Artificial Sequence: Synthetic oligonucleotide
gaaggaaguggugcagcu

SEQ ID NO: 143429 - RNA, 18 nt, Artificial Sequence
  Description of Artificial Sequence: Synthetic oligonucleotide
uuacagaaggaaguggug

SEQ ID NO: 143430 - RNA, 18 nt, Artificial Sequence
  Description of Artificial Sequence: Synthetic oligonucleotide
cuguuuuacagaaggaag

SEQ ID NO: 143431 - RNA, 18 nt, Artificial Sequence
  Description of Artificial Sequence: Synthetic oligonucleotide
uuggccuguuuuacagaa

SEQ ID NO: 143432 - RNA, 18 nt, Artificial Sequence
  Description of Artificial Sequence: Synthetic oligonucleotide
auccuuuggccuguuuua

SEQ ID NO: 143433 - RNA, 18 nt, Artificial Sequence
  Description of Artificial Sequence: Synthetic oligonucleotide
cuaccauccuuuggccug

SEQ ID NO: 143434 - RNA, 18 nt, Artificial Sequence
  Description of Artificial Sequence: Synthetic oligonucleotide
aucaccuaccauccuuug

SEQ ID NO: 143435 - RNA, 18 nt, Artificial Sequence
  Description of Artificial Sequence: Synthetic oligonucleotide
uccacaucaccuaccauc

SEQ ID NO: 143436 - RNA, 18 nt, Artificial Sequence
  Description of Artificial Sequence: Synthetic oligonucleotide
ccauauccacaucaccua

SEQ ID NO: 143437 - RNA, 18 nt, Artificial Sequence
  Description of Artificial Sequence: Synthetic oligonucleotide
aaagcccauauccacauc

SEQ ID NO: 143438 - RNA, 18 nt, Artificial Sequence
  Description of Artificial Sequence: Synthetic oligonucleotide
ucacgaaagcccauaucc

SEQ ID NO: 143439 - RNA, 18 nt, Artificial Sequence
  Description of Artificial Sequence: Synthetic oligonucleotide
aauucucacgaaagccca

SEQ ID NO: 143440 - RNA, 18 nt, Artificial Sequence
  Description of Artificial Sequence: Synthetic oligonucleotide
cauuuaauucucacgaaa

SEQ ID NO: 143441 - RNA, 18 nt, Artificial Sequence
  Description of Artificial Sequence: Synthetic oligonucleotide
ccacucauuuaauucuca

SEQ ID NO: 143442 - RNA, 18 nt, Artificial Sequence
  Description of Artificial Sequence: Synthetic oligonucleotide
gaugcccacucauuuaau

SEQ ID NO: 143443 - RNA, 18 nt, Artificial Sequence
  Description of Artificial Sequence: Synthetic oligonucleotide
uuacagaugcccacucau

SEQ ID NO: 143444 - RNA, 18 nt, Artificial Sequence
  Description of Artificial Sequence: Synthetic oligonucleotide
auguguuacagaugccca

SEQ ID NO: 143445 - RNA, 18 nt, Artificial Sequence
  Description of Artificial Sequence: Synthetic oligonucleotide
augacauguguuacagau

SEQ ID NO: 143446 - RNA, 18 nt, Artificial Sequence
  Description of Artificial Sequence: Synthetic oligonucleotide
ugaugaugacauguguua

SEQ ID NO: 143447 - RNA, 18 nt, Artificial Sequence
  Description of Artificial Sequence: Synthetic oligonucleotide
aauaaugaugaugacaug

SEQ ID NO: 143448 - RNA, 18 nt, Artificial Sequence
  Description of Artificial Sequence: Synthetic oligonucleotide
auacuaauaaugaugaug

SEQ ID NO: 143449 - RNA, 18 nt, Artificial Sequence
  Description of Artificial Sequence: Synthetic oligonucleotide
ugggaauacuaauaauga

SEQ ID NO: 143450 - RNA, 18 nt, Artificial Sequence
  Description of Artificial Sequence: Synthetic oligonucleotide
aguggugggaauacuaau

SEQ ID NO: 143451 - RNA, 18 nt, Artificial Sequence
  Description of Artificial Sequence: Synthetic oligonucleotide
uuaacaguggugggaaua

SEQ ID NO: 143452 - RNA, 18 nt, Artificial Sequence
  Description of Artificial Sequence: Synthetic oligonucleotide
uuguguuaacaguggugg

SEQ ID NO: 143453 - RNA, 18 nt, Artificial Sequence
  Description of Artificial Sequence: Synthetic oligonucleotide
augccuuguguuaacagu

SEQ ID NO: 143454 - RNA, 18 nt, Artificial Sequence
  Description of Artificial Sequence: Synthetic oligonucleotide
cucagaugccuuguguua

SEQ ID NO: 143455 - RNA, 18 nt, Artificial Sequence
  Description of Artificial Sequence: Synthetic oligonucleotide
uuggucucagaugccuug

SEQ ID NO: 143456 - RNA, 18 nt, Artificial Sequence
  Description of Artificial Sequence: Synthetic oligonucleotide
ggagauuggucucagaug

SEQ ID NO: 143457 - RNA, 18 nt, Artificial Sequence
  Description of Artificial Sequence: Synthetic oligonucleotide
uuaguggagauuggucuc

SEQ ID NO: 143458 - RNA, 18 nt, Artificial Sequence
  Description of Artificial Sequence: Synthetic oligonucleotide
ugcuguuaguggagauug

SEQ ID NO: 143459 - RNA, 18 nt, Artificial Sequence
  Description of Artificial Sequence: Synthetic oligonucleotide
uagugugcuguuagugga

SEQ ID NO: 143460 - RNA, 18 nt, Artificial Sequence
  Description of Artificial Sequence: Synthetic oligonucleotide
cuuucuagugugcuguua

SEQ ID NO: 143461 - RNA, 18 nt, Artificial Sequence
  Description of Artificial Sequence: Synthetic oligonucleotide
cugaucuuucuagugugc

SEQ ID NO: 143462 - RNA, 18 nt, Artificial Sequence
  Description of Artificial Sequence: Synthetic oligonucleotide
uacagcugaucuuucuag

SEQ ID NO: 143463 - RNA, 18 nt, Artificial Sequence
  Description of Artificial Sequence: Synthetic oligonucleotide
ccagguacagcugaucuu

SEQ ID NO: 143464 - RNA, 18 nt, Artificial Sequence
  Description of Artificial Sequence: Synthetic oligonucleotide
caaucccagguacagcug

SEQ ID NO: 143465 - RNA, 18 nt, Artificial Sequence
  Description of Artificial Sequence: Synthetic oligonucleotide
cauaacaaucccagguac

SEQ ID NO: 143466 - RNA, 18 nt, Artificial Sequence
  Description of Artificial Sequence: Synthetic oligonucleotide
cugaucauaacaauccca

SEQ ID NO: 143467 - RNA, 18 nt, Artificial Sequence
  Description of Artificial Sequence: Synthetic oligonucleotide
uucgacugaucauaacaa

SEQ ID NO: 143468 - RNA, 18 nt, Artificial Sequence
  Description of Artificial Sequence: Synthetic oligonucleotide
uguguuucgacugaucau

SEQ ID NO: 143469 - RNA, 18 nt, Artificial Sequence
  Description of Artificial Sequence: Synthetic oligonucleotide
aacuguguguuucgacug

SEQ ID NO: 143470 - RNA, 18 nt, Artificial Sequence
  Description of Artificial Sequence: Synthetic oligonucleotide
aauugaacuguguguuuc

SEQ ID NO: 143471 - RNA, 18 nt, Artificial Sequence
  Description of Artificial Sequence: Synthetic oligonucleotide
agaccaauugaacugugu

SEQ ID NO: 143472 - RNA, 18 nt, Artificial Sequence
  Description of Artificial Sequence: Synthetic oligonucleotide
uuaccagaccaauugaac

SEQ ID NO: 143473 - RNA, 18 nt, Artificial Sequence
  Description of Artificial Sequence: Synthetic oligonucleotide
aauuauuaccagaccaau

SEQ ID NO: 143474 - RNA, 18 nt, Artificial Sequence
  Description of Artificial Sequence: Synthetic oligonucleotide
uguauaauuauuaccaga

SEQ ID NO: 143475 - RNA, 18 nt, Artificial Sequence
  Description of Artificial Sequence: Synthetic oligonucleotide
ugauguguauaauuauua

SEQ ID NO: 143476 - RNA, 18 nt, Artificial Sequence
  Description of Artificial Sequence: Synthetic oligonucleotide
aaugaugauguguauaau

SEQ ID NO: 143477 - RNA, 18 nt, Artificial Sequence
  Description of Artificial Sequence: Synthetic oligonucleotide
ggcucaaugaugaugugu

SEQ ID NO: 143478 - RNA, 18 nt, Artificial Sequence
  Description of Artificial Sequence: Synthetic oligonucleotide
gauacggcucaaugauga

SEQ ID NO: 143479 - RNA, 18 nt, Artificial Sequence
  Description of Artificial Sequence: Synthetic oligonucleotide
auuaugauacggcucaau

SEQ ID NO: 143480 - RNA, 18 nt, Artificial Sequence
  Description of Artificial Sequence: Synthetic oligonucleotide
aucuaauuaugauacggc

SEQ ID NO: 143481 - RNA, 18 nt, Artificial Sequence
  Description of Artificial Sequence: Synthetic oligonucleotide
uuuuuaucuaauuaugau

SEQ ID NO: 143482 - RNA, 18 nt, Artificial Sequence
  Description of Artificial Sequence: Synthetic oligonucleotide
uagcauuuuuaucuaauu

SEQ ID NO: 143483 - RNA, 18 nt, Artificial Sequence
  Description of Artificial Sequence: Synthetic oligonucleotide
cugcuuagcauuuuuauc

SEQ ID NO: 143484 - RNA, 18 nt, Artificial Sequence
  Description of Artificial Sequence: Synthetic oligonucleotide
acuaacugcuuagcauuu

SEQ ID NO: 143485 - RNA, 18 nt, Artificial Sequence
  Description of Artificial Sequence: Synthetic oligonucleotide
uucauacuaacugcuuag

SEQ ID NO: 143486 - RNA, 18 nt, Artificial Sequence
  Description of Artificial Sequence: Synthetic oligonucleotide
aguuauucauacuaacug

SEQ ID NO: 143487 - RNA, 18 nt, Artificial Sequence
  Description of Artificial Sequence: Synthetic oligonucleotide
aguugaguuauucauacu

SEQ ID NO: 143488 - RNA, 18 nt, Artificial Sequence
  Description of Artificial Sequence: Synthetic oligonucleotide
auauuaguugaguuauuc

SEQ ID NO: 143489 - RNA, 18 nt, Artificial Sequence
  Description of Artificial Sequence: Synthetic oligonucleotide
cacaggaaguucuauucu

SEQ ID NO: 143490 - RNA, 18 nt, Artificial Sequence
  Description of Artificial Sequence: Synthetic oligonucleotide
ucccccacaggaaguucu

SEQ ID NO: 143491 - RNA, 18 nt, Artificial Sequence
  Description of Artificial Sequence: Synthetic oligonucleotide
caccaucccccacaggaa

SEQ ID NO: 143492 - RNA, 18 nt, Artificial Sequence
  Description of Artificial Sequence: Synthetic oligonucleotide
cuccccaccaucccccac

SEQ ID NO: 143493 - RNA, 18 nt, Artificial Sequence
  Description of Artificial Sequence: Synthetic oligonucleotide
cuagccuccccaccaucc

SEQ ID NO: 143494 - RNA, 18 nt, Artificial Sequence
  Description of Artificial Sequence: Synthetic oligonucleotide
cagagcuagccuccccac

SEQ ID NO: 143495 - RNA, 18 nt, Artificial Sequence
  Description of Artificial Sequence: Synthetic oligonucleotide
cucugcagagcuagccuc

SEQ ID NO: 143496 - RNA, 18 nt, Artificial Sequence
  Description of Artificial Sequence: Synthetic oligonucleotide
uagaccucugcagagcua

SEQ ID NO: 143497 - RNA, 18 nt, Artificial Sequence
  Description of Artificial Sequence: Synthetic oligonucleotide
gacuguagaccucugcag

SEQ ID NO: 143498 - RNA, 18 nt, Artificial Sequence
  Description of Artificial Sequence: Synthetic oligonucleotide
ugcaggacuguagaccuc

SEQ ID NO: 143499 - RNA, 18 nt, Artificial Sequence
  Description of Artificial Sequence: Synthetic oligonucleotide
gaaacugcaggacuguag

SEQ ID NO: 143500 - RNA, 18 nt, Artificial Sequence
  Description of Artificial Sequence: Synthetic oligonucleotide
uugcagaaacugcaggac

SEQ ID NO: 143501 - RNA, 18 nt, Artificial Sequence
  Description of Artificial Sequence: Synthetic oligonucleotide
guguuuugcagaaacugc

SEQ ID NO: 143502 - RNA, 18 nt, Artificial Sequence
  Description of Artificial Sequence: Synthetic oligonucleotide
gcaacguguuuugcagaa

SEQ ID NO: 143503 - RNA, 18 nt, Artificial Sequence
  Description of Artificial Sequence: Synthetic oligonucleotide
ugugugcaacguguuuug

SEQ ID NO: 143504 - RNA, 18 nt, Artificial Sequence
  Description of Artificial Sequence: Synthetic oligonucleotide
ggagaugugugcaacgug

SEQ ID NO: 143505 - RNA, 18 nt, Artificial Sequence
  Description of Artificial Sequence: Synthetic oligonucleotide
cauauggagaugugugca

SEQ ID NO: 143506 - RNA, 18 nt, Artificial Sequence
  Description of Artificial Sequence: Synthetic oligonucleotide
uggcccauauggagaugu

SEQ ID NO: 143507 - RNA, 18 nt, Artificial Sequence
  Description of Artificial Sequence: Synthetic oligonucleotide
ccguguggcccauaugga

SEQ ID NO: 143508 - RNA, 18 nt, Artificial Sequence
  Description of Artificial Sequence: Synthetic oligonucleotide
ugccaccguguggcccau

SEQ ID NO: 143509 - RNA, 18 nt, Artificial Sequence
  Description of Artificial Sequence: Synthetic oligonucleotide
gagguugccaccgugugg

SEQ ID NO: 143510 - RNA, 18 nt, Artificial Sequence
  Description of Artificial Sequence: Synthetic oligonucleotide
guucagagguugccaccg

SEQ ID NO: 143511 - RNA, 18 nt, Artificial Sequence
  Description of Artificial Sequence: Synthetic oligonucleotide
uccugguucagagguugc

SEQ ID NO: 143512 - RNA, 18 nt, Artificial Sequence
  Description of Artificial Sequence: Synthetic oligonucleotide
agcucuccugguucagag

SEQ ID NO: 143513 - RNA, 18 nt, Artificial Sequence
  Description of Artificial Sequence: Synthetic oligonucleotide
gaagcagcucuccugguu

SEQ ID NO: 143514 - RNA, 18 nt, Artificial Sequence
  Description of Artificial Sequence: Synthetic oligonucleotide
cuuaggaagcagcucucc

SEQ ID NO: 143515 - RNA, 18 nt, Artificial Sequence
  Description of Artificial Sequence: Synthetic oligonucleotide
uagcccuuaggaagcagc

SEQ ID NO: 143516 - RNA, 18 nt, Artificial Sequence
  Description of Artificial Sequence: Synthetic oligonucleotide
ggucuuagcccuuaggaa

SEQ ID NO: 143517 - RNA, 18 nt, Artificial Sequence
  Description of Artificial Sequence: Synthetic oligonucleotide
cagagggucuuagcccuu

SEQ ID NO: 143518 - RNA, 18 nt, Artificial Sequence
  Description of Artificial Sequence: Synthetic oligonucleotide
gcagacagagggucuuag

SEQ ID NO: 143519 - RNA, 18 nt, Artificial Sequence
  Description of Artificial Sequence: Synthetic oligonucleotide
agaaagcagacagagggu

SEQ ID NO: 143520 - RNA, 18 nt, Artificial Sequence
  Description of Artificial Sequence: Synthetic oligonucleotide
gagagagaaagcagacag

SEQ ID NO: 143521 - RNA, 18 nt, Artificial Sequence
  Description of Artificial Sequence: Synthetic oligonucleotide
agcaagagagagaaagca

SEQ ID NO: 143522 - RNA, 18 nt, Artificial Sequence
  Description of Artificial Sequence: Synthetic oligonucleotide
aggaaagcaagagagaga

SEQ ID NO: 143523 - RNA, 18 nt, Artificial Sequence
  Description of Artificial Sequence: Synthetic oligonucleotide
uugggaggaaagcaagag

SEQ ID NO: 143524 - RNA, 18 nt, Artificial Sequence
  Description of Artificial Sequence: Synthetic oligonucleotide
guguuuugggaggaaagc

SEQ ID NO: 143525 - RNA, 18 nt, Artificial Sequence
  Description of Artificial Sequence: Synthetic oligonucleotide
uggcuguguuuugggagg

SEQ ID NO: 143526 - RNA, 18 nt, Artificial Sequence
  Description of Artificial Sequence: Synthetic oligonucleotide
gaggauggcuguguuuug

SEQ ID NO: 143527 - RNA, 18 nt, Artificial Sequence
  Description of Artificial Sequence: Synthetic oligonucleotide
gggaggaggauggcugug

SEQ ID NO: 143528 - RNA, 18 nt, Artificial Sequence
  Description of Artificial Sequence: Synthetic oligonucleotide
ggcugaacucaccauggg

SEQ ID NO: 143529 - RNA, 18 nt, Artificial Sequence
  Description of Artificial Sequence: Synthetic oligonucleotide
ugggcugaacucaccaug

SEQ ID NO: 143530 - RNA, 18 nt, Artificial Sequence
  Description of Artificial Sequence: Synthetic oligonucleotide
cuuccugggcugaacuca

SEQ ID NO: 143531 - RNA, 18 nt, Artificial Sequence
  Description of Artificial Sequence: Synthetic oligonucleotide
agaggcuuccugggcuga

SEQ ID NO: 143532 - RNA, 18 nt, Artificial Sequence
  Description of Artificial Sequence: Synthetic oligonucleotide
gggucagaggcuuccugg

SEQ ID NO: 143533 - RNA, 18 nt, Artificial Sequence
  Description of Artificial Sequence: Synthetic oligonucleotide
gggcugggucagaggcuu

SEQ ID NO: 143534 - RNA, 18 nt, Artificial Sequence
  Description of Artificial Sequence: Synthetic oligonucleotide
caucagggcugggucaga

SEQ ID NO: 143535 - RNA, 18 nt, Artificial Sequence
  Description of Artificial Sequence: Synthetic oligonucleotide
auuaccaucagggcuggg

SEQ ID NO: 143536 - RNA, 18 nt, Artificial Sequence
  Description of Artificial Sequence: Synthetic oligonucleotide
cagcuauuaccaucaggg

SEQ ID NO: 143537 - RNA, 18 nt, Artificial Sequence
  Description of Artificial Sequence: Synthetic oligonucleotide
cacagcagcuauuaccau

SEQ ID NO: 143538 - RNA, 18 nt, Artificial Sequence
  Description of Artificial Sequence: Synthetic oligonucleotide
caguacacagcagcuauu

SEQ ID NO: 143539 - RNA, 18 nt, Artificial Sequence
  Description of Artificial Sequence: Synthetic oligonucleotide
auguccaguacacagcag

SEQ ID NO: 143540 - RNA, 18 nt, Artificial Sequence
  Description of Artificial Sequence: Synthetic oligonucleotide
agaagauguccaguacac

SEQ ID NO: 143541 - RNA, 18 nt, Artificial Sequence
  Description of Artificial Sequence: Synthetic oligonucleotide
cauacagaagauguccag

SEQ ID NO: 143542 - RNA, 18 nt, Artificial Sequence
  Description of Artificial Sequence: Synthetic oligonucleotide
ccuaacauacagaagaug

SEQ ID NO: 143543 - RNA, 18 nt, Artificial Sequence
  Description of Artificial Sequence: Synthetic oligonucleotide
cagagccuaacauacaga

SEQ ID NO: 143544 - RNA, 18 nt, Artificial Sequence
  Description of Artificial Sequence: Synthetic oligonucleotide
ucucccagagccuaacau

SEQ ID NO: 143545 - RNA, 18 nt, Artificial Sequence
  Description of Artificial Sequence: Synthetic oligonucleotide
gcauuucucccagagccu

SEQ ID NO: 143546 - RNA, 18 nt, Artificial Sequence
  Description of Artificial Sequence: Synthetic oligonucleotide
ccacagcauuucucccag

SEQ ID NO: 143547 - RNA, 18 nt, Artificial Sequence
  Description of Artificial Sequence: Synthetic oligonucleotide
agucuccacagcauuucu

SEQ ID NO: 143548 - RNA, 18 nt, Artificial Sequence
  Description of Artificial Sequence: Synthetic oligonucleotide
caaaaagucuccacagca

SEQ ID NO: 143549 - RNA, 18 nt, Artificial Sequence
  Description of Artificial Sequence: Synthetic oligonucleotide
augggcaaaaagucucca

SEQ ID NO: 143550 - RNA, 18 nt, Artificial Sequence
  Description of Artificial Sequence: Synthetic oligonucleotide
ggaggaugggcaaaaagu

SEQ ID NO: 143551 - RNA, 18 nt, Artificial Sequence
  Description of Artificial Sequence: Synthetic oligonucleotide
cucugggaggaugggcaa

SEQ ID NO: 143552 - RNA, 18 nt, Artificial Sequence
  Description of Artificial Sequence: Synthetic oligonucleotide
agcuucucugggaggaug

SEQ ID NO: 143553 - RNA, 18 nt, Artificial Sequence
  Description of Artificial Sequence: Synthetic oligonucleotide
cugacagcuucucuggga

SEQ ID NO: 143554 - RNA, 18 nt, Artificial Sequence
  Description of Artificial Sequence: Synthetic oligonucleotide
ggguacugacagcuucuc

SEQ ID NO: 143555 - RNA, 18 nt, Artificial Sequence
  Description of Artificial Sequence: Synthetic oligonucleotide
ucuucaccuagaacaggg

SEQ ID NO: 143556 - RNA, 18 nt, Artificial Sequence
  Description of Artificial Sequence: Synthetic oligonucleotide
guuucuucaccuagaaca

SEQ ID NO: 143557 - RNA, 18 nt, Artificial Sequence
  Description of Artificial Sequence: Synthetic oligonucleotide
gaccaguuucuucaccua

SEQ ID NO: 143558 - RNA, 18 nt, Artificial Sequence
  Description of Artificial Sequence: Synthetic oligonucleotide
cugaggaccaguuucuuc

SEQ ID NO: 143559 - RNA, 18 nt, Artificial Sequence
  Description of Artificial Sequence: Synthetic oligonucleotide
ccuuucugaggaccaguu

SEQ ID NO: 143560 - RNA, 18 nt, Artificial Sequence
  Description of Artificial Sequence: Synthetic oligonucleotide
gucaaccuuucugaggac

SEQ ID NO: 143561 - RNA, 18 nt, Artificial Sequence
  Description of Artificial Sequence: Synthetic oligonucleotide
agggagucaaccuuucug

SEQ ID NO: 143562 - RNA, 18 nt, Artificial Sequence
  Description of Artificial Sequence: Synthetic oligonucleotide
gccucagggagucaaccu

SEQ ID NO: 143563 - RNA, 18 nt, Artificial Sequence
  Description of Artificial Sequence: Synthetic oligonucleotide
guguggccucagggaguc

SEQ ID NO: 143564 - RNA, 18 nt, Artificial Sequence
  Description of Artificial Sequence: Synthetic oligonucleotide
cagcuguguggccucagg

SEQ ID NO: 143565 - RNA, 18 nt, Artificial Sequence
  Description of Artificial Sequence: Synthetic oligonucleotide
cuuaacagcuguguggcc

SEQ ID NO: 143566 - RNA, 18 nt, Artificial Sequence
  Description of Artificial Sequence: Synthetic oligonucleotide
agccacuuaacagcugug

SEQ ID NO: 143567 - RNA, 18 nt, Artificial Sequence
  Description of Artificial Sequence: Synthetic oligonucleotide
gccucagccacuuaacag

SEQ ID NO: 143568 - RNA, 18 nt, Artificial Sequence
  Description of Artificial Sequence: Synthetic oligonucleotide
cccucgccucagccacuu

SEQ ID NO: 143569 - RNA, 18 nt, Artificial Sequence
  Description of Artificial Sequence: Synthetic oligonucleotide
cacagcccucgccucagc

SEQ ID NO: 143570 - RNA, 18 nt, Artificial Sequence
  Description of Artificial Sequence: Synthetic oligonucleotide
agccccacagcccucgcc

SEQ ID NO: 143571 - RNA, 18 nt, Artificial Sequence
  Description of Artificial Sequence: Synthetic oligonucleotide
ggaacagccccacagccc

SEQ ID NO: 143572 - RNA, 18 nt, Artificial Sequence
  Description of Artificial Sequence: Synthetic oligonucleotide
gcgugggaacagccccac

SEQ ID NO: 143573 - RNA, 18 nt, Artificial Sequence
  Description of Artificial Sequence: Synthetic oligonucleotide
ccagggcgugggaacagc

SEQ ID NO: 143574 - RNA, 18 nt, Artificial Sequence
  Description of Artificial Sequence: Synthetic oligonucleotide
ggaagccagggcguggga

SEQ ID NO: 143575 - RNA, 18 nt, Artificial Sequence
  Description of Artificial Sequence: Synthetic oligonucleotide
ggccuggaagccagggcg

SEQ ID NO: 143576 - RNA, 18 nt, Artificial Sequence
  Description of Artificial Sequence: Synthetic oligonucleotide
ugccaggccuggaagcca

SEQ ID NO: 143577 - RNA, 18 nt, Artificial Sequence
  Description of Artificial Sequence: Synthetic oligonucleotide
caugcugccaggccugga

SEQ ID NO: 143578 - RNA, 18 nt, Artificial Sequence
  Description of Artificial Sequence: Synthetic oligonucleotide
cuccacaugcugccaggc

SEQ ID NO: 143579 - RNA, 18 nt, Artificial Sequence
  Description of Artificial Sequence: Synthetic oligonucleotide
ggcagcuccacaugcugc

SEQ ID NO: 143580 - RNA, 18 nt, Artificial Sequence
  Description of Artificial Sequence: Synthetic oligonucleotide
gaggagcuccgggagagg

SEQ ID NO: 143581 - RNA, 18 nt, Artificial Sequence
  Description of Artificial Sequence: Synthetic oligonucleotide
guggcgaggagcuccggg

SEQ ID NO: 143582 - RNA, 18 nt, Artificial Sequence
  Description of Artificial Sequence: Synthetic oligonucleotide
ugaggguggcgaggagcu

SEQ ID NO: 143583 - RNA, 18 nt, Artificial Sequence
  Description of Artificial Sequence: Synthetic oligonucleotide
agcagugaggguggcgag

SEQ ID NO: 143584 - RNA, 18 nt, Artificial Sequence
  Description of Artificial Sequence: Synthetic oligonucleotide
gguccagcagugagggug

SEQ ID NO: 143585 - RNA, 18 nt, Artificial Sequence
  Description of Artificial Sequence: Synthetic oligonucleotide
caguugguccagcaguga

SEQ ID NO: 143586 - RNA, 18 nt, Artificial Sequence
  Description of Artificial Sequence: Synthetic oligonucleotide
aucugcaguugguccagc

SEQ ID NO: 143587 - RNA, 18 nt, Artificial Sequence
  Description of Artificial Sequence: Synthetic oligonucleotide
agcccaucugcaguuggu

SEQ ID NO: 143588 - RNA, 18 nt, Artificial Sequence
  Description of Artificial Sequence: Synthetic oligonucleotide
gucacagcccaucugcag

SEQ ID NO: 143589 - RNA, 18 nt, Artificial Sequence
  Description of Artificial Sequence: Synthetic oligonucleotide
gccccgucacagcccauc

SEQ ID NO: 143590 - RNA, 18 nt, Artificial Sequence
  Description of Artificial Sequence: Synthetic oligonucleotide
augaggccccgucacagc

SEQ ID NO: 143591 - RNA, 18 nt, Artificial Sequence
  Description of Artificial Sequence: Synthetic oligonucleotide
gccgcaugaggccccguc

SEQ ID NO: 143592 - RNA, 18 nt, Artificial Sequence
  Description of Artificial Sequence: Synthetic oligonucleotide
aggcugccgcaugaggcc

SEQ ID NO: 143593 - RNA, 18 nt, Artificial Sequence
  Description of Artificial Sequence: Synthetic oligonucleotide
uguugaggcugccgcaug

SEQ ID NO: 143594 - RNA, 18 nt, Artificial Sequence
  Description of Artificial Sequence: Synthetic oligonucleotide
cuccauguugaggcugcc

SEQ ID NO: 143595 - RNA, 18 nt, Artificial Sequence
  Description of Artificial Sequence: Synthetic oligonucleotide
cggcacuccauguugagg

SEQ ID NO: 143596 - RNA, 18 nt, Artificial Sequence
  Description of Artificial Sequence: Synthetic oligonucleotide
acacccggcacuccaugu

SEQ ID NO: 143597 - RNA, 18 nt, Artificial Sequence
  Description of Artificial Sequence: Synthetic oligonucleotide
cccgcacacccggcacuc

SEQ ID NO: 143598 - RNA, 18 nt, Artificial Sequence
  Description of Artificial Sequence: Synthetic oligonucleotide
uuguccccgcacacccgg

SEQ ID NO: 143599 - RNA, 18 nt, Artificial Sequence
  Description of Artificial Sequence: Synthetic oligonucleotide
augccuuguccccgcaca

SEQ ID NO: 143600 - RNA, 18 nt, Artificial Sequence
  Description of Artificial Sequence: Synthetic oligonucleotide
gcccgaugccuugucccc

SEQ ID NO: 143601 - RNA, 18 nt, Artificial Sequence
  Description of Artificial Sequence: Synthetic oligonucleotide
uggaagcccgaugccuug

SEQ ID NO: 143602 - RNA, 18 nt, Artificial Sequence
  Description of Artificial Sequence: Synthetic oligonucleotide
cguaguggaagcccgaug

SEQ ID NO: 143603 - RNA, 18 nt, Artificial Sequence
  Description of Artificial Sequence: Synthetic oligonucleotide
aacaccguaguggaagcc

SEQ ID NO: 143604 - RNA, 18 nt, Artificial Sequence
  Description of Artificial Sequence: Synthetic oligonucleotide
gcaugaacaccguagugg

SEQ ID NO: 143605 - RNA, 18 nt, Artificial Sequence
  Description of Artificial Sequence: Synthetic oligonucleotide
cacaugcaugaacaccgu

SEQ ID NO: 143606 - RNA, 18 nt, Artificial Sequence
  Description of Artificial Sequence: Synthetic oligonucleotide
ccccucacaugcaugaac

SEQ ID NO: 143607 - RNA, 18 nt, Artificial Sequence
  Description of Artificial Sequence: Synthetic oligonucleotide
uugcaccccucacaugca

SEQ ID NO: 143608 - RNA, 18 nt, Artificial Sequence
  Description of Artificial Sequence: Synthetic oligonucleotide
ggcgaggagcuccgggag

SEQ ID NO: 143609 - RNA, 18 nt, Artificial Sequence
  Description of Artificial Sequence: Synthetic oligonucleotide
aggguggcgaggagcucc

SEQ ID NO: 143610 - RNA, 18 nt, Artificial Sequence
  Description of Artificial Sequence: Synthetic oligonucleotide
cagugaggguggcgagga

SEQ ID NO: 143611 - RNA, 18 nt, Artificial Sequence
  Description of Artificial Sequence: Synthetic oligonucleotide
uccagcagugaggguggc

SEQ ID NO: 143612 - RNA, 18 nt, Artificial Sequence
  Description of Artificial Sequence: Synthetic oligonucleotide
guugguccagcagugagg

SEQ ID NO: 143613 - RNA, 18 nt, Artificial Sequence
  Description of Artificial Sequence: Synthetic oligonucleotide
cugcaguugguccagcag

SEQ ID NO: 143614 - RNA, 18 nt, Artificial Sequence
  Description of Artificial Sequence: Synthetic oligonucleotide
cccaucugcaguuggucc

SEQ ID NO: 143615 - RNA, 18 nt, Artificial Sequence
  Description of Artificial Sequence: Synthetic oligonucleotide
cacagcccaucugcaguu

SEQ ID NO: 143616 - RNA, 18 nt, Artificial Sequence
  Description of Artificial Sequence: Synthetic oligonucleotide
cccgucacagcccaucug

SEQ ID NO: 143617 - RNA, 18 nt, Artificial Sequence
  Description of Artificial Sequence: Synthetic oligonucleotide
gaggccccgucacagccc

SEQ ID NO: 143618 - RNA, 18 nt, Artificial Sequence
  Description of Artificial Sequence: Synthetic oligonucleotide
cgcaugaggccccgucac

SEQ ID NO: 143619 - RNA, 18 nt, Artificial Sequence
  Description of Artificial Sequence: Synthetic oligonucleotide
gcugccgcaugaggcccc

SEQ ID NO: 143620 - RNA, 18 nt, Artificial Sequence
  Description of Artificial Sequence: Synthetic oligonucleotide
uugaggcugccgcaugag

SEQ ID NO: 143621 - RNA, 18 nt, Artificial Sequence
  Description of Artificial Sequence: Synthetic oligonucleotide
ccauguugaggcugccgc

SEQ ID NO: 143622 - RNA, 18 nt, Artificial Sequence
  Description of Artificial Sequence: Synthetic oligonucleotide
gcacuccauguugaggcu

SEQ ID NO: 143623 - RNA, 18 nt, Artificial Sequence
  Description of Artificial Sequence: Synthetic oligonucleotide
acccggcacuccauguug

SEQ ID NO: 143624 - RNA, 18 nt, Artificial Sequence
  Description of Artificial Sequence: Synthetic oligonucleotide
cgcacacccggcacucca

SEQ ID NO: 143625 - RNA, 18 nt, Artificial Sequence
  Description of Artificial Sequence: Synthetic oligonucleotide
guccccgcacacccggca

SEQ ID NO: 143626 - RNA, 18 nt, Artificial Sequence
  Description of Artificial Sequence: Synthetic oligonucleotide
gccuuguccccgcacacc

SEQ ID NO: 143627 - RNA, 18 nt, Artificial Sequence
  Description of Artificial Sequence: Synthetic oligonucleotide
ccgaugccuuguccccgc

SEQ ID NO: 143628 - RNA, 18 nt, Artificial Sequence
  Description of Artificial Sequence: Synthetic oligonucleotide
gaagcccgaugccuuguc

SEQ ID NO: 143629 - RNA, 18 nt, Artificial Sequence
  Description of Artificial Sequence: Synthetic oligonucleotide
uaguggaagcccgaugcc

SEQ ID NO: 143630 - RNA, 18 nt, Artificial Sequence
  Description of Artificial Sequence: Synthetic oligonucleotide
caccguaguggaagcccg

SEQ ID NO: 143631 - RNA, 18 nt, Artificial Sequence
  Description of Artificial Sequence: Synthetic oligonucleotide
augaacaccguaguggaa

SEQ ID NO: 143632 - RNA, 18 nt, Artificial Sequence
  Description of Artificial Sequence: Synthetic oligonucleotide
caugcaugaacaccguag

SEQ ID NO: 143633 - RNA, 18 nt, Artificial Sequence
  Description of Artificial Sequence: Synthetic oligonucleotide
ccucacaugcaugaacac

SEQ ID NO: 143634 - RNA, 18 nt, Artificial Sequence
  Description of Artificial Sequence: Synthetic oligonucleotide
gcaccccucacaugcaug

SEQ ID NO: 143635 - RNA, 18 nt, Artificial Sequence
  Description of Artificial Sequence: Synthetic oligonucleotide
ccaccgcuccccccaguc

SEQ ID NO: 143636 - RNA, 18 nt, Artificial Sequence
  Description of Artificial Sequence: Synthetic oligonucleotide
gccagccaccgcuccccc

SEQ ID NO: 143637 - RNA, 18 nt, Artificial Sequence
  Description of Artificial Sequence: Synthetic oligonucleotide
caguggccagccaccgcu

SEQ ID NO: 143638 - RNA, 18 nt, Artificial Sequence
  Description of Artificial Sequence: Synthetic oligonucleotide
agccucaguggccagcca

SEQ ID NO: 143639 - RNA, 18 nt, Artificial Sequence
  Description of Artificial Sequence: Synthetic oligonucleotide
accacagccucaguggcc

SEQ ID NO: 143640 - RNA, 18 nt, Artificial Sequence
  Description of Artificial Sequence: Synthetic oligonucleotide
augugaccacagccucag

SEQ ID NO: 143641 - RNA, 18 nt, Artificial Sequence
  Description of Artificial Sequence: Synthetic oligonucleotide
ucaccaugugaccacagc

SEQ ID NO: 143642 - RNA, 18 nt, Artificial Sequence
  Description of Artificial Sequence: Synthetic oligonucleotide
ucaauucaccaugugacc

SEQ ID NO: 143643 - RNA, 18 nt, Artificial Sequence
  Description of Artificial Sequence: Synthetic oligonucleotide
gagggucaauucaccaug

SEQ ID NO: 143644 - RNA, 18 nt, Artificial Sequence
  Description of Artificial Sequence: Synthetic oligonucleotide
uuguggagggucaauuca

SEQ ID NO: 143645 - RNA, 18 nt, Artificial Sequence
  Description of Artificial Sequence: Synthetic oligonucleotide
aagcuuuguggaggguca

SEQ ID NO: 143646 - RNA, 18 nt, Artificial Sequence
  Description of Artificial Sequence: Synthetic oligonucleotide
aaggaaagcuuuguggag

SEQ ID NO: 143647 - RNA, 18 nt, Artificial Sequence
  Description of Artificial Sequence: Synthetic oligonucleotide
aaggcaaggaaagcuuug

SEQ ID NO: 143648 - RNA, 18 nt, Artificial Sequence
  Description of Artificial Sequence: Synthetic oligonucleotide
accccaaggcaaggaaag

SEQ ID NO: 143649 - RNA, 18 nt, Artificial Sequence
  Description of Artificial Sequence: Synthetic oligonucleotide
gccccaccccaaggcaag

SEQ ID NO: 143650 - RNA, 18 nt, Artificial Sequence
  Description of Artificial Sequence: Synthetic oligonucleotide
ucagggccccaccccaag

SEQ ID NO: 143651 - RNA, 18 nt, Artificial Sequence
  Description of Artificial Sequence: Synthetic oligonucleotide
uacagucagggccccacc

SEQ ID NO: 143652 - RNA, 18 nt, Artificial Sequence
  Description of Artificial Sequence: Synthetic oligonucleotide
auagguacagucagggcc

SEQ ID NO: 143653 - RNA, 18 nt, Artificial Sequence
  Description of Artificial Sequence: Synthetic oligonucleotide
cugcaauagguacaguca

SEQ ID NO: 143654 - RNA, 18 nt, Artificial Sequence
  Description of Artificial Sequence: Synthetic oligonucleotide
gaauucugcaauagguac

SEQ ID NO: 143655 - RNA, 18 nt, Artificial Sequence
  Description of Artificial Sequence: Synthetic oligonucleotide
ggcaggaauucugcaaua

SEQ ID NO: 143656 - RNA, 18 nt, Artificial Sequence
  Description of Artificial Sequence: Synthetic oligonucleotide
uccugggcaggaauucug

SEQ ID NO: 143657 - RNA, 18 nt, Artificial Sequence
  Description of Artificial Sequence: Synthetic oligonucleotide
cugccuccugggcaggaa

SEQ ID NO: 143658 - RNA, 18 nt, Artificial Sequence
  Description of Artificial Sequence: Synthetic oligonucleotide
ccuggcugccuccugggc

SEQ ID NO: 143659 - RNA, 18 nt, Artificial Sequence
  Description of Artificial Sequence: Synthetic oligonucleotide
aagggccuggcugccucc

SEQ ID NO: 143660 - RNA, 18 nt, Artificial Sequence
  Description of Artificial Sequence: Synthetic oligonucleotide
agcacaagggccuggcug

SEQ ID NO: 143661 - RNA, 18 nt, Artificial Sequence
  Description of Artificial Sequence: Synthetic oligonucleotide
ucuggagcacaagggccu

SEQ ID NO: 143662 - RNA, 18 nt, Artificial Sequence
  Description of Artificial Sequence: Synthetic oligonucleotide
ugaggucuggagcacaag

SEQ ID NO: 143663 - RNA, 18 nt, Artificial Sequence
  Description of Artificial Sequence: Synthetic oligonucleotide
agagcugaggucuggagc

SEQ ID NO: 143664 - RNA, 18 nt, Artificial Sequence
  Description of Artificial Sequence: Synthetic oligonucleotide
ugcccagagcugaggucu

SEQ ID NO: 143665 - RNA, 18 nt, Artificial Sequence
  Description of Artificial Sequence: Synthetic oligonucleotide
ugcagugcccagagcuga

SEQ ID NO: 143666 - RNA, 18 nt, Artificial Sequence
  Description of Artificial Sequence: Synthetic oligonucleotide
ucuccugcagugcccaga

SEQ ID NO: 143667 - RNA, 18 nt, Artificial Sequence
  Description of Artificial Sequence: Synthetic oligonucleotide
ccucuucuccugcagugc

SEQ ID NO: 143668 - RNA, 18 nt, Artificial Sequence
  Description of Artificial Sequence: Synthetic oligonucleotide
aacccccucuucuccugc

SEQ ID NO: 143669 - RNA, 18 nt, Artificial Sequence
  Description of Artificial Sequence: Synthetic oligonucleotide
aagggaacccccucuucu

SEQ ID NO: 143670 - RNA, 18 nt, Artificial Sequence
  Description of Artificial Sequence: Synthetic oligonucleotide
uugacaagggaacccccu

SEQ ID NO: 143671 - RNA, 18 nt, Artificial Sequence
  Description of Artificial Sequence: Synthetic oligonucleotide
uaggcuugacaagggaac

SEQ ID NO: 143672 - RNA, 18 nt, Artificial Sequence
  Description of Artificial Sequence: Synthetic oligonucleotide
caggguaggcuugacaag

SEQ ID NO: 143673 - RNA, 18 nt, Artificial Sequence
  Description of Artificial Sequence: Synthetic oligonucleotide
cccagcaggguaggcuug

SEQ ID NO: 143674 - RNA, 18 nt, Artificial Sequence
  Description of Artificial Sequence: Synthetic oligonucleotide
aggugcccagcaggguag

SEQ ID NO: 143675 - RNA, 18 nt, Artificial Sequence
  Description of Artificial Sequence: Synthetic oligonucleotide
aacacaggugcccagcag

SEQ ID NO: 143676 - RNA, 18 nt, Artificial Sequence
  Description of Artificial Sequence: Synthetic oligonucleotide
gggucaacacaggugccc

SEQ ID NO: 143677 - RNA, 18 nt, Artificial Sequence
  Description of Artificial Sequence: Synthetic oligonucleotide
gagcugggucaacacagg

SEQ ID NO: 143678 - RNA, 18 nt, Artificial Sequence
  Description of Artificial Sequence: Synthetic oligonucleotide
ccacagagcugggucaac

SEQ ID NO: 143679 - RNA, 18 nt, Artificial Sequence
  Description of Artificial Sequence: Synthetic oligonucleotide
aucacccacagagcuggg

SEQ ID NO: 143680 - RNA, 18 nt, Artificial Sequence
  Description of Artificial Sequence: Synthetic oligonucleotide
acacaaucacccacagag

SEQ ID NO: 143681 - RNA, 18 nt, Artificial Sequence
  Description of Artificial Sequence: Synthetic oligonucleotide
gggacacaaucacccaca

SEQ ID NO: 143682 - RNA, 18 nt, Artificial Sequence
  Description of Artificial Sequence: Synthetic oligonucleotide
gcugccugguccccaggg

SEQ ID NO: 143683 - RNA, 18 nt, Artificial Sequence
  Description of Artificial Sequence: Synthetic oligonucleotide
cccuagcugccugguccc

SEQ ID NO: 143684 - RNA, 18 nt, Artificial Sequence
  Description of Artificial Sequence: Synthetic oligonucleotide
uucugcccuagcugccug

SEQ ID NO: 143685 - RNA, 18 nt, Artificial Sequence
  Description of Artificial Sequence: Synthetic oligonucleotide
ccucauucugcccuagcu

SEQ ID NO: 143686 - RNA, 18 nt, Artificial Sequence
  Description of Artificial Sequence: Synthetic oligonucleotide
aagacccucauucugccc

SEQ ID NO: 143687 - RNA, 18 nt, Artificial Sequence
  Description of Artificial Sequence: Synthetic oligonucleotide
agcccaagacccucauuc

SEQ ID NO: 143688 - RNA, 18 nt, Artificial Sequence
  Description of Artificial Sequence: Synthetic oligonucleotide
ggcucagcccaagacccu

SEQ ID NO: 143689 - RNA, 18 nt, Artificial Sequence
  Description of Artificial Sequence: Synthetic oligonucleotide
acgauggcucagcccaag

SEQ ID NO: 143690 - RNA, 18 nt, Artificial Sequence
  Description of Artificial Sequence: Synthetic oligonucleotide
guaagacgauggcucagc

SEQ ID NO: 143691 - RNA, 18 nt, Artificial Sequence
  Description of Artificial Sequence: Synthetic oligonucleotide
cucagguaagacgauggc

SEQ ID NO: 143692 - RNA, 18 nt, Artificial Sequence
  Description of Artificial Sequence: Synthetic oligonucleotide
cagaccucagguaagacg

SEQ ID NO: 143693 - RNA, 18 nt, Artificial Sequence
  Description of Artificial Sequence: Synthetic oligonucleotide
aaacccagaccucaggua

SEQ ID NO: 143694 - RNA, 18 nt, Artificial Sequence
  Description of Artificial Sequence: Synthetic oligonucleotide
acaagaaacccagaccuc

SEQ ID NO: 143695 - RNA, 18 nt, Artificial Sequence
  Description of Artificial Sequence: Synthetic oligonucleotide
gagaaacaagaaacccag

SEQ ID NO: 143696 - RNA, 18 nt, Artificial Sequence
  Description of Artificial Sequence: Synthetic oligonucleotide
gccuugagaaacaagaaa

SEQ ID NO: 143697 - RNA, 18 nt, Artificial Sequence
  Description of Artificial Sequence: Synthetic oligonucleotide
uuugagccuugagaaaca

SEQ ID NO: 143698 - RNA, 18 nt, Artificial Sequence
  Description of Artificial Sequence: Synthetic oligonucleotide
cccgcuuugagccuugag

SEQ ID NO: 143699 - RNA, 18 nt, Artificial Sequence
  Description of Artificial Sequence: Synthetic oligonucleotide
cagagcccgcuuugagcc

SEQ ID NO: 143700 - RNA, 18 nt, Artificial Sequence
  Description of Artificial Sequence: Synthetic oligonucleotide
uuucucagagcccgcuuu

SEQ ID NO: 143701 - RNA, 18 nt, Artificial Sequence
  Description of Artificial Sequence: Synthetic oligonucleotide
ccuuuuuucucagagccc

SEQ ID NO: 143702 - RNA, 18 nt, Artificial Sequence
  Description of Artificial Sequence: Synthetic oligonucleotide
ucuguccuuuuuucucag

SEQ ID NO: 143703 - RNA, 18 nt, Artificial Sequence
  Description of Artificial Sequence: Synthetic oligonucleotide
aaaugucuguccuuuuuu

SEQ ID NO: 143704 - RNA, 18 nt, Artificial Sequence
  Description of Artificial Sequence: Synthetic oligonucleotide
aaaacaaaugucuguccu

SEQ ID NO: 143705 - RNA, 18 nt, Artificial Sequence
  Description of Artificial Sequence: Synthetic oligonucleotide
cuggaaaaacaaaugucu

SEQ ID NO: 143706 - RNA, 18 nt, Artificial Sequence
  Description of Artificial Sequence: Synthetic oligonucleotide
uaucacuggaaaaacaaa

SEQ ID NO: 143707 - RNA, 18 nt, Artificial Sequence
  Description of Artificial Sequence: Synthetic oligonucleotide
acaaauaucacuggaaaa

SEQ ID NO: 143708 - RNA, 18 nt, Artificial Sequence
  Description of Artificial Sequence: Synthetic oligonucleotide
gacccacaaauaucacug

SEQ ID NO: 143709 - RNA, 18 nt, Artificial Sequence
  Description of Artificial Sequence: Synthetic oligonucleotide
ggaaggacccacaaauau

SEQ ID NO: 143710 - RNA, 18 nt, Artificial Sequence
  Description of Artificial Sequence: Synthetic oligonucleotide
aguuaggaaggacccaca

SEQ ID NO: 143711 - RNA, 18 nt, Artificial Sequence
  Description of Artificial Sequence: Synthetic oligonucleotide
ugugaaguuaggaaggac

SEQ ID NO: 143712 - RNA, 18 nt, Artificial Sequence
  Description of Artificial Sequence: Synthetic oligonucleotide
augggugugaaguuagga

SEQ ID NO: 143713 - RNA, 18 nt, Artificial Sequence
  Description of Artificial Sequence: Synthetic oligonucleotide
uuuugaugggugugaagu

SEQ ID NO: 143714 - RNA, 18 nt, Artificial Sequence
  Description of Artificial Sequence: Synthetic oligonucleotide
ugagauuuugaugggugu

SEQ ID NO: 143715 - RNA, 18 nt, Artificial Sequence
  Description of Artificial Sequence: Synthetic oligonucleotide
aucugugagauuuugaug

SEQ ID NO: 143716 - RNA, 18 nt, Artificial Sequence
  Description of Artificial Sequence: Synthetic oligonucleotide
aaauaaucugugagauuu

SEQ ID NO: 143717 - RNA, 18 nt, Artificial Sequence
  Description of Artificial Sequence: Synthetic oligonucleotide
caauaaaauaaucuguga

SEQ ID NO: 143718 - RNA, 18 nt, Artificial Sequence
  Description of Artificial Sequence: Synthetic oligonucleotide
ugauucaauaaaauaauc

SEQ ID NO: 143719 - RNA, 18 nt, Artificial Sequence
  Description of Artificial Sequence: Synthetic oligonucleotide
gguggugauucaauaaaa

SEQ ID NO: 143720 - RNA, 18 nt, Artificial Sequence
  Description of Artificial Sequence: Synthetic oligonucleotide
ugugagguggugauucaa

SEQ ID NO: 143721 - RNA, 18 nt, Artificial Sequence
  Description of Artificial Sequence: Synthetic oligonucleotide
guauuugugaggugguga

SEQ ID NO: 143722 - RNA, 18 nt, Artificial Sequence
  Description of Artificial Sequence: Synthetic oligonucleotide
ucuguguauuugugaggu

SEQ ID NO: 143723 - RNA, 18 nt, Artificial Sequence
  Description of Artificial Sequence: Synthetic oligonucleotide
cugguucuguguauuugu

SEQ ID NO: 143724 - RNA, 18 nt, Artificial Sequence
  Description of Artificial Sequence: Synthetic oligonucleotide
uguaucugguucugugua

SEQ ID NO: 143725 - RNA, 18 nt, Artificial Sequence
  Description of Artificial Sequence: Synthetic oligonucleotide
auaaauguaucugguucu

SEQ ID NO: 143726 - RNA, 18 nt, Artificial Sequence
  Description of Artificial Sequence: Synthetic oligonucleotide
ucuucauaaauguaucug

SEQ ID NO: 143727 - RNA, 18 nt, Artificial Sequence
  Description of Artificial Sequence: Synthetic oligonucleotide
ugauuucuucauaaaugu

SEQ ID NO: 143728 - RNA, 18 nt, Artificial Sequence
  Description of Artificial Sequence: Synthetic oligonucleotide
uaacuugauuucuucaua

SEQ ID NO: 143729 - RNA, 18 nt, Artificial Sequence
  Description of Artificial Sequence: Synthetic oligonucleotide
acggcuaacuugauuucu

SEQ ID NO: 143730 - RNA, 18 nt, Artificial Sequence
  Description of Artificial Sequence: Synthetic oligonucleotide
gucucacggcuaacuuga

SEQ ID NO: 143731 - RNA, 18 nt, Artificial Sequence
  Description of Artificial Sequence: Synthetic oligonucleotide
agauugucucacggcuaa

SEQ ID NO: 143732 - RNA, 18 nt, Artificial Sequence
  Description of Artificial Sequence: Synthetic oligonucleotide
aacaaaaaaaaaacacaa

SEQ ID NO: 143733 - RNA, 18 nt, Artificial Sequence
  Description of Artificial Sequence: Synthetic oligonucleotide
aacaaaacaaaaaaaaaa

SEQ ID NO: 143734 - RNA, 18 nt, Artificial Sequence
  Description of Artificial Sequence: Synthetic oligonucleotide
aacaaaacaaaacaaaaa

SEQ ID NO: 143735 - RNA, 18 nt, Artificial Sequence
  Description of Artificial Sequence: Synthetic oligonucleotide
aauaaaacaaaacaaaac

SEQ ID NO: 143736 - RNA, 18 nt, Artificial Sequence
  Description of Artificial Sequence: Synthetic oligonucleotide
aacaaaauaaaacaaaac

SEQ ID NO: 143737 - RNA, 18 nt, Artificial Sequence
  Description of Artificial Sequence: Synthetic oligonucleotide
aacaaaacaaaauaaaac

SEQ ID NO: 143738 - RNA, 18 nt, Artificial Sequence
  Description of Artificial Sequence: Synthetic oligonucleotide
aacaaaacaaaacaaaau

SEQ ID NO: 143739 - RNA, 18 nt, Artificial Sequence
  Description of Artificial Sequence: Synthetic oligonucleotide
cucaaaacaaaacaaaac

SEQ ID NO: 143740 - RNA, 18 nt, Artificial Sequence
  Description of Artificial Sequence: Synthetic oligonucleotide
uccaucucaaaacaaaac

SEQ ID NO: 143741 - RNA, 18 nt, Artificial Sequence
  Description of Artificial Sequence: Synthetic oligonucleotide
gaaacuccaucucaaaac

SEQ ID NO: 143742 - RNA, 18 nt, Artificial Sequence
  Description of Artificial Sequence: Synthetic oligonucleotide
agagugaaacuccaucuc

SEQ ID NO: 143743 - RNA, 18 nt, Artificial Sequence
  Description of Artificial Sequence: Synthetic oligonucleotide
caacaagagugaaacucc

SEQ ID NO: 143744 - RNA, 18 nt, Artificial Sequence
  Description of Artificial Sequence: Synthetic oligonucleotide
cuggacaacaagagugaa

SEQ ID NO: 143745 - RNA, 18 nt, Artificial Sequence
  Description of Artificial Sequence: Synthetic oligonucleotide
ccagccuggacaacaaga

SEQ ID NO: 143746 - RNA, 18 nt, Artificial Sequence
  Description of Artificial Sequence: Synthetic oligonucleotide
acacuccagccuggacaa

SEQ ID NO: 143747 - RNA, 18 nt, Artificial Sequence
  Description of Artificial Sequence: Synthetic oligonucleotide
ccauuacacuccagccug

SEQ ID NO: 143748 - RNA, 18 nt, Artificial Sequence
  Description of Artificial Sequence: Synthetic oligonucleotide
ucgcgccauuacacucca

SEQ ID NO: 143749 - RNA, 18 nt, Artificial Sequence
  Description of Artificial Sequence: Synthetic oligonucleotide
caagaucgcgccauuaca

SEQ ID NO: 143750 - RNA, 18 nt, Artificial Sequence
  Description of Artificial Sequence: Synthetic oligonucleotide
ucagccaagaucgcgcca

SEQ ID NO: 143751 - RNA, 18 nt, Artificial Sequence
  Description of Artificial Sequence: Synthetic oligonucleotide
ugcagucagccaagaucg

SEQ ID NO: 143752 - RNA, 18 nt, Artificial Sequence
  Description of Artificial Sequence: Synthetic oligonucleotide
gagguugcagucagccaa

SEQ ID NO: 143753 - RNA, 18 nt, Artificial Sequence
  Description of Artificial Sequence: Synthetic oligonucleotide
agguggagguugcaguca

SEQ ID NO: 143754 - RNA, 18 nt, Artificial Sequence
  Description of Artificial Sequence: Synthetic oligonucleotide
ccgggagguggagguugc

SEQ ID NO: 143755 - RNA, 18 nt, Artificial Sequence
  Description of Artificial Sequence: Synthetic oligonucleotide
ugaacccgggagguggag

SEQ ID NO: 143756 - RNA, 18 nt, Artificial Sequence
  Description of Artificial Sequence: Synthetic oligonucleotide
ucgcuugaacccgggagg

SEQ ID NO: 143757 - RNA, 18 nt, Artificial Sequence
  Description of Artificial Sequence: Synthetic oligonucleotide
gggaaucgcuugaacccg

SEQ ID NO: 143758 - RNA, 18 nt, Artificial Sequence
  Description of Artificial Sequence: Synthetic oligonucleotide
caggaggcugaggcaggg

SEQ ID NO: 143759 - RNA, 18 nt, Artificial Sequence
  Description of Artificial Sequence: Synthetic oligonucleotide
ucaggaggcugaggcagg

SEQ ID NO: 143760 - RNA, 18 nt, Artificial Sequence
  Description of Artificial Sequence: Synthetic oligonucleotide
gcuacucaggaggcugag

SEQ ID NO: 143761 - RNA, 18 nt, Artificial Sequence
  Description of Artificial Sequence: Synthetic oligonucleotide
ucccagcuacucaggagg

SEQ ID NO: 143762 - RNA, 18 nt, Artificial Sequence
  Description of Artificial Sequence: Synthetic oligonucleotide
uguaaucccagcuacuca

SEQ ID NO: 143763 - RNA, 18 nt, Artificial Sequence
  Description of Artificial Sequence: Synthetic oligonucleotide
accccuguaaucccagcu

SEQ ID NO: 143764 - RNA, 18 nt, Artificial Sequence
  Description of Artificial Sequence: Synthetic oligonucleotide
ggcacaccccuguaaucc

SEQ ID NO: 143765 - RNA, 18 nt, Artificial Sequence
  Description of Artificial Sequence: Synthetic oligonucleotide
guaguggcacaccccugu

SEQ ID NO: 143766 - RNA, 18 nt, Artificial Sequence
  Description of Artificial Sequence: Synthetic oligonucleotide
uggguguaguggcacacc

SEQ ID NO: 143767 - RNA, 18 nt, Artificial Sequence
  Description of Artificial Sequence: Synthetic oligonucleotide
uuagcuggguguaguggc

SEQ ID NO: 143768 - RNA, 18 nt, Artificial Sequence
  Description of Artificial Sequence: Synthetic oligonucleotide
aaaaauuagcugggugua

SEQ ID NO: 143769 - RNA, 18 nt, Artificial Sequence
  Description of Artificial Sequence: Synthetic oligonucleotide
uacagaaaaauuagcugg

SEQ ID NO: 143770 - RNA, 18 nt, Artificial Sequence
  Description of Artificial Sequence: Synthetic oligonucleotide
aaaaauacagaaaaauua

SEQ ID NO: 143771 - RNA, 18 nt, Artificial Sequence
  Description of Artificial Sequence: Synthetic oligonucleotide
cuacuaaaaauacagaaa

SEQ ID NO: 143772 - RNA, 18 nt, Artificial Sequence
  Description of Artificial Sequence: Synthetic oligonucleotide
cgucucuacuaaaaauac

SEQ ID NO: 143773 - RNA, 18 nt, Artificial Sequence
  Description of Artificial Sequence: Synthetic oligonucleotide
aaccccgucucuacuaaa

SEQ ID NO: 143774 - RNA, 18 nt, Artificial Sequence
  Description of Artificial Sequence: Synthetic oligonucleotide
ggugaaaccccgucucua

SEQ ID NO: 143775 - RNA, 18 nt, Artificial Sequence
  Description of Artificial Sequence: Synthetic oligonucleotide
aacauggugaaaccccgu

SEQ ID NO: 143776 - RNA, 18 nt, Artificial Sequence
  Description of Artificial Sequence: Synthetic oligonucleotide
uggccaacauggugaaac

SEQ ID NO: 143777 - RNA, 18 nt, Artificial Sequence
  Description of Artificial Sequence: Synthetic oligonucleotide
cagccuggccaacauggu

SEQ ID NO: 143778 - RNA, 18 nt, Artificial Sequence
  Description of Artificial Sequence: Synthetic oligonucleotide
gagaccagccuggccaac

SEQ ID NO: 143779 - RNA, 18 nt, Artificial Sequence
  Description of Artificial Sequence: Synthetic oligonucleotide
aguuugagaccagccugg

SEQ ID NO: 143780 - RNA, 18 nt, Artificial Sequence
  Description of Artificial Sequence: Synthetic oligonucleotide
ucaggaguuugagaccag

SEQ ID NO: 143781 - RNA, 18 nt, Artificial Sequence
  Description of Artificial Sequence: Synthetic oligonucleotide
ugaggucaggaguuugag

SEQ ID NO: 143782 - RNA, 18 nt, Artificial Sequence
  Description of Artificial Sequence: Synthetic oligonucleotide
ucaccugaggucaggagu

SEQ ID NO: 143783 - RNA, 18 nt, Artificial Sequence
  Description of Artificial Sequence: Synthetic oligonucleotide
gcggaucaccugagguca

SEQ ID NO: 143784 - RNA, 18 nt, Artificial Sequence
  Description of Artificial Sequence: Synthetic oligonucleotide
ggugggcggaucaccuga

SEQ ID NO: 143785 - RNA, 18 nt, Artificial Sequence
  Description of Artificial Sequence: Synthetic oligonucleotide
gccgaggugggcggauca

SEQ ID NO: 143786 - RNA, 18 nt, Artificial Sequence
  Description of Artificial Sequence: Synthetic oligonucleotide
gagaggccgaggugggcg

SEQ ID NO: 143787 - RNA, 18 nt, Artificial Sequence
  Description of Artificial Sequence: Synthetic oligonucleotide
acuuugagaggccgaggu

SEQ ID NO: 143788 - RNA, 18 nt, Artificial Sequence
  Description of Artificial Sequence: Synthetic oligonucleotide
ccagcacuuugagaggcc

SEQ ID NO: 143789 - RNA, 18 nt, Artificial Sequence
  Description of Artificial Sequence: Synthetic oligonucleotide
uaaucccagcacuuugag

SEQ ID NO: 143790 - RNA, 18 nt, Artificial Sequence
  Description of Artificial Sequence: Synthetic oligonucleotide
gccuguaaucccagcacu

SEQ ID NO: 143791 - RNA, 18 nt, Artificial Sequence
  Description of Artificial Sequence: Synthetic oligonucleotide
cucacgccuguaauccca

SEQ ID NO: 143792 - RNA, 18 nt, Artificial Sequence
  Description of Artificial Sequence: Synthetic oligonucleotide
aguggcucacgccuguaa

SEQ ID NO: 143793 - RNA, 18 nt, Artificial Sequence
  Description of Artificial Sequence: Synthetic oligonucleotide
ggcacaguggcucacgcc

SEQ ID NO: 143794 - RNA, 18 nt, Artificial Sequence
  Description of Artificial Sequence: Synthetic oligonucleotide
guucaggcacaguggcuc

SEQ ID NO: 143795 - RNA, 18 nt, Artificial Sequence
  Description of Artificial Sequence: Synthetic oligonucleotide
uuuuaguucaggcacagu

SEQ ID NO: 143796 - RNA, 18 nt, Artificial Sequence
  Description of Artificial Sequence: Synthetic oligonucleotide
aacuauuuuaguucaggc

SEQ ID NO: 143797 - RNA, 18 nt, Artificial Sequence
  Description of Artificial Sequence: Synthetic oligonucleotide
auuaaaacuauuuuaguu

SEQ ID NO: 143798 - RNA, 18 nt, Artificial Sequence
  Description of Artificial Sequence: Synthetic oligonucleotide
cuuuaauuaaaacuauuu

SEQ ID NO: 143799 - RNA, 18 nt, Artificial Sequence
  Description of Artificial Sequence: Synthetic oligonucleotide
uaaaacuuuaauuaaaac

SEQ ID NO: 143800 - RNA, 18 nt, Artificial Sequence
  Description of Artificial Sequence: Synthetic oligonucleotide
aauucuaaaacuuuaauu

SEQ ID NO: 143801 - RNA, 18 nt, Artificial Sequence
  Description of Artificial Sequence: Synthetic oligonucleotide
aaaguaauucuaaaacuu

SEQ ID NO: 143802 - RNA, 18 nt, Artificial Sequence
  Description of Artificial Sequence: Synthetic oligonucleotide
gaaggaaaguaauucuaa

SEQ ID NO: 143803 - RNA, 18 nt, Artificial Sequence
  Description of Artificial Sequence: Synthetic oligonucleotide
auggagaaggaaaguaau

SEQ ID NO: 143804 - RNA, 18 nt, Artificial Sequence
  Description of Artificial Sequence: Synthetic oligonucleotide
gggagauggagaaggaaa

SEQ ID NO: 143805 - RNA, 18 nt, Artificial Sequence
  Description of Artificial Sequence: Synthetic oligonucleotide
agaaauuuuuuuggaggg

SEQ ID NO: 143806 - RNA, 18 nt, Artificial Sequence
  Description of Artificial Sequence: Synthetic oligonucleotide
gagaagaaauuuuuuugg

SEQ ID NO: 143807 - RNA, 18 nt, Artificial Sequence
  Description of Artificial Sequence: Synthetic oligonucleotide
guaacgagaagaaauuuu

SEQ ID NO: 143808 - RNA, 18 nt, Artificial Sequence
  Description of Artificial Sequence: Synthetic oligonucleotide
uggaaguaacgagaagaa

SEQ ID NO: 143809 - RNA, 18 nt, Artificial Sequence
  Description of Artificial Sequence: Synthetic oligonucleotide
acauuuggaaguaacgag

SEQ ID NO: 143810 - RNA, 18 nt, Artificial Sequence
  Description of Artificial Sequence: Synthetic oligonucleotide
uccugacauuuggaagua

SEQ ID NO: 143811 - RNA, 18 nt, Artificial Sequence
  Description of Artificial Sequence: Synthetic oligonucleotide
aacacuccugacauuugg

SEQ ID NO: 143812 - RNA, 18 nt, Artificial Sequence
  Description of Artificial Sequence: Synthetic oligonucleotide
guguaaacacuccugaca

SEQ ID NO: 143813 - RNA, 18 nt, Artificial Sequence
  Description of Artificial Sequence: Synthetic oligonucleotide
auaagguguaaacacucc

SEQ ID NO: 143814 - RNA, 18 nt, Artificial Sequence
  Description of Artificial Sequence: Synthetic oligonucleotide
uauguauaagguguaaac

SEQ ID NO: 143815 - RNA, 18 nt, Artificial Sequence
  Description of Artificial Sequence: Synthetic oligonucleotide
ccgauuauguauaaggug

SEQ ID NO: 143816 - RNA, 18 nt, Artificial Sequence
  Description of Artificial Sequence: Synthetic oligonucleotide
agggcccgauuauguaua

SEQ ID NO: 143817 - RNA, 18 nt, Artificial Sequence
  Description of Artificial Sequence: Synthetic oligonucleotide
gccaaagggcccgauuau

SEQ ID NO: 143818 - RNA, 18 nt, Artificial Sequence
  Description of Artificial Sequence: Synthetic oligonucleotide
gcugugccaaagggcccg

SEQ ID NO: 143819 - RNA, 18 nt, Artificial Sequence
  Description of Artificial Sequence: Synthetic oligonucleotide
gggaggcugugccaaagg

SEQ ID NO: 143820 - RNA, 18 nt, Artificial Sequence
  Description of Artificial Sequence: Synthetic oligonucleotide
ugggagggaggcugugcc

SEQ ID NO: 143821 - RNA, 18 nt, Artificial Sequence
  Description of Artificial Sequence: Synthetic oligonucleotide
ggaggugggagggaggcu

SEQ ID NO: 143822 - RNA, 18 nt, Artificial Sequence
  Description of Artificial Sequence: Synthetic oligonucleotide
caccaggaggugggaggg

SEQ ID NO: 143823 - RNA, 18 nt, Artificial Sequence
  Description of Artificial Sequence: Synthetic oligonucleotide
aaggccaccaggaggugg

SEQ ID NO: 143824 - RNA, 18 nt, Artificial Sequence
  Description of Artificial Sequence: Synthetic oligonucleotide
gaggaaaggccaccagga

SEQ ID NO: 143825 - RNA, 18 nt, Artificial Sequence
  Description of Artificial Sequence: Synthetic oligonucleotide
caggugaggaaaggccac

SEQ ID NO: 143826 - RNA, 18 nt, Artificial Sequence
  Description of Artificial Sequence: Synthetic oligonucleotide
ucguacgacggaagaagc

SEQ ID NO: 143827 - RNA, 18 nt, Artificial Sequence
  Description of Artificial Sequence: Synthetic oligonucleotide
gcggaucguacgacggaa

SEQ ID NO: 143828 - RNA, 18 nt, Artificial Sequence
  Description of Artificial Sequence: Synthetic oligonucleotide
uucaugcggaucguacga

SEQ ID NO: 143829 - RNA, 18 nt, Artificial Sequence
  Description of Artificial Sequence: Synthetic oligonucleotide
ccagcuucaugcggaucg

SEQ ID NO: 143830 - RNA, 18 nt, Artificial Sequence
  Description of Artificial Sequence: Synthetic oligonucleotide
guacuccagcuucaugcg

SEQ ID NO: 143831 - RNA, 18 nt, Artificial Sequence
  Description of Artificial Sequence: Synthetic oligonucleotide
uucucguacuccagcuuc

SEQ ID NO: 143832 - RNA, 18 nt, Artificial Sequence
  Description of Artificial Sequence: Synthetic oligonucleotide
cacacuucucguacucca

SEQ ID NO: 143833 - RNA, 18 nt, Artificial Sequence
  Description of Artificial Sequence: Synthetic oligonucleotide
gcgcucacacuucucgua

SEQ ID NO: 143834 - RNA, 18 nt, Artificial Sequence
  Description of Artificial Sequence: Synthetic oligonucleotide
cagcugcgcucacacuuc

SEQ ID NO: 143835 - RNA, 18 nt, Artificial Sequence
  Description of Artificial Sequence: Synthetic oligonucleotide
ucuugcagcugcgcucac

SEQ ID NO: 143836 - RNA, 18 nt, Artificial Sequence
  Description of Artificial Sequence: Synthetic oligonucleotide
cugaaucuugcagcugcg

SEQ ID NO: 143837 - RNA, 18 nt, Artificial Sequence
  Description of Artificial Sequence: Synthetic oligonucleotide
uucuucugaaucuugcag

SEQ ID NO: 143838 - RNA, 18 nt, Artificial Sequence
  Description of Artificial Sequence: Synthetic oligonucleotide
gguucuucuucugaaucu

SEQ ID NO: 143839 - RNA, 18 nt, Artificial Sequence
  Description of Artificial Sequence: Synthetic oligonucleotide
guugcgguucuucuucug

SEQ ID NO: 143840 - RNA, 18 nt, Artificial Sequence
  Description of Artificial Sequence: Synthetic oligonucleotide
cacuuguugcgguucuuc

SEQ ID NO: 143841 - RNA, 18 nt, Artificial Sequence
  Description of Artificial Sequence: Synthetic oligonucleotide
acuggcacuuguugcggu

SEQ ID NO: 143842 - RNA, 18 nt, Artificial Sequence
  Description of Artificial Sequence: Synthetic oligonucleotide
gcaguacuggcacuuguu

SEQ ID NO: 143843 - RNA, 18 nt, Artificial Sequence
  Description of Artificial Sequence: Synthetic oligonucleotide
aagcggcaguacuggcac

SEQ ID NO: 143844 - RNA, 18 nt, Artificial Sequence
  Description of Artificial Sequence: Synthetic oligonucleotide
ucuggaagcggcaguacu

SEQ ID NO: 143845 - RNA, 18 nt, Artificial Sequence
  Description of Artificial Sequence: Synthetic oligonucleotide
gcacuucuggaagcggca

SEQ ID NO: 143846 - RNA, 18 nt, Artificial Sequence
  Description of Artificial Sequence: Synthetic oligonucleotide
gccaggcacuucuggaag

SEQ ID NO: 143847 - RNA, 18 nt, Artificial Sequence
  Description of Artificial Sequence: Synthetic oligonucleotide
ccagugccaggcacuucu

SEQ ID NO: 143848 - RNA, 18 nt, Artificial Sequence
  Description of Artificial Sequence: Synthetic oligonucleotide
caugcccagugccaggca

SEQ ID NO: 143849 - RNA, 18 nt, Artificial Sequence
  Description of Artificial Sequence: Synthetic oligonucleotide
ugugacaugcccagugcc

SEQ ID NO: 143850 - RNA, 18 nt, Artificial Sequence
  Description of Artificial Sequence: Synthetic oligonucleotide
cguugugugacaugccca

SEQ ID NO: 143851 - RNA, 18 nt, Artificial Sequence
  Description of Artificial Sequence: Synthetic oligonucleotide
gaucguacgacggaagaa

SEQ ID NO: 143852 - RNA, 18 nt, Artificial Sequence
  Description of Artificial Sequence: Synthetic oligonucleotide
augcggaucguacgacgg

SEQ ID NO: 143853 - RNA, 18 nt, Artificial Sequence
  Description of Artificial Sequence: Synthetic oligonucleotide
gcuucaugcggaucguac

SEQ ID NO: 143854 - RNA, 18 nt, Artificial Sequence
  Description of Artificial Sequence: Synthetic oligonucleotide
cuccagcuucaugcggau

SEQ ID NO: 143855 - RNA, 18 nt, Artificial Sequence
  Description of Artificial Sequence: Synthetic oligonucleotide
ucguacuccagcuucaug

SEQ ID NO: 143856 - RNA, 18 nt, Artificial Sequence
  Description of Artificial Sequence: Synthetic oligonucleotide
acuucucguacuccagcu

SEQ ID NO: 143857 - RNA, 18 nt, Artificial Sequence
  Description of Artificial Sequence: Synthetic oligonucleotide
cucacacuucucguacuc

SEQ ID NO: 143858 - RNA, 18 nt, Artificial Sequence
  Description of Artificial Sequence: Synthetic oligonucleotide
cugcgcucacacuucucg

SEQ ID NO: 143859 - RNA, 18 nt, Artificial Sequence
  Description of Artificial Sequence: Synthetic oligonucleotide
ugcagcugcgcucacacu

SEQ ID NO: 143860 - RNA, 18 nt, Artificial Sequence
  Description of Artificial Sequence: Synthetic oligonucleotide
aaucuugcagcugcgcuc

SEQ ID NO: 143861 - RNA, 18 nt, Artificial Sequence
  Description of Artificial Sequence: Synthetic oligonucleotide
uucugaaucuugcagcug

SEQ ID NO: 143862 - RNA, 18 nt, Artificial Sequence
  Description of Artificial Sequence: Synthetic oligonucleotide
ucuucuucugaaucuugc

SEQ ID NO: 143863 - RNA, 18 nt, Artificial Sequence
  Description of Artificial Sequence: Synthetic oligonucleotide
gcgguucuucuucugaau

SEQ ID NO: 143864 - RNA, 18 nt, Artificial Sequence
  Description of Artificial Sequence: Synthetic oligonucleotide
uuguugcgguucuucuuc

SEQ ID NO: 143865 - RNA, 18 nt, Artificial Sequence
  Description of Artificial Sequence: Synthetic oligonucleotide
ggcacuuguugcgguucu

SEQ ID NO: 143866 - RNA, 18 nt, Artificial Sequence
  Description of Artificial Sequence: Synthetic oligonucleotide
guacuggcacuuguugcg

SEQ ID NO: 143867 - RNA, 18 nt, Artificial Sequence
  Description of Artificial Sequence: Synthetic oligonucleotide
cggcaguacuggcacuug

SEQ ID NO: 143868 - RNA, 18 nt, Artificial Sequence
  Description of Artificial Sequence: Synthetic oligonucleotide
ggaagcggcaguacuggc

SEQ ID NO: 143869 - RNA, 18 nt, Artificial Sequence
  Description of Artificial Sequence: Synthetic oligonucleotide
cuucuggaagcggcagua

SEQ ID NO: 143870 - RNA, 18 nt, Artificial Sequence
  Description of Artificial Sequence: Synthetic oligonucleotide
aggcacuucuggaagcgg

SEQ ID NO: 143871 - RNA, 18 nt, Artificial Sequence
  Description of Artificial Sequence: Synthetic oligonucleotide
gugccaggcacuucugga

SEQ ID NO: 143872 - RNA, 18 nt, Artificial Sequence
  Description of Artificial Sequence: Synthetic oligonucleotide
gcccagugccaggcacuu

SEQ ID NO: 143873 - RNA, 18 nt, Artificial Sequence
  Description of Artificial Sequence: Synthetic oligonucleotide
gacaugcccagugccagg

SEQ ID NO: 143874 - RNA, 18 nt, Artificial Sequence
  Description of Artificial Sequence: Synthetic oligonucleotide
ugugugacaugcccagug

SEQ ID NO: 143875 - RNA, 18 nt, Artificial Sequence
  Description of Artificial Sequence: Synthetic oligonucleotide
gaguugcccuggucagcu

SEQ ID NO: 143876 - RNA, 18 nt, Artificial Sequence
  Description of Artificial Sequence: Synthetic oligonucleotide
cccgugaguugcccuggu

SEQ ID NO: 143877 - RNA, 18 nt, Artificial Sequence
  Description of Artificial Sequence: Synthetic oligonucleotide
agcagcccgugaguugcc

SEQ ID NO: 143878 - RNA, 18 nt, Artificial Sequence
  Description of Artificial Sequence: Synthetic oligonucleotide
gagccagcagcccgugag

SEQ ID NO: 143879 - RNA, 18 nt, Artificial Sequence
  Description of Artificial Sequence: Synthetic oligonucleotide
guguggagccagcagccc

SEQ ID NO: 143880 - RNA, 18 nt, Artificial Sequence
  Description of Artificial Sequence: Synthetic oligonucleotide
aggcuguguggagccagc

SEQ ID NO: 143881 - RNA, 18 nt, Artificial Sequence
  Description of Artificial Sequence: Synthetic oligonucleotide
guuucaggcuguguggag

SEQ ID NO: 143882 - RNA, 18 nt, Artificial Sequence
  Description of Artificial Sequence: Synthetic oligonucleotide
ccuugguuucaggcugug

SEQ ID NO: 143883 - RNA, 18 nt, Artificial Sequence
  Description of Artificial Sequence: Synthetic oligonucleotide
cuggaccuugguuucagg

SEQ ID NO: 143884 - RNA, 18 nt, Artificial Sequence
  Description of Artificial Sequence: Synthetic oligonucleotide
gcucccuggaccuugguu

SEQ ID NO: 143885 - RNA, 18 nt, Artificial Sequence
  Description of Artificial Sequence: Synthetic oligonucleotide
caagggcucccuggaccu

SEQ ID NO: 143886 - RNA, 18 nt, Artificial Sequence
  Description of Artificial Sequence: Synthetic oligonucleotide
ugccccaagggcucccug

SEQ ID NO: 143887 - RNA, 18 nt, Artificial Sequence
  Description of Artificial Sequence: Synthetic oligonucleotide
uaggcugccccaagggcu

SEQ ID NO: 143888 - RNA, 18 nt, Artificial Sequence
  Description of Artificial Sequence: Synthetic oligonucleotide
cccucuaggcugccccaa

SEQ ID NO: 143889 - RNA, 18 nt, Artificial Sequence
  Description of Artificial Sequence: Synthetic oligonucleotide
gugcccccucuaggcugc

SEQ ID NO: 143890 - RNA, 18 nt, Artificial Sequence
  Description of Artificial Sequence: Synthetic oligonucleotide
uacaggugcccccucuag

SEQ ID NO: 143891 - RNA, 18 nt, Artificial Sequence
  Description of Artificial Sequence: Synthetic oligonucleotide
ugcucuacaggugccccc

SEQ ID NO: 143892 - RNA, 18 nt, Artificial Sequence
  Description of Artificial Sequence: Synthetic oligonucleotide
ggcacugcucuacaggug

SEQ ID NO: 143893 - RNA, 18 nt, Artificial Sequence
  Description of Artificial Sequence: Synthetic oligonucleotide
cgccaggcacugcucuac

SEQ ID NO: 143894 - RNA, 18 nt, Artificial Sequence
  Description of Artificial Sequence: Synthetic oligonucleotide
cugugcgccaggcacugc

SEQ ID NO: 143895 - RNA, 18 nt, Artificial Sequence
  Description of Artificial Sequence: Synthetic oligonucleotide
gcuuacugugcgccaggc

SEQ ID NO: 143896 - RNA, 18 nt, Artificial Sequence
  Description of Artificial Sequence: Synthetic oligonucleotide
auggugcuuacugugcgc

SEQ ID NO: 143897 - RNA, 18 nt, Artificial Sequence
  Description of Artificial Sequence: Synthetic oligonucleotide
cagccauggugcuuacug

SEQ ID NO: 143898 - RNA, 18 nt, Artificial Sequence
  Description of Artificial Sequence: Synthetic oligonucleotide
gccaacagccauggugcu

SEQ ID NO: 143899 - RNA, 18 nt, Artificial Sequence
  Description of Artificial Sequence: Synthetic oligonucleotide
caacagccaacagccaug

SEQ ID NO: 143900 - RNA, 18 nt, Artificial Sequence
  Description of Artificial Sequence: Synthetic oligonucleotide
aaagccaacagccaacag

SEQ ID NO: 143901 - RNA, 18 nt, Artificial Sequence
  Description of Artificial Sequence: Synthetic oligonucleotide
ucagcaaagccaacagcc

SEQ ID NO: 143902 - RNA, 18 nt, Artificial Sequence
  Description of Artificial Sequence: Synthetic oligonucleotide
ccagaucagcaaagccaa

SEQ ID NO: 143903 - RNA, 18 nt, Artificial Sequence
  Description of Artificial Sequence: Synthetic oligonucleotide
aagguccagaucagcaaa

SEQ ID NO: 143904 - RNA, 18 nt, Artificial Sequence
  Description of Artificial Sequence: Synthetic oligonucleotide
gauccaagguccagauca

SEQ ID NO: 143905 - RNA, 18 nt, Artificial Sequence
  Description of Artificial Sequence: Synthetic oligonucleotide
ucuaagauccaaggucca

SEQ ID NO: 143906 - RNA, 18 nt, Artificial Sequence
  Description of Artificial Sequence: Synthetic oligonucleotide
uaggcucuaagauccaag

SEQ ID NO: 143907 - RNA, 18 nt, Artificial Sequence
  Description of Artificial Sequence: Synthetic oligonucleotide
ggucuuaggcucuaagau

SEQ ID NO: 143908 - RNA, 18 nt, Artificial Sequence
  Description of Artificial Sequence: Synthetic oligonucleotide
uggcaggucuuaggcucu

SEQ ID NO: 143909 - RNA, 18 nt, Artificial Sequence
  Description of Artificial Sequence: Synthetic oligonucleotide
ggaaguggcaggucuuag

SEQ ID NO: 143910 - RNA, 18 nt, Artificial Sequence
  Description of Artificial Sequence: Synthetic oligonucleotide
ucugaggaaguggcaggu

SEQ ID NO: 143911 - RNA, 18 nt, Artificial Sequence
  Description of Artificial Sequence: Synthetic oligonucleotide
ggcagucugaggaagugg

SEQ ID NO: 143912 - RNA, 18 nt, Artificial Sequence
  Description of Artificial Sequence: Synthetic oligonucleotide
augcuggcagucugagga

SEQ ID NO: 143913 - RNA, 18 nt, Artificial Sequence
  Description of Artificial Sequence: Synthetic oligonucleotide
gguagaugcuggcagucu

SEQ ID NO: 143914 - RNA, 18 nt, Artificial Sequence
  Description of Artificial Sequence: Synthetic oligonucleotide
cccaugguagaugcuggc

SEQ ID NO: 143915 - RNA, 18 nt, Artificial Sequence
  Description of Artificial Sequence: Synthetic oligonucleotide
ugggacccaugguagaug

SEQ ID NO: 143916 - RNA, 18 nt, Artificial Sequence
  Description of Artificial Sequence: Synthetic oligonucleotide
acgccugggacccauggu

SEQ ID NO: 143917 - RNA, 18 nt, Artificial Sequence
  Description of Artificial Sequence: Synthetic oligonucleotide
accccacgccugggaccc

SEQ ID NO: 143918 - RNA, 18 nt, Artificial Sequence
  Description of Artificial Sequence: Synthetic oligonucleotide
acacuaccccacgccugg

SEQ ID NO: 143919 - RNA, 18 nt, Artificial Sequence
  Description of Artificial Sequence: Synthetic oligonucleotide
gguaaacacuaccccacg

SEQ ID NO: 143920 - RNA, 18 nt, Artificial Sequence
  Description of Artificial Sequence: Synthetic oligonucleotide
agggagguaaacacuacc

SEQ ID NO: 143921 - RNA, 18 nt, Artificial Sequence
  Description of Artificial Sequence: Synthetic oligonucleotide
gguauagggagguaaaca

SEQ ID NO: 143922 - RNA, 18 nt, Artificial Sequence
  Description of Artificial Sequence: Synthetic oligonucleotide
ccucagguauagggaggu

SEQ ID NO: 143923 - RNA, 18 nt, Artificial Sequence
  Description of Artificial Sequence: Synthetic oligonucleotide
guaaaccucagguauagg

SEQ ID NO: 143924 - RNA, 18 nt, Artificial Sequence
  Description of Artificial Sequence: Synthetic oligonucleotide
aaugcguaaaccucaggu

SEQ ID NO: 143925 - RNA, 18 nt, Artificial Sequence
  Description of Artificial Sequence: Synthetic oligonucleotide
gccagaaugcguaaaccu

SEQ ID NO: 143926 - RNA, 18 nt, Artificial Sequence
  Description of Artificial Sequence: Synthetic oligonucleotide
ucugggccagaaugcgua

SEQ ID NO: 143927 - RNA, 18 nt, Artificial Sequence
  Description of Artificial Sequence: Synthetic oligonucleotide
ucccuucugggccagaau

SEQ ID NO: 143928 - RNA, 18 nt, Artificial Sequence
  Description of Artificial Sequence: Synthetic oligonucleotide
ucaguucccuucugggcc

SEQ ID NO: 143929 - RNA, 18 nt, Artificial Sequence
  Description of Artificial Sequence: Synthetic oligonucleotide
aauuaucaguucccuucu

SEQ ID NO: 143930 - RNA, 18 nt, Artificial Sequence
  Description of Artificial Sequence: Synthetic oligonucleotide
guaucaauuaucaguucc

SEQ ID NO: 143931 - RNA, 18 nt, Artificial Sequence
  Description of Artificial Sequence: Synthetic oligonucleotide
agcugguaucaauuauca

SEQ ID NO: 143932 - RNA, 18 nt, Artificial Sequence
  Description of Artificial Sequence: Synthetic oligonucleotide
guucaagcugguaucaau

SEQ ID NO: 143933 - RNA, 18 nt, Artificial Sequence
  Description of Artificial Sequence: Synthetic oligonucleotide
aaauuguucaagcuggua

SEQ ID NO: 143934 - RNA, 18 nt, Artificial Sequence
  Description of Artificial Sequence: Synthetic oligonucleotide
uccccaaauuguucaagc

SEQ ID NO: 143935 - RNA, 18 nt, Artificial Sequence
  Description of Artificial Sequence: Synthetic oligonucleotide
gguguuccccaaauuguu

SEQ ID NO: 143936 - RNA, 18 nt, Artificial Sequence
  Description of Artificial Sequence: Synthetic oligonucleotide
ggacugguguuccccaaa

SEQ ID NO: 143937 - RNA, 18 nt, Artificial Sequence
  Description of Artificial Sequence: Synthetic oligonucleotide
uucugggacugguguucc

SEQ ID NO: 143938 - RNA, 18 nt, Artificial Sequence
  Description of Artificial Sequence: Synthetic oligonucleotide
ugaguuucugggacuggu

SEQ ID NO: 143939 - RNA, 18 nt, Artificial Sequence
  Description of Artificial Sequence: Synthetic oligonucleotide
aggcuugaguuucuggga

SEQ ID NO: 143940 - RNA, 18 nt, Artificial Sequence
  Description of Artificial Sequence: Synthetic oligonucleotide
gagacaggcuugaguuuc

SEQ ID NO: 143941 - RNA, 18 nt, Artificial Sequence
  Description of Artificial Sequence: Synthetic oligonucleotide
caucugagacaggcuuga

SEQ ID NO: 143942 - RNA, 18 nt, Artificial Sequence
  Description of Artificial Sequence: Synthetic oligonucleotide
caggucaucugagacagg

SEQ ID NO: 143943 - RNA, 18 nt, Artificial Sequence
  Description of Artificial Sequence: Synthetic oligonucleotide
ugugucaggucaucugag

SEQ ID NO: 143944 - RNA, 18 nt, Artificial Sequence
  Description of Artificial Sequence: Synthetic oligonucleotide
caugcugugucaggucau

SEQ ID NO: 143945 - RNA, 18 nt, Artificial Sequence
  Description of Artificial Sequence: Synthetic oligonucleotide
gcuuucaugcugugucag

SEQ ID NO: 143946 - RNA, 18 nt, Artificial Sequence
  Description of Artificial Sequence: Synthetic oligonucleotide
caguagcuuucaugcugu

SEQ ID NO: 143947 - RNA, 18 nt, Artificial Sequence
  Description of Artificial Sequence: Synthetic oligonucleotide
cuuggcaguagcuuucau

SEQ ID NO: 143948 - RNA, 18 nt, Artificial Sequence
  Description of Artificial Sequence: Synthetic oligonucleotide
cuggccuuggcaguagcu

SEQ ID NO: 143949 - RNA, 18 nt, Artificial Sequence
  Description of Artificial Sequence: Synthetic oligonucleotide
gccaccuggccuuggcag

SEQ ID NO: 143950 - RNA, 18 nt, Artificial Sequence
  Description of Artificial Sequence: Synthetic oligonucleotide
gaagggccaccuggccuu

SEQ ID NO: 143951 - RNA, 18 nt, Artificial Sequence
  Description of Artificial Sequence: Synthetic oligonucleotide
accaagaagggccaccug

SEQ ID NO: 143952 - RNA, 18 nt, Artificial Sequence
  Description of Artificial Sequence: Synthetic oligonucleotide
cuauaaccaagaagggcc

SEQ ID NO: 143953 - RNA, 18 nt, Artificial Sequence
  Description of Artificial Sequence: Synthetic oligonucleotide
gccuucuauaaccaagaa

SEQ ID NO: 143954 - RNA, 18 nt, Artificial Sequence
  Description of Artificial Sequence: Synthetic oligonucleotide
ugccugccuucuauaacc

SEQ ID NO: 143955 - RNA, 18 nt, Artificial Sequence
  Description of Artificial Sequence: Synthetic oligonucleotide
guuacugccugccuucua

SEQ ID NO: 143956 - RNA, 18 nt, Artificial Sequence
  Description of Artificial Sequence: Synthetic oligonucleotide
uacugguuacugccugcc

SEQ ID NO: 143957 - RNA, 18 nt, Artificial Sequence
  Description of Artificial Sequence: Synthetic oligonucleotide
uuacuuacugguuacugc

SEQ ID NO: 143958 - RNA, 18 nt, Artificial Sequence
  Description of Artificial Sequence: Synthetic oligonucleotide
ugugguuacuuacugguu

SEQ ID NO: 143959 - RNA, 18 nt, Artificial Sequence
  Description of Artificial Sequence: Synthetic oligonucleotide
acaaaugugguuacuuac

SEQ ID NO: 143960 - RNA, 18 nt, Artificial Sequence
  Description of Artificial Sequence: Synthetic oligonucleotide
aguugacaaaugugguua

SEQ ID NO: 143961 - RNA, 18 nt, Artificial Sequence
  Description of Artificial Sequence: Synthetic oligonucleotide
cuggcaguugacaaaugu

SEQ ID NO: 143962 - RNA, 18 nt, Artificial Sequence
  Description of Artificial Sequence: Synthetic oligonucleotide
ggcuccuggcaguugaca

SEQ ID NO: 143963 - RNA, 18 nt, Artificial Sequence
  Description of Artificial Sequence: Synthetic oligonucleotide
ugccuggcuccuggcagu

SEQ ID NO: 143964 - RNA, 18 nt, Artificial Sequence
  Description of Artificial Sequence: Synthetic oligonucleotide
acuucugccuggcuccug

SEQ ID NO: 143965 - RNA, 18 nt, Artificial Sequence
  Description of Artificial Sequence: Synthetic oligonucleotide
aagaaacuucugccuggc

SEQ ID NO: 143966 - RNA, 18 nt, Artificial Sequence
  Description of Artificial Sequence: Synthetic oligonucleotide
ccuccaagaaacuucugc

SEQ ID NO: 143967 - RNA, 18 nt, Artificial Sequence
  Description of Artificial Sequence: Synthetic oligonucleotide
ggugaccuccaagaaacu

SEQ ID NO: 143968 - RNA, 18 nt, Artificial Sequence
  Description of Artificial Sequence: Synthetic oligonucleotide
gagugggugaccuccaag

SEQ ID NO: 143969 - RNA, 18 nt, Artificial Sequence
  Description of Artificial Sequence: Synthetic oligonucleotide
ccugggagugggugaccu

SEQ ID NO: 143970 - RNA, 18 nt, Artificial Sequence
  Description of Artificial Sequence: Synthetic oligonucleotide
ugucuccugggagugggu

SEQ ID NO: 143971 - RNA, 18 nt, Artificial Sequence
  Description of Artificial Sequence: Synthetic oligonucleotide
ggcucugucuccugggag

SEQ ID NO: 143972 - RNA, 18 nt, Artificial Sequence
  Description of Artificial Sequence: Synthetic oligonucleotide
gagaaggcucugucuccu

SEQ ID NO: 143973 - RNA, 18 nt, Artificial Sequence
  Description of Artificial Sequence: Synthetic oligonucleotide
gggcagagaaggcucugu

SEQ ID NO: 143974 - RNA, 18 nt, Artificial Sequence
  Description of Artificial Sequence: Synthetic oligonucleotide
aauucucugucucagccu

SEQ ID NO: 143975 - RNA, 18 nt, Artificial Sequence
  Description of Artificial Sequence: Synthetic oligonucleotide
caagcaauucucugucuc

SEQ ID NO: 143976 - RNA, 18 nt, Artificial Sequence
  Description of Artificial Sequence: Synthetic oligonucleotide
ggguucaagcaauucucu

SEQ ID NO: 143977 - RNA, 18 nt, Artificial Sequence
  Description of Artificial Sequence: Synthetic oligonucleotide
cucccggguucaagcaau

SEQ ID NO: 143978 - RNA, 18 nt, Artificial Sequence
  Description of Artificial Sequence: Synthetic oligonucleotide
ucugccucccggguucaa

SEQ ID NO: 143979 - RNA, 18 nt, Artificial Sequence
  Description of Artificial Sequence: Synthetic oligonucleotide
caaccucugccucccggg

SEQ ID NO: 143980 - RNA, 18 nt, Artificial Sequence
  Description of Artificial Sequence: Synthetic oligonucleotide
cacugcaaccucugccuc

SEQ ID NO: 143981 - RNA, 18 nt, Artificial Sequence
  Description of Artificial Sequence: Synthetic oligonucleotide
cggcucacugcaaccucu

SEQ ID NO: 143982 - RNA, 18 nt, Artificial Sequence
  Description of Artificial Sequence: Synthetic oligonucleotide
gaucucggcucacugcaa

SEQ ID NO: 143983 - RNA, 18 nt, Artificial Sequence
  Description of Artificial Sequence: Synthetic oligonucleotide
ggcacgaucucggcucac

SEQ ID NO: 143984 - RNA, 18 nt, Artificial Sequence
  Description of Artificial Sequence: Synthetic oligonucleotide
gcaguggcacgaucucgg

SEQ ID NO: 143985 - RNA, 18 nt, Artificial Sequence
  Description of Artificial Sequence: Synthetic oligonucleotide
ggagugcaguggcacgau

SEQ ID NO: 143986 - RNA, 18 nt, Artificial Sequence
  Description of Artificial Sequence: Synthetic oligonucleotide
aggcuggagugcaguggc

SEQ ID NO: 143987 - RNA, 18 nt, Artificial Sequence
  Description of Artificial Sequence: Synthetic oligonucleotide
cucccaggcuggagugca

SEQ ID NO: 143988 - RNA, 18 nt, Artificial Sequence
  Description of Artificial Sequence: Synthetic oligonucleotide
ucugucucccaggcugga

SEQ ID NO: 143989 - RNA, 18 nt, Artificial Sequence
  Description of Artificial Sequence: Synthetic oligonucleotide
cucgcucugucucccagg

SEQ ID NO: 143990 - RNA, 18 nt, Artificial Sequence
  Description of Artificial Sequence: Synthetic oligonucleotide
agagucucgcucugucuc

SEQ ID NO: 143991 - RNA, 18 nt, Artificial Sequence
  Description of Artificial Sequence: Synthetic oligonucleotide
gagacagagucucgcucu

SEQ ID NO: 143992 - RNA, 18 nt, Artificial Sequence
  Description of Artificial Sequence: Synthetic oligonucleotide
uuuuugagacagagucuc

SEQ ID NO: 143993 - RNA, 18 nt, Artificial Sequence
  Description of Artificial Sequence: Synthetic oligonucleotide
uuuuuuuuuugagacaga

SEQ ID NO: 143994 - RNA, 18 nt, Artificial Sequence
  Description of Artificial Sequence: Synthetic oligonucleotide
ucuuuuuuuuuuuuugag

SEQ ID NO: 143995 - RNA, 18 nt, Artificial Sequence
  Description of Artificial Sequence: Synthetic oligonucleotide
ucuuuucuuuuuuuuuuu

SEQ ID NO: 143996 - RNA, 18 nt, Artificial Sequence
  Description of Artificial Sequence: Synthetic oligonucleotide
cuuuuucuuuucuuuuuu

SEQ ID NO: 143997 - RNA, 18 nt, Artificial Sequence
  Description of Artificial Sequence: Synthetic oligonucleotide
cuuuucuuuuucuuuucu

SEQ ID NO: 143998 - RNA, 18 nt, Artificial Sequence
  Description of Artificial Sequence: Synthetic oligonucleotide
cuucacuuuucuuuuucu

SEQ ID NO: 143999 - RNA, 18 nt, Artificial Sequence
  Description of Artificial Sequence: Synthetic oligonucleotide
gacuccuucacuuuucuu

SEQ ID NO: 144000 - RNA, 18 nt, Artificial Sequence
  Description of Artificial Sequence: Synthetic oligonucleotide
gggcagacuccuucacuu

SEQ ID NO: 144001 - RNA, 18 nt, Artificial Sequence
  Description of Artificial Sequence: Synthetic oligonucleotide
cuagcuuugugacuuggg

SEQ ID NO: 144002 - RNA, 18 nt, Artificial Sequence
  Description of Artificial Sequence: Synthetic oligonucleotide
uacuagcuuugugacuug

SEQ ID NO: 144003 - RNA, 18 nt, Artificial Sequence
  Description of Artificial Sequence: Synthetic oligonucleotide
caguuuacuagcuuugug

SEQ ID NO: 144004 - RNA, 18 nt, Artificial Sequence
  Description of Artificial Sequence: Synthetic oligonucleotide
cucagcaguuuacuagcu

SEQ ID NO: 144005 - RNA, 18 nt, Artificial Sequence
  Description of Artificial Sequence: Synthetic oligonucleotide
uccagcucagcaguuuac

SEQ ID NO: 144006 - RNA, 18 nt, Artificial Sequence
  Description of Artificial Sequence: Synthetic oligonucleotide
ugaguuccagcucagcag

SEQ ID NO: 144007 - RNA, 18 nt, Artificial Sequence
  Description of Artificial Sequence: Synthetic oligonucleotide
gggcuugaguuccagcuc

SEQ ID NO: 144008 - RNA, 18 nt, Artificial Sequence
  Description of Artificial Sequence: Synthetic oligonucleotide
ggccugggcuugaguucc

SEQ ID NO: 144009 - RNA, 18 nt, Artificial Sequence
  Description of Artificial Sequence: Synthetic oligonucleotide
acaaaggccugggcuuga

SEQ ID NO: 144010 - RNA, 18 nt, Artificial Sequence
  Description of Artificial Sequence: Synthetic oligonucleotide
uggugacaaaggccuggg

SEQ ID NO: 144011 - RNA, 18 nt, Artificial Sequence
  Description of Artificial Sequence: Synthetic oligonucleotide
gacuuuggugacaaaggc

SEQ ID NO: 144012 - RNA, 18 nt, Artificial Sequence
  Description of Artificial Sequence: Synthetic oligonucleotide
agacagacuuuggugaca

SEQ ID NO: 144013 - RNA, 18 nt, Artificial Sequence
  Description of Artificial Sequence: Synthetic oligonucleotide
ggguaagacagacuuugg

SEQ ID NO: 144014 - RNA, 18 nt, Artificial Sequence
  Description of Artificial Sequence: Synthetic oligonucleotide
ugagcuacgcuagcuggg

SEQ ID NO: 144015 - RNA, 18 nt, Artificial Sequence
  Description of Artificial Sequence: Synthetic oligonucleotide
ugacugagcuacgcuagc

SEQ ID NO: 144016 - RNA, 18 nt, Artificial Sequence
  Description of Artificial Sequence: Synthetic oligonucleotide
cugagugacugagcuacg

SEQ ID NO: 144017 - RNA, 18 nt, Artificial Sequence
  Description of Artificial Sequence: Synthetic oligonucleotide
acuuacugagugacugag

SEQ ID NO: 144018 - RNA, 18 nt, Artificial Sequence
  Description of Artificial Sequence: Synthetic oligonucleotide
cucuaacuuacugaguga

SEQ ID NO: 144019 - RNA, 18 nt, Artificial Sequence
  Description of Artificial Sequence: Synthetic oligonucleotide
aaggacucuaacuuacug

SEQ ID NO: 144020 - RNA, 18 nt, Artificial Sequence
  Description of Artificial Sequence: Synthetic oligonucleotide
cacacaaggacucuaacu

SEQ ID NO: 144021 - RNA, 18 nt, Artificial Sequence
  Description of Artificial Sequence: Synthetic oligonucleotide
cccagcacacaaggacuc

SEQ ID NO: 144022 - RNA, 18 nt, Artificial Sequence
  Description of Artificial Sequence: Synthetic oligonucleotide
cagugcccagcacacaag

SEQ ID NO: 144023 - RNA, 18 nt, Artificial Sequence
  Description of Artificial Sequence: Synthetic oligonucleotide
guucacagugcccagcac

SEQ ID NO: 144024 - RNA, 18 nt, Artificial Sequence
  Description of Artificial Sequence: Synthetic oligonucleotide
guuuuguucacagugccc

SEQ ID NO: 144025 - RNA, 18 nt, Artificial Sequence
  Description of Artificial Sequence: Synthetic oligonucleotide
ugucuguuuuguucacag

SEQ ID NO: 144026 - RNA, 18 nt, Artificial Sequence
  Description of Artificial Sequence: Synthetic oligonucleotide
gauuuugucuguuuuguu

SEQ ID NO: 144027 - RNA, 18 nt, Artificial Sequence
  Description of Artificial Sequence: Synthetic oligonucleotide
gcagugauuuugucuguu

SEQ ID NO: 144028 - RNA, 18 nt, Artificial Sequence
  Description of Artificial Sequence: Synthetic oligonucleotide
caagagcagugauuuugu

SEQ ID NO: 144029 - RNA, 18 nt, Artificial Sequence
  Description of Artificial Sequence: Synthetic oligonucleotide
cuuugcaagagcagugau

SEQ ID NO: 144030 - RNA, 18 nt, Artificial Sequence
  Description of Artificial Sequence: Synthetic oligonucleotide
uguaucuuugcaagagca

SEQ ID NO: 144031 - RNA, 18 nt, Artificial Sequence
  Description of Artificial Sequence: Synthetic oligonucleotide
uuugguguaucuuugcaa

SEQ ID NO: 144032 - RNA, 18 nt, Artificial Sequence
  Description of Artificial Sequence: Synthetic oligonucleotide
uuuuuuuugguguaucuu

SEQ ID NO: 144033 - RNA, 18 nt, Artificial Sequence
  Description of Artificial Sequence: Synthetic oligonucleotide
uuuuuuuuuuuuuggugu

SEQ ID NO: 144034 - RNA, 18 nt, Artificial Sequence
  Description of Artificial Sequence: Synthetic oligonucleotide
ugauuuuuuuuuuuuuuu

SEQ ID NO: 144035 - RNA, 18 nt, Artificial Sequence
  Description of Artificial Sequence: Synthetic oligonucleotide
agaugugauuuuuuuuuu

SEQ ID NO: 144036 - RNA, 18 nt, Artificial Sequence
  Description of Artificial Sequence: Synthetic oligonucleotide
ccacaagaugugauuuuu

SEQ ID NO: 144037 - RNA, 18 nt, Artificial Sequence
  Description of Artificial Sequence: Synthetic oligonucleotide
aagcuccacaagauguga

SEQ ID NO: 144038 - RNA, 18 nt, Artificial Sequence
  Description of Artificial Sequence: Synthetic oligonucleotide
aucgcaagcuccacaaga

SEQ ID NO: 144039 - RNA, 18 nt, Artificial Sequence
  Description of Artificial Sequence: Synthetic oligonucleotide
uccagaucgcaagcucca

SEQ ID NO: 144040 - RNA, 18 nt, Artificial Sequence
  Description of Artificial Sequence: Synthetic oligonucleotide
gccccuccagaucgcaag

SEQ ID NO: 144041 - RNA, 18 nt, Artificial Sequence
  Description of Artificial Sequence: Synthetic oligonucleotide
ggguggccccuccagauc

SEQ ID NO: 144042 - RNA, 18 nt, Artificial Sequence
  Description of Artificial Sequence: Synthetic oligonucleotide
caagguaggaaugauggg

SEQ ID NO: 144043 - RNA, 18 nt, Artificial Sequence
  Description of Artificial Sequence: Synthetic oligonucleotide
ucagcaagguaggaauga

SEQ ID NO: 144044 - RNA, 18 nt, Artificial Sequence
  Description of Artificial Sequence: Synthetic oligonucleotide
uagagucagcaagguagg

SEQ ID NO: 144045 - RNA, 18 nt, Artificial Sequence
  Description of Artificial Sequence: Synthetic oligonucleotide
agcucuagagucagcaag

SEQ ID NO: 144046 - RNA, 18 nt, Artificial Sequence
  Description of Artificial Sequence: Synthetic oligonucleotide
ccagaagcucuagaguca

SEQ ID NO: 144047 - RNA, 18 nt, Artificial Sequence
  Description of Artificial Sequence: Synthetic oligonucleotide
ggcccccagaagcucuag

SEQ ID NO: 144048 - RNA, 18 nt, Artificial Sequence
  Description of Artificial Sequence: Synthetic oligonucleotide
ccuaaggcccccagaagc

SEQ ID NO: 144049 - RNA, 18 nt, Artificial Sequence
  Description of Artificial Sequence: Synthetic oligonucleotide
uggagccuaaggccccca

SEQ ID NO: 144050 - RNA, 18 nt, Artificial Sequence
  Description of Artificial Sequence: Synthetic oligonucleotide
ccuuuuggagccuaaggc

SEQ ID NO: 144051 - RNA, 18 nt, Artificial Sequence
  Description of Artificial Sequence: Synthetic oligonucleotide
caaauccuuuuggagccu

SEQ ID NO: 144052 - RNA, 18 nt, Artificial Sequence
  Description of Artificial Sequence: Synthetic oligonucleotide
ugggccaaauccuuuugg

SEQ ID NO: 144053 - RNA, 18 nt, Artificial Sequence
  Description of Artificial Sequence: Synthetic oligonucleotide
gugcaugggccaaauccu

SEQ ID NO: 144054 - RNA, 18 nt, Artificial Sequence
  Description of Artificial Sequence: Synthetic oligonucleotide
uacaggugcaugggccaa

SEQ ID NO: 144055 - RNA, 18 nt, Artificial Sequence
  Description of Artificial Sequence: Synthetic oligonucleotide
cccuuuacaggugcaugg

SEQ ID NO: 144056 - RNA, 18 nt, Artificial Sequence
  Description of Artificial Sequence: Synthetic oligonucleotide
cccaucccuuuacaggug

SEQ ID NO: 144057 - RNA, 18 nt, Artificial Sequence
  Description of Artificial Sequence: Synthetic oligonucleotide
acauccccaucccuuuac

SEQ ID NO: 144058 - RNA, 18 nt, Artificial Sequence
  Description of Artificial Sequence: Synthetic oligonucleotide
cucugacauccccauccc

SEQ ID NO: 144059 - RNA, 18 nt, Artificial Sequence
  Description of Artificial Sequence: Synthetic oligonucleotide
agcaccucugacaucccc

SEQ ID NO: 144060 - RNA, 18 nt, Artificial Sequence
  Description of Artificial Sequence: Synthetic oligonucleotide
gccccagcaccucugaca

SEQ ID NO: 144061 - RNA, 18 nt, Artificial Sequence
  Description of Artificial Sequence: Synthetic oligonucleotide
ggcaggccccagcaccuc

SEQ ID NO: 144062 - RNA, 18 nt, Artificial Sequence
  Description of Artificial Sequence: Synthetic oligonucleotide
gcccaggcaggccccagc

SEQ ID NO: 144063 - RNA, 18 nt, Artificial Sequence
  Description of Artificial Sequence: Synthetic oligonucleotide
aaggagcccaggcaggcc

SEQ ID NO: 144064 - RNA, 18 nt, Artificial Sequence
  Description of Artificial Sequence: Synthetic oligonucleotide
ucagcaaggagcccaggc

SEQ ID NO: 144065 - RNA, 18 nt, Artificial Sequence
  Description of Artificial Sequence: Synthetic oligonucleotide
ggcagucagcaaggagcc

SEQ ID NO: 144066 - RNA, 18 nt, Artificial Sequence
  Description of Artificial Sequence: Synthetic oligonucleotide
auccgaccaaaacggaua

SEQ ID NO: 144067 - RNA, 18 nt, Artificial Sequence
  Description of Artificial Sequence: Synthetic oligonucleotide
ccggcauccgaccaaaac

SEQ ID NO: 144068 - RNA, 18 nt, Artificial Sequence
  Description of Artificial Sequence: Synthetic oligonucleotide
agccuccggcauccgacc

SEQ ID NO: 144069 - RNA, 18 nt, Artificial Sequence
  Description of Artificial Sequence: Synthetic oligonucleotide
uucucagccuccggcauc

SEQ ID NO: 144070 - RNA, 18 nt, Artificial Sequence
  Description of Artificial Sequence: Synthetic oligonucleotide
uccucuucucagccuccg

SEQ ID NO: 144071 - RNA, 18 nt, Artificial Sequence
  Description of Artificial Sequence: Synthetic oligonucleotide
cagcuuccucuucucagc

SEQ ID NO: 144072 - RNA, 18 nt, Artificial Sequence
  Description of Artificial Sequence: Synthetic oligonucleotide
gccaccagcuuccucuuc

SEQ ID NO: 144073 - RNA, 18 nt, Artificial Sequence
  Description of Artificial Sequence: Synthetic oligonucleotide
gcccugccaccagcuucc

SEQ ID NO: 144074 - RNA, 18 nt, Artificial Sequence
  Description of Artificial Sequence: Synthetic oligonucleotide
agucagcccugccaccag

SEQ ID NO: 144075 - RNA, 18 nt, Artificial Sequence
  Description of Artificial Sequence: Synthetic oligonucleotide
uuugcagucagcccugcc

SEQ ID NO: 144076 - RNA, 18 nt, Artificial Sequence
  Description of Artificial Sequence: Synthetic oligonucleotide
ccucguuugcagucagcc

SEQ ID NO: 144077 - RNA, 18 nt, Artificial Sequence
  Description of Artificial Sequence: Synthetic oligonucleotide
gcuccccucguuugcagu

SEQ ID NO: 144078 - RNA, 18 nt, Artificial Sequence
  Description of Artificial Sequence: Synthetic oligonucleotide
uacuggcuccccucguuu

SEQ ID NO: 144079 - RNA, 18 nt, Artificial Sequence
  Description of Artificial Sequence: Synthetic oligonucleotide
gguuguacuggcuccccu

SEQ ID NO: 144080 - RNA, 18 nt, Artificial Sequence
  Description of Artificial Sequence: Synthetic oligonucleotide
cuguggguuguacuggcu

SEQ ID NO: 144081 - RNA, 18 nt, Artificial Sequence
  Description of Artificial Sequence: Synthetic oligonucleotide
gccaccuguggguuguac

SEQ ID NO: 144082 - RNA, 18 nt, Artificial Sequence
  Description of Artificial Sequence: Synthetic oligonucleotide
ggucggccaccugugggu

SEQ ID NO: 144083 - RNA, 18 nt, Artificial Sequence
  Description of Artificial Sequence: Synthetic oligonucleotide
cuucaggucggccaccug

SEQ ID NO: 144084 - RNA, 18 nt, Artificial Sequence
  Description of Artificial Sequence: Synthetic oligonucleotide
aaggccuucaggucggcc

SEQ ID NO: 144085 - RNA, 18 nt, Artificial Sequence
  Description of Artificial Sequence: Synthetic oligonucleotide
uggagaaggccuucaggu

SEQ ID NO: 144086 - RNA, 18 nt, Artificial Sequence
  Description of Artificial Sequence: Synthetic oligonucleotide
gugcuuggagaaggccuu

SEQ ID NO: 144087 - RNA, 18 nt, Artificial Sequence
  Description of Artificial Sequence: Synthetic oligonucleotide
uagaugugcuuggagaag

SEQ ID NO: 144088 - RNA, 18 nt, Artificial Sequence
  Description of Artificial Sequence: Synthetic oligonucleotide
cauuguagaugugcuugg

SEQ ID NO: 144089 - RNA, 18 nt, Artificial Sequence
  Description of Artificial Sequence: Synthetic oligonucleotide
guaggcauuguagaugug

SEQ ID NO: 144090 - RNA, 18 nt, Artificial Sequence
  Description of Artificial Sequence: Synthetic oligonucleotide
uucagguaggcauuguag

SEQ ID NO: 144091 - RNA, 18 nt, Artificial Sequence
  Description of Artificial Sequence: Synthetic oligonucleotide
aguuuuucagguaggcau

SEQ ID NO: 144092 - RNA, 18 nt, Artificial Sequence
  Description of Artificial Sequence: Synthetic oligonucleotide
guugaaguuuuucaggua

SEQ ID NO: 144093 - RNA, 18 nt, Artificial Sequence
  Description of Artificial Sequence: Synthetic oligonucleotide
gucauguugaaguuuuuc

SEQ ID NO: 144094 - RNA, 18 nt, Artificial Sequence
  Description of Artificial Sequence: Synthetic oligonucleotide
uuuuggucauguugaagu

SEQ ID NO: 144095 - RNA, 18 nt, Artificial Sequence
  Description of Artificial Sequence: Synthetic oligonucleotide
cuucuuuuuggucauguu

SEQ ID NO: 144096 - RNA, 18 nt, Artificial Sequence
  Description of Artificial Sequence: Synthetic oligonucleotide
cgggccuucuuuuugguc

SEQ ID NO: 144097 - RNA, 18 nt, Artificial Sequence
  Description of Artificial Sequence: Synthetic oligonucleotide
ugcugcgggccuucuuuu

SEQ ID NO: 144098 - RNA, 18 nt, Artificial Sequence
  Description of Artificial Sequence: Synthetic oligonucleotide
gaggaugcugcgggccuu

SEQ ID NO: 144099 - RNA, 18 nt, Artificial Sequence
  Description of Artificial Sequence: Synthetic oligonucleotide
ccggugaggaugcugcgg

SEQ ID NO: 144100 - RNA, 18 nt, Artificial Sequence
  Description of Artificial Sequence: Synthetic oligonucleotide
cuuugccggugaggaugc

SEQ ID NO: 144101 - RNA, 18 nt, Artificial Sequence
  Description of Artificial Sequence: Synthetic oligonucleotide
gcuggcuuugccggugag

SEQ ID NO: 144102 - RNA, 18 nt, Artificial Sequence
  Description of Artificial Sequence: Synthetic oligonucleotide
guguggcuggcuuugccg

SEQ ID NO: 144103 - RNA, 18 nt, Artificial Sequence
  Description of Artificial Sequence: Synthetic oligonucleotide
cauccgaccaaaacggau

SEQ ID NO: 144104 - RNA, 18 nt, Artificial Sequence
  Description of Artificial Sequence: Synthetic oligonucleotide
uccggcauccgaccaaaa

SEQ ID NO: 144105 - RNA, 18 nt, Artificial Sequence
  Description of Artificial Sequence: Synthetic oligonucleotide
cagccuccggcauccgac

SEQ ID NO: 144106 - RNA, 18 nt, Artificial Sequence
  Description of Artificial Sequence: Synthetic oligonucleotide
cuucucagccuccggcau

SEQ ID NO: 144107 - RNA, 18 nt, Artificial Sequence
  Description of Artificial Sequence: Synthetic oligonucleotide
uuccucuucucagccucc

SEQ ID NO: 144108 - RNA, 18 nt, Artificial Sequence
  Description of Artificial Sequence: Synthetic oligonucleotide
ccagcuuccucuucucag

SEQ ID NO: 144109 - RNA, 18 nt, Artificial Sequence
  Description of Artificial Sequence: Synthetic oligonucleotide
ugccaccagcuuccucuu

SEQ ID NO: 144110 - RNA, 18 nt, Artificial Sequence
  Description of Artificial Sequence: Synthetic oligonucleotide
agcccugccaccagcuuc

SEQ ID NO: 144111 - RNA, 18 nt, Artificial Sequence
  Description of Artificial Sequence: Synthetic oligonucleotide
cagucagcccugccacca

SEQ ID NO: 144112 - RNA, 18 nt, Artificial Sequence
  Description of Artificial Sequence: Synthetic oligonucleotide
guuugcagucagcccugc

SEQ ID NO: 144113 - RNA, 18 nt, Artificial Sequence
  Description of Artificial Sequence: Synthetic oligonucleotide
cccucguuugcagucagc

SEQ ID NO: 144114 - RNA, 18 nt, Artificial Sequence
  Description of Artificial Sequence: Synthetic oligonucleotide
ggcuccccucguuugcag

SEQ ID NO: 144115 - RNA, 18 nt, Artificial Sequence
  Description of Artificial Sequence: Synthetic oligonucleotide
guacuggcuccccucguu

SEQ ID NO: 144116 - RNA, 18 nt, Artificial Sequence
  Description of Artificial Sequence: Synthetic oligonucleotide
ggguuguacuggcucccc

SEQ ID NO: 144117 - RNA, 18 nt, Artificial Sequence
  Description of Artificial Sequence: Synthetic oligonucleotide
ccuguggguuguacuggc

SEQ ID NO: 144118 - RNA, 18 nt, Artificial Sequence
  Description of Artificial Sequence: Synthetic oligonucleotide
ggccaccuguggguugua

SEQ ID NO: 144119 - RNA, 18 nt, Artificial Sequence
  Description of Artificial Sequence: Synthetic oligonucleotide
aggucggccaccuguggg

SEQ ID NO: 144120 - RNA, 18 nt, Artificial Sequence
  Description of Artificial Sequence: Synthetic oligonucleotide
ccuucaggucggccaccu

SEQ ID NO: 144121 - RNA, 18 nt, Artificial Sequence
  Description of Artificial Sequence: Synthetic oligonucleotide
gaaggccuucaggucggc

SEQ ID NO: 144122 - RNA, 18 nt, Artificial Sequence
  Description of Artificial Sequence: Synthetic oligonucleotide
uuggagaaggccuucagg

SEQ ID NO: 144123 - RNA, 18 nt, Artificial Sequence
  Description of Artificial Sequence: Synthetic oligonucleotide
ugugcuuggagaaggccu

SEQ ID NO: 144124 - RNA, 18 nt, Artificial Sequence
  Description of Artificial Sequence: Synthetic oligonucleotide
guagaugugcuuggagaa

SEQ ID NO: 144125 - RNA, 18 nt, Artificial Sequence
  Description of Artificial Sequence: Synthetic oligonucleotide
gcauuguagaugugcuug

SEQ ID NO: 144126 - RNA, 18 nt, Artificial Sequence
  Description of Artificial Sequence: Synthetic oligonucleotide
gguaggcauuguagaugu

SEQ ID NO: 144127 - RNA, 18 nt, Artificial Sequence
  Description of Artificial Sequence: Synthetic oligonucleotide
uuucagguaggcauugua

SEQ ID NO: 144128 - RNA, 18 nt, Artificial Sequence
  Description of Artificial Sequence: Synthetic oligonucleotide
aaguuuuucagguaggca

SEQ ID NO: 144129 - RNA, 18 nt, Artificial Sequence
  Description of Artificial Sequence: Synthetic oligonucleotide
uguugaaguuuuucaggu

SEQ ID NO: 144130 - RNA, 18 nt, Artificial Sequence
  Description of Artificial Sequence: Synthetic oligonucleotide
ggucauguugaaguuuuu

SEQ ID NO: 144131 - RNA, 18 nt, Artificial Sequence
  Description of Artificial Sequence: Synthetic oligonucleotide
uuuuuggucauguugaag

SEQ ID NO: 144132 - RNA, 18 nt, Artificial Sequence
  Description of Artificial Sequence: Synthetic oligonucleotide
ccuucuuuuuggucaugu

SEQ ID NO: 144133 - RNA, 18 nt, Artificial Sequence
  Description of Artificial Sequence: Synthetic oligonucleotide
gcgggccuucuuuuuggu

SEQ ID NO: 144134 - RNA, 18 nt, Artificial Sequence
  Description of Artificial Sequence: Synthetic oligonucleotide
augcugcgggccuucuuu

SEQ ID NO: 144135 - RNA, 18 nt, Artificial Sequence
  Description of Artificial Sequence: Synthetic oligonucleotide
ugaggaugcugcgggccu

SEQ ID NO: 144136 - RNA, 18 nt, Artificial Sequence
  Description of Artificial Sequence: Synthetic oligonucleotide
gccggugaggaugcugcg

SEQ ID NO: 144137 - RNA, 18 nt, Artificial Sequence
  Description of Artificial Sequence: Synthetic oligonucleotide
gcuuugccggugaggaug

SEQ ID NO: 144138 - RNA, 18 nt, Artificial Sequence
  Description of Artificial Sequence: Synthetic oligonucleotide
ggcuggcuuugccgguga

SEQ ID NO: 144139 - RNA, 18 nt, Artificial Sequence
  Description of Artificial Sequence: Synthetic oligonucleotide
cguguggcuggcuuugcc

SEQ ID NO: 144140 - RNA, 18 nt, Artificial Sequence
  Description of Artificial Sequence: Synthetic oligonucleotide
ggccaagcagcagcaaca

SEQ ID NO: 144141 - RNA, 18 nt, Artificial Sequence
  Description of Artificial Sequence: Synthetic oligonucleotide
ugccaggccaagcagcag

SEQ ID NO: 144142 - RNA, 18 nt, Artificial Sequence
  Description of Artificial Sequence: Synthetic oligonucleotide
gaugcugccaggccaagc

SEQ ID NO: 144143 - RNA, 18 nt, Artificial Sequence
  Description of Artificial Sequence: Synthetic oligonucleotide
cccaggaugcugccaggc

SEQ ID NO: 144144 - RNA, 18 nt, Artificial Sequence
  Description of Artificial Sequence: Synthetic oligonucleotide
cagagcccaggaugcugc

SEQ ID NO: 144145 - RNA, 18 nt, Artificial Sequence
  Description of Artificial Sequence: Synthetic oligonucleotide
ggacccagagcccaggau

SEQ ID NO: 144146 - RNA, 18 nt, Artificial Sequence
  Description of Artificial Sequence: Synthetic oligonucleotide
cagugggacccagagccc

SEQ ID NO: 144147 - RNA, 18 nt, Artificial Sequence
  Description of Artificial Sequence: Synthetic oligonucleotide
ggcggcagugggacccag

SEQ ID NO: 144148 - RNA, 18 nt, Artificial Sequence
  Description of Artificial Sequence: Synthetic oligonucleotide
aggcaggcggcaguggga

SEQ ID NO: 144149 - RNA, 18 nt, Artificial Sequence
  Description of Artificial Sequence: Synthetic oligonucleotide
gagucaggcaggcggcag

SEQ ID NO: 144150 - RNA, 18 nt, Artificial Sequence
  Description of Artificial Sequence: Synthetic oligonucleotide
ucccggagucaggcaggc

SEQ ID NO: 144151 - RNA, 18 nt, Artificial Sequence
  Description of Artificial Sequence: Synthetic oligonucleotide
ggcucucccggagucagg

SEQ ID NO: 144152 - RNA, 18 nt, Artificial Sequence
  Description of Artificial Sequence: Synthetic oligonucleotide
ggccuggcucucccggag

SEQ ID NO: 144153 - RNA, 18 nt, Artificial Sequence
  Description of Artificial Sequence: Synthetic oligonucleotide
gagaaggccuggcucucc

SEQ ID NO: 144154 - RNA, 18 nt, Artificial Sequence
  Description of Artificial Sequence: Synthetic oligonucleotide
ggagggagaaggccuggc

SEQ ID NO: 144155 - RNA, 18 nt, Artificial Sequence
  Description of Artificial Sequence: Synthetic oligonucleotide
uugagggagggagaaggc

SEQ ID NO: 144156 - RNA, 18 nt, Artificial Sequence
  Description of Artificial Sequence: Synthetic oligonucleotide
ugaaguugagggagggag

SEQ ID NO: 144157 - RNA, 18 nt, Artificial Sequence
  Description of Artificial Sequence: Synthetic oligonucleotide
caccaugaaguugaggga

SEQ ID NO: 144158 - RNA, 18 nt, Artificial Sequence
  Description of Artificial Sequence: Synthetic oligonucleotide
gccugcaccaugaaguug

SEQ ID NO: 144159 - RNA, 18 nt, Artificial Sequence
  Description of Artificial Sequence: Synthetic oligonucleotide
cccuugccugcaccauga

SEQ ID NO: 144160 - RNA, 18 nt, Artificial Sequence
  Description of Artificial Sequence: Synthetic oligonucleotide
cuggcucucccggaguca

SEQ ID NO: 144161 - RNA, 18 nt, Artificial Sequence
  Description of Artificial Sequence: Synthetic oligonucleotide
aaggccuggcucucccgg

SEQ ID NO: 144162 - RNA, 18 nt, Artificial Sequence
  Description of Artificial Sequence: Synthetic oligonucleotide
gggagaaggccuggcucu

SEQ ID NO: 144163 - RNA, 18 nt, Artificial Sequence
  Description of Artificial Sequence: Synthetic oligonucleotide
agggagggagaaggccug

SEQ ID NO: 144164 - RNA, 18 nt, Artificial Sequence
  Description of Artificial Sequence: Synthetic oligonucleotide
aguugagggagggagaag

SEQ ID NO: 144165 - RNA, 18 nt, Artificial Sequence
  Description of Artificial Sequence: Synthetic oligonucleotide
caugaaguugagggaggg

SEQ ID NO: 144166 - RNA, 18 nt, Artificial Sequence
  Description of Artificial Sequence: Synthetic oligonucleotide
ugcaccaugaaguugagg

SEQ ID NO: 144167 - RNA, 18 nt, Artificial Sequence
  Description of Artificial Sequence: Synthetic oligonucleotide
uugccugcaccaugaagu

SEQ ID NO: 144168 - RNA, 18 nt, Artificial Sequence
  Description of Artificial Sequence: Synthetic oligonucleotide
gucccuugccugcaccau

SEQ ID NO: 144169 - RNA, 18 nt, Artificial Sequence
  Description of Artificial Sequence: Synthetic oligonucleotide
cccaugucccuugccugc

SEQ ID NO: 144170 - RNA, 18 nt, Artificial Sequence
  Description of Artificial Sequence: Synthetic oligonucleotide
ugcuccccaugucccuug

SEQ ID NO: 144171 - RNA, 18 nt, Artificial Sequence
  Description of Artificial Sequence: Synthetic oligonucleotide
cccugugcuccccauguc

SEQ ID NO: 144172 - RNA, 18 nt, Artificial Sequence
  Description of Artificial Sequence: Synthetic oligonucleotide
ccccacccugugcucccc

SEQ ID NO: 144173 - RNA, 18 nt, Artificial Sequence
  Description of Artificial Sequence: Synthetic oligonucleotide
gagacccccacccugugc

SEQ ID NO: 144174 - RNA, 18 nt, Artificial Sequence
  Description of Artificial Sequence: Synthetic oligonucleotide
cucgggagacccccaccc

SEQ ID NO: 144175 - RNA, 18 nt, Artificial Sequence
  Description of Artificial Sequence: Synthetic oligonucleotide
caggccucgggagacccc

SEQ ID NO: 144176 - RNA, 18 nt, Artificial Sequence
  Description of Artificial Sequence: Synthetic oligonucleotide
gagaucaggccucgggag

SEQ ID NO: 144177 - RNA, 18 nt, Artificial Sequence
  Description of Artificial Sequence: Synthetic oligonucleotide
cguuagagaucaggccuc

SEQ ID NO: 144178 - RNA, 18 nt, Artificial Sequence
  Description of Artificial Sequence: Synthetic oligonucleotide
ugucguggaucacaaagg

SEQ ID NO: 144179 - RNA, 18 nt, Artificial Sequence
  Description of Artificial Sequence: Synthetic oligonucleotide
cucgaugucguggaucac

SEQ ID NO: 144180 - RNA, 18 nt, Artificial Sequence
  Description of Artificial Sequence: Synthetic oligonucleotide
aaugucucgaugucgugg

SEQ ID NO: 144181 - RNA, 18 nt, Artificial Sequence
  Description of Artificial Sequence: Synthetic oligonucleotide
gccacaaugucucgaugu

SEQ ID NO: 144182 - RNA, 18 nt, Artificial Sequence
  Description of Artificial Sequence: Synthetic oligonucleotide
ugccugccacaaugucuc

SEQ ID NO: 144183 - RNA, 18 nt, Artificial Sequence
  Description of Artificial Sequence: Synthetic oligonucleotide
uucucugccugccacaau

SEQ ID NO: 144184 - RNA, 18 nt, Artificial Sequence
  Description of Artificial Sequence: Synthetic oligonucleotide
gccccuucucugccugcc

SEQ ID NO: 144185 - RNA, 18 nt, Artificial Sequence
  Description of Artificial Sequence: Synthetic oligonucleotide
caccagccccuucucugc

SEQ ID NO: 144186 - RNA, 18 nt, Artificial Sequence
  Description of Artificial Sequence: Synthetic oligonucleotide
uuccacaccagccccuuc

SEQ ID NO: 144187 - RNA, 18 nt, Artificial Sequence
  Description of Artificial Sequence: Synthetic oligonucleotide
acugcuuccacaccagcc

SEQ ID NO: 144188 - RNA, 18 nt, Artificial Sequence
  Description of Artificial Sequence: Synthetic oligonucleotide
caccaacugcuuccacac

SEQ ID NO: 144189 - RNA, 18 nt, Artificial Sequence
  Description of Artificial Sequence: Synthetic oligonucleotide
ccauucaccaacugcuuc

SEQ ID NO: 144190 - RNA, 18 nt, Artificial Sequence
  Description of Artificial Sequence: Synthetic oligonucleotide
gcaggccauucaccaacu

SEQ ID NO: 144191 - RNA, 18 nt, Artificial Sequence
  Description of Artificial Sequence: Synthetic oligonucleotide
gggaggcaggccauucac

SEQ ID NO: 144192 - RNA, 18 nt, Artificial Sequence
  Description of Artificial Sequence: Synthetic oligonucleotide
uuguagggaggcaggcca

SEQ ID NO: 144193 - RNA, 18 nt, Artificial Sequence
  Description of Artificial Sequence: Synthetic oligonucleotide
ucuccuuguagggaggca

SEQ ID NO: 144194 - RNA, 18 nt, Artificial Sequence
  Description of Artificial Sequence: Synthetic oligonucleotide
gcugaucuccuuguaggg

SEQ ID NO: 144195 - RNA, 18 nt, Artificial Sequence
  Description of Artificial Sequence: Synthetic oligonucleotide
ugcacgcugaucuccuug

SEQ ID NO: 144196 - RNA, 18 nt, Artificial Sequence
  Description of Artificial Sequence: Synthetic oligonucleotide
agacgugcacgcugaucu

SEQ ID NO: 144197 - RNA, 18 nt, Artificial Sequence
  Description of Artificial Sequence: Synthetic oligonucleotide
guagaagacgugcacgcu

SEQ ID NO: 144198 - RNA, 18 nt, Artificial Sequence
  Description of Artificial Sequence: Synthetic oligonucleotide
cagcgguagaagacgugc

SEQ ID NO: 144199 - RNA, 18 nt, Artificial Sequence
  Description of Artificial Sequence: Synthetic oligonucleotide
acuggcagcgguagaaga

SEQ ID NO: 144200 - RNA, 18 nt, Artificial Sequence
  Description of Artificial Sequence: Synthetic oligonucleotide
ggugcacuggcagcggua

SEQ ID NO: 144201 - RNA, 18 nt, Artificial Sequence
  Description of Artificial Sequence: Synthetic oligonucleotide
acuguggugcacuggcag

SEQ ID NO: 144202 - RNA, 18 nt, Artificial Sequence
  Description of Artificial Sequence: Synthetic oligonucleotide
ucuccacuguggugcacu

SEQ ID NO: 144203 - RNA, 18 nt, Artificial Sequence
  Description of Artificial Sequence: Synthetic oligonucleotide
cacggucuccacuguggu

SEQ ID NO: 144204 - RNA, 18 nt, Artificial Sequence
  Description of Artificial Sequence: Synthetic oligonucleotide
ucccgcacggucuccacu

SEQ ID NO: 144205 - RNA, 18 nt, Artificial Sequence
  Description of Artificial Sequence: Synthetic oligonucleotide
ugagcucccgcacggucu

SEQ ID NO: 144206 - RNA, 18 nt, Artificial Sequence
  Description of Artificial Sequence: Synthetic oligonucleotide
cucagugagcucccgcac

SEQ ID NO: 144207 - RNA, 18 nt, Artificial Sequence
  Description of Artificial Sequence: Synthetic oligonucleotide
gcgaacucagugagcucc

SEQ ID NO: 144208 - RNA, 18 nt, Artificial Sequence
  Description of Artificial Sequence: Synthetic oligonucleotide
ucuuggcgaacucaguga

SEQ ID NO: 144209 - RNA, 18 nt, Artificial Sequence
  Description of Artificial Sequence: Synthetic oligonucleotide
gaugcucuuggcgaacuc

SEQ ID NO: 144210 - RNA, 18 nt, Artificial Sequence
  Description of Artificial Sequence: Synthetic oligonucleotide
gggaugcucuuggcgaac

SEQ ID NO: 144211 - RNA, 18 nt, Artificial Sequence
  Description of Artificial Sequence: Synthetic oligonucleotide
gaggcugcugaagcuggg

SEQ ID NO: 144212 - RNA, 18 nt, Artificial Sequence
  Description of Artificial Sequence: Synthetic oligonucleotide
aggaagaggcugcugaag

SEQ ID NO: 144213 - RNA, 18 nt, Artificial Sequence
  Description of Artificial Sequence: Synthetic oligonucleotide
cguugaggaagaggcugc

SEQ ID NO: 144214 - RNA, 18 nt, Artificial Sequence
  Description of Artificial Sequence: Synthetic oligonucleotide
cuggucguugaggaagag

SEQ ID NO: 144215 - RNA, 18 nt, Artificial Sequence
  Description of Artificial Sequence: Synthetic oligonucleotide
guaaccuggucguugagg

SEQ ID NO: 144216 - RNA, 18 nt, Artificial Sequence
  Description of Artificial Sequence: Synthetic oligonucleotide
gaaggguaaccuggucgu

SEQ ID NO: 144217 - RNA, 18 nt, Artificial Sequence
  Description of Artificial Sequence: Synthetic oligonucleotide
cuugagaaggguaaccug

SEQ ID NO: 144218 - RNA, 18 nt, Artificial Sequence
  Description of Artificial Sequence: Synthetic oligonucleotide
ccauacuugagaagggua

SEQ ID NO: 144219 - RNA, 18 nt, Artificial Sequence
  Description of Artificial Sequence: Synthetic oligonucleotide
gcacgccauacuugagaa

SEQ ID NO: 144220 - RNA, 18 nt, Artificial Sequence
  Description of Artificial Sequence: Synthetic oligonucleotide
cucgugcacgccauacuu

SEQ ID NO: 144221 - RNA, 18 nt, Artificial Sequence
  Description of Artificial Sequence: Synthetic oligonucleotide
auggccucgugcacgcca

SEQ ID NO: 144222 - RNA, 18 nt, Artificial Sequence
  Description of Artificial Sequence: Synthetic oligonucleotide
cgaagauggccucgugca

SEQ ID NO: 144223 - RNA, 18 nt, Artificial Sequence
  Description of Artificial Sequence: Synthetic oligonucleotide
cauggcgaagauggccuc

SEQ ID NO: 144224 - RNA, 18 nt, Artificial Sequence
  Description of Artificial Sequence: Synthetic oligonucleotide
gccagcauggcgaagaug

SEQ ID NO: 144225 - RNA, 18 nt, Artificial Sequence
  Description of Artificial Sequence: Synthetic oligonucleotide
uagaggccagcauggcga

SEQ ID NO: 144226 - RNA, 18 nt, Artificial Sequence
  Description of Artificial Sequence: Synthetic oligonucleotide
gacgauagaggccagcau

SEQ ID NO: 144227 - RNA, 18 nt, Artificial Sequence
  Description of Artificial Sequence: Synthetic oligonucleotide
uuguugacgauagaggcc

SEQ ID NO: 144228 - RNA, 18 nt, Artificial Sequence
  Description of Artificial Sequence: Synthetic oligonucleotide
cguccuuguugacgauag

SEQ ID NO: 144229 - RNA, 18 nt, Artificial Sequence
  Description of Artificial Sequence: Synthetic oligonucleotide
cagcccguccuuguugac

SEQ ID NO: 144230 - RNA, 18 nt, Artificial Sequence
  Description of Artificial Sequence: Synthetic oligonucleotide
accagcagcccguccuug

SEQ ID NO: 144231 - RNA, 18 nt, Artificial Sequence
  Description of Artificial Sequence: Synthetic oligonucleotide
uggcuaccagcagcccgu

SEQ ID NO: 144232 - RNA, 18 nt, Artificial Sequence
  Description of Artificial Sequence: Synthetic oligonucleotide
gccguuggcuaccagcag

SEQ ID NO: 144233 - RNA, 18 nt, Artificial Sequence
  Description of Artificial Sequence: Synthetic oligonucleotide
ccacugccguuggcuacc

SEQ ID NO: 144234 - RNA, 18 nt, Artificial Sequence
  Description of Artificial Sequence: Synthetic oligonucleotide
caaagccacugccguugg

SEQ ID NO: 144235 - RNA, 18 nt, Artificial Sequence
  Description of Artificial Sequence: Synthetic oligonucleotide
ggugacaaagccacugcc

SEQ ID NO: 144236 - RNA, 18 nt, Artificial Sequence
  Description of Artificial Sequence: Synthetic oligonucleotide
ucacgggugacaaagcca

SEQ ID NO: 144237 - RNA, 18 nt, Artificial Sequence
  Description of Artificial Sequence: Synthetic oligonucleotide
ggaacucacgggugacaa

SEQ ID NO: 144238 - RNA, 18 nt, Artificial Sequence
  Description of Artificial Sequence: Synthetic oligonucleotide
gcgcaggaacucacgggu

SEQ ID NO: 144239 - RNA, 18 nt, Artificial Sequence
  Description of Artificial Sequence: Synthetic oligonucleotide
aggcugcgcaggaacuca

SEQ ID NO: 144240 - RNA, 18 nt, Artificial Sequence
  Description of Artificial Sequence: Synthetic oligonucleotide
ugcggaggcugcgcagga

SEQ ID NO: 144241 - RNA, 18 nt, Artificial Sequence
  Description of Artificial Sequence: Synthetic oligonucleotide
ggguuugcggaggcugcg

SEQ ID NO: 144242 - RNA, 18 nt, Artificial Sequence
  Description of Artificial Sequence: Synthetic oligonucleotide
cugaaggguuugcggagg

SEQ ID NO: 144243 - RNA, 18 nt, Artificial Sequence
  Description of Artificial Sequence: Synthetic oligonucleotide
uaucacugaaggguuugc

SEQ ID NO: 144244 - RNA, 18 nt, Artificial Sequence
  Description of Artificial Sequence: Synthetic oligonucleotide
aaugauaucacugaaggg

SEQ ID NO: 144245 - RNA, 18 nt, Artificial Sequence
  Description of Artificial Sequence: Synthetic oligonucleotide
ggcucaaugauaucacug

SEQ ID NO: 144246 - RNA, 18 nt, Artificial Sequence
  Description of Artificial Sequence: Synthetic oligonucleotide
acuuaggcucaaugauau

SEQ ID NO: 144247 - RNA, 18 nt, Artificial Sequence
  Description of Artificial Sequence: Synthetic oligonucleotide
uucaaacuuaggcucaau

SEQ ID NO: 144248 - RNA, 18 nt, Artificial Sequence
  Description of Artificial Sequence: Synthetic oligonucleotide
gcaaauucaaacuuaggc

SEQ ID NO: 144249 - RNA, 18 nt, Artificial Sequence
  Description of Artificial Sequence: Synthetic oligonucleotide
ugacagcaaauucaaacu

SEQ ID NO: 144250 - RNA, 18 nt, Artificial Sequence
  Description of Artificial Sequence: Synthetic oligonucleotide
gaacuugacagcaaauuc

SEQ ID NO: 144251 - RNA, 18 nt, Artificial Sequence
  Description of Artificial Sequence: Synthetic oligonucleotide
gcguugaacuugacagca

SEQ ID NO: 144252 - RNA, 18 nt, Artificial Sequence
  Description of Artificial Sequence: Synthetic oligonucleotide
ccagggcguugaacuuga

SEQ ID NO: 144253 - RNA, 18 nt, Artificial Sequence
  Description of Artificial Sequence: Synthetic oligonucleotide
aaguuccagggcguugaa

SEQ ID NO: 144254 - RNA, 18 nt, Artificial Sequence
  Description of Artificial Sequence: Synthetic oligonucleotide
ucaucaaguuccagggcg

SEQ ID NO: 144255 - RNA, 18 nt, Artificial Sequence
  Description of Artificial Sequence: Synthetic oligonucleotide
cacugucaucaaguucca

SEQ ID NO: 144256 - RNA, 18 nt, Artificial Sequence
  Description of Artificial Sequence: Synthetic oligonucleotide
caggucacugucaucaag

SEQ ID NO: 144257 - RNA, 18 nt, Artificial Sequence
  Description of Artificial Sequence: Synthetic oligonucleotide
agggccaggucacuguca

SEQ ID NO: 144258 - RNA, 18 nt, Artificial Sequence
  Description of Artificial Sequence: Synthetic oligonucleotide
ugaauagggccaggucac

SEQ ID NO: 144259 - RNA, 18 nt, Artificial Sequence
  Description of Artificial Sequence: Synthetic oligonucleotide
cgcaaugaauagggccag

SEQ ID NO: 144260 - RNA, 18 nt, Artificial Sequence
  Description of Artificial Sequence: Synthetic oligonucleotide
auggccgcaaugaauagg

SEQ ID NO: 144261 - RNA, 18 nt, Artificial Sequence
  Description of Artificial Sequence: Synthetic oligonucleotide
gaaugauggccgcaauga

SEQ ID NO: 144262 - RNA, 18 nt, Artificial Sequence
  Description of Artificial Sequence: Synthetic oligonucleotide
acacagaaugauggccgc

SEQ ID NO: 144263 - RNA, 18 nt, Artificial Sequence
  Description of Artificial Sequence: Synthetic oligonucleotide
ugcccaaaacacuguaca

SEQ ID NO: 144264 - RNA, 18 nt, Artificial Sequence
  Description of Artificial Sequence: Synthetic oligonucleotide
gugcaugcccaaaacacu

SEQ ID NO: 144265 - RNA, 18 nt, Artificial Sequence
  Description of Artificial Sequence: Synthetic oligonucleotide
aucacgugcaugcccaaa

SEQ ID NO: 144266 - RNA, 18 nt, Artificial Sequence
  Description of Artificial Sequence: Synthetic oligonucleotide
ugaguaucacgugcaugc

SEQ ID NO: 144267 - RNA, 18 nt, Artificial Sequence
  Description of Artificial Sequence: Synthetic oligonucleotide
cugugugaguaucacgug

SEQ ID NO: 144268 - RNA, 18 nt, Artificial Sequence
  Description of Artificial Sequence: Synthetic oligonucleotide
agccacugugugaguauc

SEQ ID NO: 144269 - RNA, 18 nt, Artificial Sequence
  Description of Artificial Sequence: Synthetic oligonucleotide
gcagaagccacuguguga

SEQ ID NO: 144270 - RNA, 18 nt, Artificial Sequence
  Description of Artificial Sequence: Synthetic oligonucleotide
ggugagcagaagccacug

SEQ ID NO: 144271 - RNA, 18 nt, Artificial Sequence
  Description of Artificial Sequence: Synthetic oligonucleotide
cuguuggugagcagaagc

SEQ ID NO: 144272 - RNA, 18 nt, Artificial Sequence
  Description of Artificial Sequence: Synthetic oligonucleotide
uucaucuguuggugagca

SEQ ID NO: 144273 - RNA, 18 nt, Artificial Sequence
  Description of Artificial Sequence: Synthetic oligonucleotide
cugucuucaucuguuggu

SEQ ID NO: 144274 - RNA, 18 nt, Artificial Sequence
  Description of Artificial Sequence: Synthetic oligonucleotide
ugcaucugucuucaucug

SEQ ID NO: 144275 - RNA, 18 nt, Artificial Sequence
  Description of Artificial Sequence: Synthetic oligonucleotide
guuggugcaucugucuuc

SEQ ID NO: 144276 - RNA, 18 nt, Artificial Sequence
  Description of Artificial Sequence: Synthetic oligonucleotide
cugaguaaagaaaauggg

SEQ ID NO: 144277 - RNA, 18 nt, Artificial Sequence
  Description of Artificial Sequence: Synthetic oligonucleotide
gaccccugaguaaagaaa

SEQ ID NO: 144278 - RNA, 18 nt, Artificial Sequence
  Description of Artificial Sequence: Synthetic oligonucleotide
ucagagaccccugaguaa

SEQ ID NO: 144279 - RNA, 18 nt, Artificial Sequence
  Description of Artificial Sequence: Synthetic oligonucleotide
gguggucagagaccccug

SEQ ID NO: 144280 - RNA, 18 nt, Artificial Sequence
  Description of Artificial Sequence: Synthetic oligonucleotide
ucagugguggucagagac

SEQ ID NO: 144281 - RNA, 18 nt, Artificial Sequence
  Description of Artificial Sequence: Synthetic oligonucleotide
cugugucaguggugguca

SEQ ID NO: 144282 - RNA, 18 nt, Artificial Sequence
  Description of Artificial Sequence: Synthetic oligonucleotide
ggauccugugucaguggu

SEQ ID NO: 144283 - RNA, 18 nt, Artificial Sequence
  Description of Artificial Sequence: Synthetic oligonucleotide
aaucuggauccuguguca

SEQ ID NO: 144284 - RNA, 18 nt, Artificial Sequence
  Description of Artificial Sequence: Synthetic oligonucleotide
ucuuaaaucuggauccug

SEQ ID NO: 144285 - RNA, 18 nt, Artificial Sequence
  Description of Artificial Sequence: Synthetic oligonucleotide
caggaucuuaaaucugga

SEQ ID NO: 144286 - RNA, 18 nt, Artificial Sequence
  Description of Artificial Sequence: Synthetic oligonucleotide
aaggucaggaucuuaaau

SEQ ID NO: 144287 - RNA, 18 nt, Artificial Sequence
  Description of Artificial Sequence: Synthetic oligonucleotide
ucuucaaggucaggaucu

SEQ ID NO: 144288 - RNA, 18 nt, Artificial Sequence
  Description of Artificial Sequence: Synthetic oligonucleotide
uuucaucuucaaggucag

SEQ ID NO: 144289 - RNA, 18 nt, Artificial Sequence
  Description of Artificial Sequence: Synthetic oligonucleotide
aauuauuucaucuucaag

SEQ ID NO: 144290 - RNA, 18 nt, Artificial Sequence
  Description of Artificial Sequence: Synthetic oligonucleotide
agugaaauuauuucaucu

SEQ ID NO: 144291 - RNA, 18 nt, Artificial Sequence
  Description of Artificial Sequence: Synthetic oligonucleotide
gcccuagugaaauuauuu

SEQ ID NO: 144292 - RNA, 18 nt, Artificial Sequence
  Description of Artificial Sequence: Synthetic oligonucleotide
aauaagcccuagugaaau

SEQ ID NO: 144293 - RNA, 18 nt, Artificial Sequence
  Description of Artificial Sequence: Synthetic oligonucleotide
cugggaauaagcccuagu

SEQ ID NO: 144294 - RNA, 18 nt, Artificial Sequence
  Description of Artificial Sequence: Synthetic oligonucleotide
ggaaucugggaauaagcc

SEQ ID NO: 144295 - RNA, 18 nt, Artificial Sequence
  Description of Artificial Sequence: Synthetic oligonucleotide
aaccuggaaucugggaau

SEQ ID NO: 144296 - RNA, 18 nt, Artificial Sequence
  Description of Artificial Sequence: Synthetic oligonucleotide
acaggaaccuggaaucug

SEQ ID NO: 144297 - RNA, 18 nt, Artificial Sequence
  Description of Artificial Sequence: Synthetic oligonucleotide
cugugacaggaaccugga

SEQ ID NO: 144298 - RNA, 18 nt, Artificial Sequence
  Description of Artificial Sequence: Synthetic oligonucleotide
agaugcugugacaggaac

SEQ ID NO: 144299 - RNA, 18 nt, Artificial Sequence
  Description of Artificial Sequence: Synthetic oligonucleotide
guaccagaugcugugaca

SEQ ID NO: 144300 - RNA, 18 nt, Artificial Sequence
  Description of Artificial Sequence: Synthetic oligonucleotide
aacugguaccagaugcug

SEQ ID NO: 144301 - RNA, 18 nt, Artificial Sequence
  Description of Artificial Sequence: Synthetic oligonucleotide
uaagcaacugguaccaga

SEQ ID NO: 144302 - RNA, 18 nt, Artificial Sequence
  Description of Artificial Sequence: Synthetic oligonucleotide
augcauaagcaacuggua

SEQ ID NO: 144303 - RNA, 18 nt, Artificial Sequence
  Description of Artificial Sequence: Synthetic oligonucleotide
auacuaugcauaagcaac

SEQ ID NO: 144304 - RNA, 18 nt, Artificial Sequence
  Description of Artificial Sequence: Synthetic oligonucleotide
ugccuauacuaugcauaa

SEQ ID NO: 144305 - RNA, 18 nt, Artificial Sequence
  Description of Artificial Sequence: Synthetic oligonucleotide
auaaaugccuauacuaug

SEQ ID NO: 144306 - RNA, 18 nt, Artificial Sequence
  Description of Artificial Sequence: Synthetic oligonucleotide
acuuaauaaaugccuaua

SEQ ID NO: 144307 - RNA, 18 nt, Artificial Sequence
  Description of Artificial Sequence: Synthetic oligonucleotide
uaauuacuuaauaaaugc

SEQ ID NO: 144308 - RNA, 18 nt, Artificial Sequence
  Description of Artificial Sequence: Synthetic oligonucleotide
uucaauaauuacuuaaua

SEQ ID NO: 144309 - RNA, 18 nt, Artificial Sequence
  Description of Artificial Sequence: Synthetic oligonucleotide
agacuuucaauaauuacu

SEQ ID NO: 144310 - RNA, 18 nt, Artificial Sequence
  Description of Artificial Sequence: Synthetic oligonucleotide
gccauagacuuucaauaa

SEQ ID NO: 144311 - RNA, 18 nt, Artificial Sequence
  Description of Artificial Sequence: Synthetic oligonucleotide
uguaagccauagacuuuc

SEQ ID NO: 144312 - RNA, 18 nt, Artificial Sequence
  Description of Artificial Sequence: Synthetic oligonucleotide
aacuauguaagccauaga

SEQ ID NO: 144313 - RNA, 18 nt, Artificial Sequence
  Description of Artificial Sequence: Synthetic oligonucleotide
gaaaaaacuauguaagcc

SEQ ID NO: 144314 - RNA, 18 nt, Artificial Sequence
  Description of Artificial Sequence: Synthetic oligonucleotide
cuccugaaaaaacuaugu

SEQ ID NO: 144315 - RNA, 18 nt, Artificial Sequence
  Description of Artificial Sequence: Synthetic oligonucleotide
ccaugcuccugaaaaaac

SEQ ID NO: 144316 - RNA, 18 nt, Artificial Sequence
  Description of Artificial Sequence: Synthetic oligonucleotide
aaucuccaugcuccugaa

SEQ ID NO: 144317 - RNA, 18 nt, Artificial Sequence
  Description of Artificial Sequence: Synthetic oligonucleotide
gugggaaucuccaugcuc

SEQ ID NO: 144318 - RNA, 18 nt, Artificial Sequence
  Description of Artificial Sequence: Synthetic oligonucleotide
caaaggugggaaucucca

SEQ ID NO: 144319 - RNA, 18 nt, Artificial Sequence
  Description of Artificial Sequence: Synthetic oligonucleotide
gggcgcaaaggugggaau

SEQ ID NO: 144320 - RNA, 18 nt, Artificial Sequence
  Description of Artificial Sequence: Synthetic oligonucleotide
uuaaugggcgcaaaggug

SEQ ID NO: 144321 - RNA, 18 nt, Artificial Sequence
  Description of Artificial Sequence: Synthetic oligonucleotide
aucuuuuaaugggcgcaa

SEQ ID NO: 144322 - RNA, 18 nt, Artificial Sequence
  Description of Artificial Sequence: Synthetic oligonucleotide
aguuuaucuuuuaauggg

SEQ ID NO: 144323 - RNA, 18 nt, Artificial Sequence
  Description of Artificial Sequence: Synthetic oligonucleotide
uguggaguuuaucuuuua

SEQ ID NO: 144324 - RNA, 18 nt, Artificial Sequence
  Description of Artificial Sequence: Synthetic oligonucleotide
ugcccuguggaguuuauc

SEQ ID NO: 144325 - RNA, 18 nt, Artificial Sequence
  Description of Artificial Sequence: Synthetic oligonucleotide
cucccugcccuguggagu

SEQ ID NO: 144326 - RNA, 18 nt, Artificial Sequence
  Description of Artificial Sequence: Synthetic oligonucleotide
aacaacucccugcccugu

SEQ ID NO: 144327 - RNA, 18 nt, Artificial Sequence
  Description of Artificial Sequence: Synthetic oligonucleotide
agcaaaacaacucccugc

SEQ ID NO: 144328 - RNA, 18 nt, Artificial Sequence
  Description of Artificial Sequence: Synthetic oligonucleotide
caggcagcaaaacaacuc

SEQ ID NO: 144329 - RNA, 18 nt, Artificial Sequence
  Description of Artificial Sequence: Synthetic oligonucleotide
cacaacaggcagcaaaac

SEQ ID NO: 144330 - RNA, 18 nt, Artificial Sequence
  Description of Artificial Sequence: Synthetic oligonucleotide
cuagacacaacaggcagc

SEQ ID NO: 144331 - RNA, 18 nt, Artificial Sequence
  Description of Artificial Sequence: Synthetic oligonucleotide
cuauccuagacacaacag

SEQ ID NO: 144332 - RNA, 18 nt, Artificial Sequence
  Description of Artificial Sequence: Synthetic oligonucleotide
aggcacuauccuagacac

SEQ ID NO: 144333 - RNA, 18 nt, Artificial Sequence
  Description of Artificial Sequence: Synthetic oligonucleotide
gugccaggcacuauccua

SEQ ID NO: 144334 - RNA, 18 nt, Artificial Sequence
  Description of Artificial Sequence: Synthetic oligonucleotide
ccucugugccaggcacua

SEQ ID NO: 144335 - RNA, 18 nt, Artificial Sequence
  Description of Artificial Sequence: Synthetic oligonucleotide
uaucuccucugugccagg

SEQ ID NO: 144336 - RNA, 18 nt, Artificial Sequence
  Description of Artificial Sequence: Synthetic oligonucleotide
uucauuaucuccucugug

SEQ ID NO: 144337 - RNA, 18 nt, Artificial Sequence
  Description of Artificial Sequence: Synthetic oligonucleotide
auuuauucauuaucuccu

SEQ ID NO: 144338 - RNA, 18 nt, Artificial Sequence
  Description of Artificial Sequence: Synthetic oligonucleotide
caaaaauuuauucauuau

SEQ ID NO: 144339 - RNA, 18 nt, Artificial Sequence
  Description of Artificial Sequence: Synthetic oligonucleotide
uucaacaaaaauuuauuc

SEQ ID NO: 144340 - RNA, 18 nt, Artificial Sequence
  Description of Artificial Sequence: Synthetic oligonucleotide
acucauucaacaaaaauu

SEQ ID NO: 144341 - RNA, 18 nt, Artificial Sequence
  Description of Artificial Sequence: Synthetic oligonucleotide
cauuuacucauucaacaa

SEQ ID NO: 144342 - RNA, 18 nt, Artificial Sequence
  Description of Artificial Sequence: Synthetic oligonucleotide
ucguucauuuacucauuc

SEQ ID NO: 144343 - RNA, 18 nt, Artificial Sequence
  Description of Artificial Sequence: Synthetic oligonucleotide
aaaguucguucauuuacu

SEQ ID NO: 144344 - RNA, 18 nt, Artificial Sequence
  Description of Artificial Sequence: Synthetic oligonucleotide
agacgaaaguucguucau

SEQ ID NO: 144345 - RNA, 18 nt, Artificial Sequence
  Description of Artificial Sequence: Synthetic oligonucleotide
ggcaaagacgaaaguucg

SEQ ID NO: 144346 - RNA, 18 nt, Artificial Sequence
  Description of Artificial Sequence: Synthetic oligonucleotide
auauaggcaaagacgaaa

SEQ ID NO: 144347 - RNA, 18 nt, Artificial Sequence
  Description of Artificial Sequence: Synthetic oligonucleotide
uacccauauaggcaaaga

SEQ ID NO: 144348 - RNA, 18 nt, Artificial Sequence
  Description of Artificial Sequence: Synthetic oligonucleotide
cuagguacccauauaggc

SEQ ID NO: 144349 - RNA, 18 nt, Artificial Sequence
  Description of Artificial Sequence: Synthetic oligonucleotide
gcacccuagguacccaua

SEQ ID NO: 144350 - RNA, 18 nt, Artificial Sequence
  Description of Artificial Sequence: Synthetic oligonucleotide
gccuggcacccuagguac

SEQ ID NO: 144351 - RNA, 18 nt, Artificial Sequence
  Description of Artificial Sequence: Synthetic oligonucleotide
uuguggccuggcacccua

SEQ ID NO: 144352 - RNA, 18 nt, Artificial Sequence
  Description of Artificial Sequence: Synthetic oligonucleotide
caucuuuguggccuggca

SEQ ID NO: 144353 - RNA, 18 nt, Artificial Sequence
  Description of Artificial Sequence: Synthetic oligonucleotide
gacaccaucuuuguggcc

SEQ ID NO: 144354 - RNA, 18 nt, Artificial Sequence
  Description of Artificial Sequence: Synthetic oligonucleotide
ugauggacaccaucuuug

SEQ ID NO: 144355 - RNA, 18 nt, Artificial Sequence
  Description of Artificial Sequence: Synthetic oligonucleotide
gagaaugauggacaccau

SEQ ID NO: 144356 - RNA, 18 nt, Artificial Sequence
  Description of Artificial Sequence: Synthetic oligonucleotide
uaagagagaaugauggac

SEQ ID NO: 144357 - RNA, 18 nt, Artificial Sequence
  Description of Artificial Sequence: Synthetic oligonucleotide
ccuaauaagagagaauga

SEQ ID NO: 144358 - RNA, 18 nt, Artificial Sequence
  Description of Artificial Sequence: Synthetic oligonucleotide
ugcccccuaauaagagag

SEQ ID NO: 144359 - RNA, 18 nt, Artificial Sequence
  Description of Artificial Sequence: Synthetic oligonucleotide
auauuugcccccuaauaa

SEQ ID NO: 144360 - RNA, 18 nt, Artificial Sequence
  Description of Artificial Sequence: Synthetic oligonucleotide
uauauauauuugcccccu

SEQ ID NO: 144361 - RNA, 18 nt, Artificial Sequence
  Description of Artificial Sequence: Synthetic oligonucleotide
auauauauauauauuugc

SEQ ID NO: 144362 - RNA, 18 nt, Artificial Sequence
  Description of Artificial Sequence: Synthetic oligonucleotide
uauauauauauauauaua

SEQ ID NO: 144363 - RNA, 18 nt, Artificial Sequence
  Description of Artificial Sequence: Synthetic oligonucleotide
caaaauauauauauauau

SEQ ID NO: 144364 - RNA, 18 nt, Artificial Sequence
  Description of Artificial Sequence: Synthetic oligonucleotide
acaaacaaaauauauaua

SEQ ID NO: 144365 - RNA, 18 nt, Artificial Sequence
  Description of Artificial Sequence: Synthetic oligonucleotide
aacaaacaaacaaaauau

SEQ ID NO: 144366 - RNA, 18 nt, Artificial Sequence
  Description of Artificial Sequence: Synthetic oligonucleotide
aaacaaacaaacaaacaa

SEQ ID NO: 144367 - RNA, 18 nt, Artificial Sequence
  Description of Artificial Sequence: Synthetic oligonucleotide
cucaaaaacaaacaaaca

SEQ ID NO: 144368 - RNA, 18 nt, Artificial Sequence
  Description of Artificial Sequence: Synthetic oligonucleotide
uucgucucaaaaacaaac

SEQ ID NO: 144369 - RNA, 18 nt, Artificial Sequence
  Description of Artificial Sequence: Synthetic oligonucleotide
aagacuucgucucaaaaa

SEQ ID NO: 144370 - RNA, 18 nt, Artificial Sequence
  Description of Artificial Sequence: Synthetic oligonucleotide
agagcaagacuucgucuc

SEQ ID NO: 144371 - RNA, 18 nt, Artificial Sequence
  Description of Artificial Sequence: Synthetic oligonucleotide
ggacaagagcaagacuuc

SEQ ID NO: 144372 - RNA, 18 nt, Artificial Sequence
  Description of Artificial Sequence: Synthetic oligonucleotide
gggacaagagcaagacuu

SEQ ID NO: 144373 - RNA, 18 nt, Artificial Sequence
  Description of Artificial Sequence: Synthetic oligonucleotide
auugcacuccagucuggg

SEQ ID NO: 144374 - RNA, 18 nt, Artificial Sequence
  Description of Artificial Sequence: Synthetic oligonucleotide
cacaggaaguucuauucu

SEQ ID NO: 144375 - RNA, 18 nt, Artificial Sequence
  Description of Artificial Sequence: Synthetic oligonucleotide
ucccccacaggaaguucu

SEQ ID NO: 144376 - RNA, 18 nt, Artificial Sequence
  Description of Artificial Sequence: Synthetic oligonucleotide
caccaucccccacaggaa

SEQ ID NO: 144377 - RNA, 18 nt, Artificial Sequence
  Description of Artificial Sequence: Synthetic oligonucleotide
cuccccaccaucccccac

SEQ ID NO: 144378 - RNA, 18 nt, Artificial Sequence
  Description of Artificial Sequence: Synthetic oligonucleotide
cuagccuccccaccaucc

SEQ ID NO: 144379 - RNA, 18 nt, Artificial Sequence
  Description of Artificial Sequence: Synthetic oligonucleotide
cagagcuagccuccccac

SEQ ID NO: 144380 - RNA, 18 nt, Artificial Sequence
  Description of Artificial Sequence: Synthetic oligonucleotide
cucugcagagcuagccuc

SEQ ID NO: 144381 - RNA, 18 nt, Artificial Sequence
  Description of Artificial Sequence: Synthetic oligonucleotide
uagaccucugcagagcua

SEQ ID NO: 144382 - RNA, 18 nt, Artificial Sequence
  Description of Artificial Sequence: Synthetic oligonucleotide
gacuguagaccucugcag

SEQ ID NO: 144383 - RNA, 18 nt, Artificial Sequence
  Description of Artificial Sequence: Synthetic oligonucleotide
ugcaggacuguagaccuc

SEQ ID NO: 144384 - RNA, 18 nt, Artificial Sequence
  Description of Artificial Sequence: Synthetic oligonucleotide
gaaacugcaggacuguag

SEQ ID NO: 144385 - RNA, 18 nt, Artificial Sequence
  Description of Artificial Sequence: Synthetic oligonucleotide
uugcagaaacugcaggac

SEQ ID NO: 144386 - RNA, 18 nt, Artificial Sequence
  Description of Artificial Sequence: Synthetic oligonucleotide
guguuuugcagaaacugc

SEQ ID NO: 144387 - RNA, 18 nt, Artificial Sequence
  Description of Artificial Sequence: Synthetic oligonucleotide
gcaacguguuuugcagaa

SEQ ID NO: 144388 - RNA, 18 nt, Artificial Sequence
  Description of Artificial Sequence: Synthetic oligonucleotide
ugugugcaacguguuuug

SEQ ID NO: 144389 - RNA, 18 nt, Artificial Sequence
  Description of Artificial Sequence: Synthetic oligonucleotide
ggagaugugugcaacgug

SEQ ID NO: 144390 - RNA, 18 nt, Artificial Sequence
  Description of Artificial Sequence: Synthetic oligonucleotide
cauauggagaugugugca

SEQ ID NO: 144391 - RNA, 18 nt, Artificial Sequence
  Description of Artificial Sequence: Synthetic oligonucleotide
uggcccauauggagaugu

SEQ ID NO: 144392 - RNA, 18 nt, Artificial Sequence
  Description of Artificial Sequence: Synthetic oligonucleotide
ccguguggcccauaugga

SEQ ID NO: 144393 - RNA, 18 nt, Artificial Sequence
  Description of Artificial Sequence: Synthetic oligonucleotide
ugccaccguguggcccau

SEQ ID NO: 144394 - RNA, 18 nt, Artificial Sequence
  Description of Artificial Sequence: Synthetic oligonucleotide
gagguugccaccgugugg

SEQ ID NO: 144395 - RNA, 18 nt, Artificial Sequence
  Description of Artificial Sequence: Synthetic oligonucleotide
guucagagguugccaccg

SEQ ID NO: 144396 - RNA, 18 nt, Artificial Sequence
  Description of Artificial Sequence: Synthetic oligonucleotide
uccugguucagagguugc

SEQ ID NO: 144397 - RNA, 18 nt, Artificial Sequence
  Description of Artificial Sequence: Synthetic oligonucleotide
agcucuccugguucagag

SEQ ID NO: 144398 - RNA, 18 nt, Artificial Sequence
  Description of Artificial Sequence: Synthetic oligonucleotide
gaagcagcucuccugguu

SEQ ID NO: 144399 - RNA, 18 nt, Artificial Sequence
  Description of Artificial Sequence: Synthetic oligonucleotide
cuuaggaagcagcucucc

SEQ ID NO: 144400 - RNA, 18 nt, Artificial Sequence
  Description of Artificial Sequence: Synthetic oligonucleotide
uagcccuuaggaagcagc

SEQ ID NO: 144401 - RNA, 18 nt, Artificial Sequence
  Description of Artificial Sequence: Synthetic oligonucleotide
ggucuuagcccuuaggaa

SEQ ID NO: 144402 - RNA, 18 nt, Artificial Sequence
  Description of Artificial Sequence: Synthetic oligonucleotide
cagagggucuuagcccuu

SEQ ID NO: 144403 - RNA, 18 nt, Artificial Sequence
  Description of Artificial Sequence: Synthetic oligonucleotide
gcagacagagggucuuag

SEQ ID NO: 144404 - RNA, 18 nt, Artificial Sequence
  Description of Artificial Sequence: Synthetic oligonucleotide
agaaagcagacagagggu

SEQ ID NO: 144405 - RNA, 18 nt, Artificial Sequence
  Description of Artificial Sequence: Synthetic oligonucleotide
gagagagaaagcagacag

SEQ ID NO: 144406 - RNA, 18 nt, Artificial Sequence
  Description of Artificial Sequence: Synthetic oligonucleotide
agcaagagagagaaagca

SEQ ID NO: 144407 - RNA, 18 nt, Artificial Sequence
  Description of Artificial Sequence: Synthetic oligonucleotide
aggaaagcaagagagaga

SEQ ID NO: 144408 - RNA, 18 nt, Artificial Sequence
  Description of Artificial Sequence: Synthetic oligonucleotide
uugggaggaaagcaagag

SEQ ID NO: 144409 - RNA, 18 nt, Artificial Sequence
  Description of Artificial Sequence: Synthetic oligonucleotide
guguuuugggaggaaagc

SEQ ID NO: 144410 - RNA, 18 nt, Artificial Sequence
  Description of Artificial Sequence: Synthetic oligonucleotide
uggcuguguuuugggagg

SEQ ID NO: 144411 - RNA, 18 nt, Artificial Sequence
  Description of Artificial Sequence: Synthetic oligonucleotide
gaggauggcuguguuuug

SEQ ID NO: 144412 - RNA, 18 nt, Artificial Sequence
  Description of Artificial Sequence: Synthetic oligonucleotide
gggaggaggauggcugug

SEQ ID NO: 144413 - RNA, 18 nt, Artificial Sequence
  Description of Artificial Sequence: Synthetic oligonucleotide
ggcugaacucaccauggg

SEQ ID NO: 144414 - RNA, 18 nt, Artificial Sequence
  Description of Artificial Sequence: Synthetic oligonucleotide
ugggcugaacucaccaug

SEQ ID NO: 144415 - RNA, 18 nt, Artificial Sequence
  Description of Artificial Sequence: Synthetic oligonucleotide
cuuccugggcugaacuca

SEQ ID NO: 144416 - RNA, 18 nt, Artificial Sequence
  Description of Artificial Sequence: Synthetic oligonucleotide
agaggcuuccugggcuga

SEQ ID NO: 144417 - RNA, 18 nt, Artificial Sequence
  Description of Artificial Sequence: Synthetic oligonucleotide
gggucagaggcuuccugg

SEQ ID NO: 144418 - RNA, 18 nt, Artificial Sequence
  Description of Artificial Sequence: Synthetic oligonucleotide
gggcugggucagaggcuu

SEQ ID NO: 144419 - RNA, 18 nt, Artificial Sequence
  Description of Artificial Sequence: Synthetic oligonucleotide
caucagggcugggucaga

SEQ ID NO: 144420 - RNA, 18 nt, Artificial Sequence
  Description of Artificial Sequence: Synthetic oligonucleotide
auuaccaucagggcuggg

SEQ ID NO: 144421 - RNA, 18 nt, Artificial Sequence
  Description of Artificial Sequence: Synthetic oligonucleotide
cagcuauuaccaucaggg

SEQ ID NO: 144422 - RNA, 18 nt, Artificial Sequence
  Description of Artificial Sequence: Synthetic oligonucleotide
cacagcagcuauuaccau

SEQ ID NO: 144423 - RNA, 18 nt, Artificial Sequence
  Description of Artificial Sequence: Synthetic oligonucleotide
caguacacagcagcuauu

SEQ ID NO: 144424 - RNA, 18 nt, Artificial Sequence
  Description of Artificial Sequence: Synthetic oligonucleotide
auguccaguacacagcag

SEQ ID NO: 144425 - RNA, 18 nt, Artificial Sequence
  Description of Artificial Sequence: Synthetic oligonucleotide
agaagauguccaguacac

SEQ ID NO: 144426 - RNA, 18 nt, Artificial Sequence
  Description of Artificial Sequence: Synthetic oligonucleotide
cauacagaagauguccag

SEQ ID NO: 144427 - RNA, 18 nt, Artificial Sequence
  Description of Artificial Sequence: Synthetic oligonucleotide
ccuaacauacagaagaug

SEQ ID NO: 144428 - RNA, 18 nt, Artificial Sequence
  Description of Artificial Sequence: Synthetic oligonucleotide
cagagccuaacauacaga

SEQ ID NO: 144429 - RNA, 18 nt, Artificial Sequence
  Description of Artificial Sequence: Synthetic oligonucleotide
ucucccagagccuaacau

SEQ ID NO: 144430 - RNA, 18 nt, Artificial Sequence
  Description of Artificial Sequence: Synthetic oligonucleotide
gcauuucucccagagccu

SEQ ID NO: 144431 - RNA, 18 nt, Artificial Sequence
  Description of Artificial Sequence: Synthetic oligonucleotide
ccacagcauuucucccag

SEQ ID NO: 144432 - RNA, 18 nt, Artificial Sequence
  Description of Artificial Sequence: Synthetic oligonucleotide
agucuccacagcauuucu

SEQ ID NO: 144433 - RNA, 18 nt, Artificial Sequence
  Description of Artificial Sequence: Synthetic oligonucleotide
caaaaagucuccacagca

SEQ ID NO: 144434 - RNA, 18 nt, Artificial Sequence
  Description of Artificial Sequence: Synthetic oligonucleotide
augggcaaaaagucucca

SEQ ID NO: 144435 - RNA, 18 nt, Artificial Sequence
  Description of Artificial Sequence: Synthetic oligonucleotide
ggaggaugggcaaaaagu

SEQ ID NO: 144436 - RNA, 18 nt, Artificial Sequence
  Description of Artificial Sequence: Synthetic oligonucleotide
cucugggaggaugggcaa

SEQ ID NO: 144437 - RNA, 18 nt, Artificial Sequence
  Description of Artificial Sequence: Synthetic oligonucleotide
agcuucucugggaggaug

SEQ ID NO: 144438 - RNA, 18 nt, Artificial Sequence
  Description of Artificial Sequence: Synthetic oligonucleotide
cugacagcuucucuggga

SEQ ID NO: 144439 - RNA, 18 nt, Artificial Sequence
  Description of Artificial Sequence: Synthetic oligonucleotide
ggguacugacagcuucuc

SEQ ID NO: 144440 - RNA, 18 nt, Artificial Sequence
  Description of Artificial Sequence: Synthetic oligonucleotide
ucuucaccuagaacaggg

SEQ ID NO: 144441 - RNA, 18 nt, Artificial Sequence
  Description of Artificial Sequence: Synthetic oligonucleotide
guuucuucaccuagaaca

SEQ ID NO: 144442 - RNA, 18 nt, Artificial Sequence
  Description of Artificial Sequence: Synthetic oligonucleotide
gaccaguuucuucaccua

SEQ ID NO: 144443 - RNA, 18 nt, Artificial Sequence
  Description of Artificial Sequence: Synthetic oligonucleotide
cugaggaccaguuucuuc

SEQ ID NO: 144444 - RNA, 18 nt, Artificial Sequence
  Description of Artificial Sequence: Synthetic oligonucleotide
ccuuucugaggaccaguu

SEQ ID NO: 144445 - RNA, 18 nt, Artificial Sequence
  Description of Artificial Sequence: Synthetic oligonucleotide
gucaaccuuucugaggac

SEQ ID NO: 144446 - RNA, 18 nt, Artificial Sequence
  Description of Artificial Sequence: Synthetic oligonucleotide
agggagucaaccuuucug

SEQ ID NO: 144447 - RNA, 18 nt, Artificial Sequence
  Description of Artificial Sequence: Synthetic oligonucleotide
gccucagggagucaaccu

SEQ ID NO: 144448 - RNA, 18 nt, Artificial Sequence
  Description of Artificial Sequence: Synthetic oligonucleotide
guguggccucagggaguc

SEQ ID NO: 144449 - RNA, 18 nt, Artificial Sequence
  Description of Artificial Sequence: Synthetic oligonucleotide
cagcuguguggccucagg

SEQ ID NO: 144450 - RNA, 18 nt, Artificial Sequence
  Description of Artificial Sequence: Synthetic oligonucleotide
cuuaacagcuguguggcc

SEQ ID NO: 144451 - RNA, 18 nt, Artificial Sequence
  Description of Artificial Sequence: Synthetic oligonucleotide
agccacuuaacagcugug

SEQ ID NO: 144452 - RNA, 18 nt, Artificial Sequence
  Description of Artificial Sequence: Synthetic oligonucleotide
gccucagccacuuaacag

SEQ ID NO: 144453 - RNA, 18 nt, Artificial Sequence
  Description of Artificial Sequence: Synthetic oligonucleotide
cccucgccucagccacuu

SEQ ID NO: 144454 - RNA, 18 nt, Artificial Sequence
  Description of Artificial Sequence: Synthetic oligonucleotide
cacagcccucgccucagc

SEQ ID NO: 144455 - RNA, 18 nt, Artificial Sequence
  Description of Artificial Sequence: Synthetic oligonucleotide
agccccacagcccucgcc

SEQ ID NO: 144456 - RNA, 18 nt, Artificial Sequence
  Description of Artificial Sequence: Synthetic oligonucleotide
ggaacagccccacagccc

SEQ ID NO: 144457 - RNA, 18 nt, Artificial Sequence
  Description of Artificial Sequence: Synthetic oligonucleotide
gcgugggaacagccccac

SEQ ID NO: 144458 - RNA, 18 nt, Artificial Sequence
  Description of Artificial Sequence: Synthetic oligonucleotide
ccagggcgugggaacagc

SEQ ID NO: 144459 - RNA, 18 nt, Artificial Sequence
  Description of Artificial Sequence: Synthetic oligonucleotide
ggaagccagggcguggga

SEQ ID NO: 144460 - RNA, 18 nt, Artificial Sequence
  Description of Artificial Sequence: Synthetic oligonucleotide
ggccuggaagccagggcg

SEQ ID NO: 144461 - RNA, 18 nt, Artificial Sequence
  Description of Artificial Sequence: Synthetic oligonucleotide
ugccaggccuggaagcca

SEQ ID NO: 144462 - RNA, 18 nt, Artificial Sequence
  Description of Artificial Sequence: Synthetic oligonucleotide
caugcugccaggccugga

SEQ ID NO: 144463 - RNA, 18 nt, Artificial Sequence
  Description of Artificial Sequence: Synthetic oligonucleotide
cuccacaugcugccaggc

SEQ ID NO: 144464 - RNA, 18 nt, Artificial Sequence
  Description of Artificial Sequence: Synthetic oligonucleotide
ggcagcuccacaugcugc

SEQ ID NO: 144465 - RNA, 18 nt, Artificial Sequence
  Description of Artificial Sequence: Synthetic oligonucleotide
gaggagcuccgggagagg

SEQ ID NO: 144466 - RNA, 18 nt, Artificial Sequence
  Description of Artificial Sequence: Synthetic oligonucleotide
guggcgaggagcuccggg

SEQ ID NO: 144467 - RNA, 18 nt, Artificial Sequence
  Description of Artificial Sequence: Synthetic oligonucleotide
ugaggguggcgaggagcu

SEQ ID NO: 144468 - RNA, 18 nt, Artificial Sequence
  Description of Artificial Sequence: Synthetic oligonucleotide
agcagugaggguggcgag

SEQ ID NO: 144469 - RNA, 18 nt, Artificial Sequence
  Description of Artificial Sequence: Synthetic oligonucleotide
gguccagcagugagggug

SEQ ID NO: 144470 - RNA, 18 nt, Artificial Sequence
  Description of Artificial Sequence: Synthetic oligonucleotide
caguugguccagcaguga

SEQ ID NO: 144471 - RNA, 18 nt, Artificial Sequence
  Description of Artificial Sequence: Synthetic oligonucleotide
aucugcaguugguccagc

SEQ ID NO: 144472 - RNA, 18 nt, Artificial Sequence
  Description of Artificial Sequence: Synthetic oligonucleotide
agcccaucugcaguuggu

SEQ ID NO: 144473 - RNA, 18 nt, Artificial Sequence
  Description of Artificial Sequence: Synthetic oligonucleotide
gucacagcccaucugcag

SEQ ID NO: 144474 - RNA, 18 nt, Artificial Sequence
  Description of Artificial Sequence: Synthetic oligonucleotide
gccccgucacagcccauc

SEQ ID NO: 144475 - RNA, 18 nt, Artificial Sequence
  Description of Artificial Sequence: Synthetic oligonucleotide
augaggccccgucacagc

SEQ ID NO: 144476 - RNA, 18 nt, Artificial Sequence
  Description of Artificial Sequence: Synthetic oligonucleotide
gccgcaugaggccccguc

SEQ ID NO: 144477 - RNA, 18 nt, Artificial Sequence
  Description of Artificial Sequence: Synthetic oligonucleotide
aggcugccgcaugaggcc

SEQ ID NO: 144478 - RNA, 18 nt, Artificial Sequence
  Description of Artificial Sequence: Synthetic oligonucleotide
uguugaggcugccgcaug

SEQ ID NO: 144479 - RNA, 18 nt, Artificial Sequence
  Description of Artificial Sequence: Synthetic oligonucleotide
cuccauguugaggcugcc

SEQ ID NO: 144480 - RNA, 18 nt, Artificial Sequence
  Description of Artificial Sequence: Synthetic oligonucleotide
cggcacuccauguugagg

SEQ ID NO: 144481 - RNA, 18 nt, Artificial Sequence
  Description of Artificial Sequence: Synthetic oligonucleotide
acacccggcacuccaugu

SEQ ID NO: 144482 - RNA, 18 nt, Artificial Sequence
  Description of Artificial Sequence: Synthetic oligonucleotide
cccgcacacccggcacuc

SEQ ID NO: 144483 - RNA, 18 nt, Artificial Sequence
  Description of Artificial Sequence: Synthetic oligonucleotide
uuguccccgcacacccgg

SEQ ID NO: 144484 - RNA, 18 nt, Artificial Sequence
  Description of Artificial Sequence: Synthetic oligonucleotide
augccuuguccccgcaca

SEQ ID NO: 144485 - RNA, 18 nt, Artificial Sequence
  Description of Artificial Sequence: Synthetic oligonucleotide
gcccgaugccuugucccc

SEQ ID NO: 144486 - RNA, 18 nt, Artificial Sequence
  Description of Artificial Sequence: Synthetic oligonucleotide
uggaagcccgaugccuug

SEQ ID NO: 144487 - RNA, 18 nt, Artificial Sequence
  Description of Artificial Sequence: Synthetic oligonucleotide
cguaguggaagcccgaug

SEQ ID NO: 144488 - RNA, 18 nt, Artificial Sequence
  Description of Artificial Sequence: Synthetic oligonucleotide
aacaccguaguggaagcc

SEQ ID NO: 144489 - RNA, 18 nt, Artificial Sequence
  Description of Artificial Sequence: Synthetic oligonucleotide
gcaugaacaccguagugg

SEQ ID NO: 144490 - RNA, 18 nt, Artificial Sequence
  Description of Artificial Sequence: Synthetic oligonucleotide
cacaugcaugaacaccgu

SEQ ID NO: 144491 - RNA, 18 nt, Artificial Sequence
  Description of Artificial Sequence: Synthetic oligonucleotide
ccccucacaugcaugaac

SEQ ID NO: 144492 - RNA, 18 nt, Artificial Sequence
  Description of Artificial Sequence: Synthetic oligonucleotide
uugcaccccucacaugca

SEQ ID NO: 144493 - RNA, 18 nt, Artificial Sequence
  Description of Artificial Sequence: Synthetic oligonucleotide
ggcgaggagcuccgggag

SEQ ID NO: 144494 - RNA, 18 nt, Artificial Sequence
  Description of Artificial Sequence: Synthetic oligonucleotide
aggguggcgaggagcucc

SEQ ID NO: 144495 - RNA, 18 nt, Artificial Sequence
  Description of Artificial Sequence: Synthetic oligonucleotide
cagugaggguggcgagga

SEQ ID NO: 144496 - RNA, 18 nt, Artificial Sequence
  Description of Artificial Sequence: Synthetic oligonucleotide
uccagcagugaggguggc

SEQ ID NO: 144497 - RNA, 18 nt, Artificial Sequence
  Description of Artificial Sequence: Synthetic oligonucleotide
guugguccagcagugagg

SEQ ID NO: 144498 - RNA, 18 nt, Artificial Sequence
  Description of Artificial Sequence: Synthetic oligonucleotide
cugcaguugguccagcag

SEQ ID NO: 144499 - RNA, 18 nt, Artificial Sequence
  Description of Artificial Sequence: Synthetic oligonucleotide
cccaucugcaguuggucc

SEQ ID NO: 144500 - RNA, 18 nt, Artificial Sequence
  Description of Artificial Sequence: Synthetic oligonucleotide
cacagcccaucugcaguu

SEQ ID NO: 144501 - RNA, 18 nt, Artificial Sequence
  Description of Artificial Sequence: Synthetic oligonucleotide
cccgucacagcccaucug

SEQ ID NO: 144502 - RNA, 18 nt, Artificial Sequence
  Description of Artificial Sequence: Synthetic oligonucleotide
gaggccccgucacagccc

SEQ ID NO: 144503 - RNA, 18 nt, Artificial Sequence
  Description of Artificial Sequence: Synthetic oligonucleotide
cgcaugaggccccgucac

SEQ ID NO: 144504 - RNA, 18 nt, Artificial Sequence
  Description of Artificial Sequence: Synthetic oligonucleotide
gcugccgcaugaggcccc

SEQ ID NO: 144505 - RNA, 18 nt, Artificial Sequence
  Description of Artificial Sequence: Synthetic oligonucleotide
uugaggcugccgcaugag

SEQ ID NO: 144506 - RNA, 18 nt, Artificial Sequence
  Description of Artificial Sequence: Synthetic oligonucleotide
ccauguugaggcugccgc

SEQ ID NO: 144507 - RNA, 18 nt, Artificial Sequence
  Description of Artificial Sequence: Synthetic oligonucleotide
gcacuccauguugaggcu

SEQ ID NO: 144508 - RNA, 18 nt, Artificial Sequence
  Description of Artificial Sequence: Synthetic oligonucleotide
acccggcacuccauguug

SEQ ID NO: 144509 - RNA, 18 nt, Artificial Sequence
  Description of Artificial Sequence: Synthetic oligonucleotide
cgcacacccggcacucca

SEQ ID NO: 144510 - RNA, 18 nt, Artificial Sequence
  Description of Artificial Sequence: Synthetic oligonucleotide
guccccgcacacccggca

SEQ ID NO: 144511 - RNA, 18 nt, Artificial Sequence
  Description of Artificial Sequence: Synthetic oligonucleotide
gccuuguccccgcacacc

SEQ ID NO: 144512 - RNA, 18 nt, Artificial Sequence
  Description of Artificial Sequence: Synthetic oligonucleotide
ccgaugccuuguccccgc

SEQ ID NO: 144513 - RNA, 18 nt, Artificial Sequence
  Description of Artificial Sequence: Synthetic oligonucleotide
gaagcccgaugccuuguc

SEQ ID NO: 144514 - RNA, 18 nt, Artificial Sequence
  Description of Artificial Sequence: Synthetic oligonucleotide
uaguggaagcccgaugcc

SEQ ID NO: 144515 - RNA, 18 nt, Artificial Sequence
  Description of Artificial Sequence: Synthetic oligonucleotide
caccguaguggaagcccg

SEQ ID NO: 144516 - RNA, 18 nt, Artificial Sequence
  Description of Artificial Sequence: Synthetic oligonucleotide
augaacaccguaguggaa

SEQ ID NO: 144517 - RNA, 18 nt, Artificial Sequence
  Description of Artificial Sequence: Synthetic oligonucleotide
caugcaugaacaccguag

SEQ ID NO: 144518 - RNA, 18 nt, Artificial Sequence
  Description of Artificial Sequence: Synthetic oligonucleotide
ccucacaugcaugaacac

SEQ ID NO: 144519 - RNA, 18 nt, Artificial Sequence
  Description of Artificial Sequence: Synthetic oligonucleotide
gcaccccucacaugcaug

SEQ ID NO: 144520 - RNA, 18 nt, Artificial Sequence
  Description of Artificial Sequence: Synthetic oligonucleotide
ccaccgcuccccccaguc

SEQ ID NO: 144521 - RNA, 18 nt, Artificial Sequence
  Description of Artificial Sequence: Synthetic oligonucleotide
gccagccaccgcuccccc

SEQ ID NO: 144522 - RNA, 18 nt, Artificial Sequence
  Description of Artificial Sequence: Synthetic oligonucleotide
caguggccagccaccgcu

SEQ ID NO: 144523 - RNA, 18 nt, Artificial Sequence
  Description of Artificial Sequence: Synthetic oligonucleotide
agccucaguggccagcca

SEQ ID NO: 144524 - RNA, 18 nt, Artificial Sequence
  Description of Artificial Sequence: Synthetic oligonucleotide
accacagccucaguggcc

SEQ ID NO: 144525 - RNA, 18 nt, Artificial Sequence
  Description of Artificial Sequence: Synthetic oligonucleotide
augugaccacagccucag

SEQ ID NO: 144526 - RNA, 18 nt, Artificial Sequence
  Description of Artificial Sequence: Synthetic oligonucleotide
ucaccaugugaccacagc

SEQ ID NO: 144527 - RNA, 18 nt, Artificial Sequence
  Description of Artificial Sequence: Synthetic oligonucleotide
ucaauucaccaugugacc

SEQ ID NO: 144528 - RNA, 18 nt, Artificial Sequence
  Description of Artificial Sequence: Synthetic oligonucleotide
gagggucaauucaccaug

SEQ ID NO: 144529 - RNA, 18 nt, Artificial Sequence
  Description of Artificial Sequence: Synthetic oligonucleotide
uuguggagggucaauuca

SEQ ID NO: 144530 - RNA, 18 nt, Artificial Sequence
  Description of Artificial Sequence: Synthetic oligonucleotide
aagcuuuguggaggguca

SEQ ID NO: 144531 - RNA, 18 nt, Artificial Sequence
  Description of Artificial Sequence: Synthetic oligonucleotide
aaggaaagcuuuguggag

SEQ ID NO: 144532 - RNA, 18 nt, Artificial Sequence
  Description of Artificial Sequence: Synthetic oligonucleotide
aaggcaaggaaagcuuug

SEQ ID NO: 144533 - RNA, 18 nt, Artificial Sequence
  Description of Artificial Sequence: Synthetic oligonucleotide
accccaaggcaaggaaag

SEQ ID NO: 144534 - RNA, 18 nt, Artificial Sequence
  Description of Artificial Sequence: Synthetic oligonucleotide
gccccaccccaaggcaag

SEQ ID NO: 144535 - RNA, 18 nt, Artificial Sequence
  Description of Artificial Sequence: Synthetic oligonucleotide
ucagggccccaccccaag

SEQ ID NO: 144536 - RNA, 18 nt, Artificial Sequence
  Description of Artificial Sequence: Synthetic oligonucleotide
uacagucagggccccacc

SEQ ID NO: 144537 - RNA, 18 nt, Artificial Sequence
  Description of Artificial Sequence: Synthetic oligonucleotide
auagguacagucagggcc

SEQ ID NO: 144538 - RNA, 18 nt, Artificial Sequence
  Description of Artificial Sequence: Synthetic oligonucleotide
cugcaauagguacaguca

SEQ ID NO: 144539 - RNA, 18 nt, Artificial Sequence
  Description of Artificial Sequence: Synthetic oligonucleotide
gaauucugcaauagguac

SEQ ID NO: 144540 - RNA, 18 nt, Artificial Sequence
  Description of Artificial Sequence: Synthetic oligonucleotide
ggcaggaauucugcaaua

SEQ ID NO: 144541 - RNA, 18 nt, Artificial Sequence
  Description of Artificial Sequence: Synthetic oligonucleotide
uccugggcaggaauucug

SEQ ID NO: 144542 - RNA, 18 nt, Artificial Sequence
  Description of Artificial Sequence: Synthetic oligonucleotide
cugccuccugggcaggaa

SEQ ID NO: 144543 - RNA, 18 nt, Artificial Sequence
  Description of Artificial Sequence: Synthetic oligonucleotide
ccuggcugccuccugggc

SEQ ID NO: 144544 - RNA, 18 nt, Artificial Sequence
  Description of Artificial Sequence: Synthetic oligonucleotide
aagggccuggcugccucc

SEQ ID NO: 144545 - RNA, 18 nt, Artificial Sequence
  Description of Artificial Sequence: Synthetic oligonucleotide
agcacaagggccuggcug

SEQ ID NO: 144546 - RNA, 18 nt, Artificial Sequence
  Description of Artificial Sequence: Synthetic oligonucleotide
ucuggagcacaagggccu

SEQ ID NO: 144547 - RNA, 18 nt, Artificial Sequence
  Description of Artificial Sequence: Synthetic oligonucleotide
ugaggucuggagcacaag

SEQ ID NO: 144548 - RNA, 18 nt, Artificial Sequence
  Description of Artificial Sequence: Synthetic oligonucleotide
agagcugaggucuggagc

SEQ ID NO: 144549 - RNA, 18 nt, Artificial Sequence
  Description of Artificial Sequence: Synthetic oligonucleotide
ugcccagagcugaggucu

SEQ ID NO: 144550 - RNA, 18 nt, Artificial Sequence
  Description of Artificial Sequence: Synthetic oligonucleotide
ugcagugcccagagcuga

SEQ ID NO: 144551 - RNA, 18 nt, Artificial Sequence
  Description of Artificial Sequence: Synthetic oligonucleotide
ucuccugcagugcccaga

SEQ ID NO: 144552 - RNA, 18 nt, Artificial Sequence
  Description of Artificial Sequence: Synthetic oligonucleotide
ccucuucuccugcagugc

SEQ ID NO: 144553 - RNA, 18 nt, Artificial Sequence
  Description of Artificial Sequence: Synthetic oligonucleotide
aacccccucuucuccugc

SEQ ID NO: 144554 - RNA, 18 nt, Artificial Sequence
  Description of Artificial Sequence: Synthetic oligonucleotide
aagggaacccccucuucu

SEQ ID NO: 144555 - RNA, 18 nt, Artificial Sequence
  Description of Artificial Sequence: Synthetic oligonucleotide
uugacaagggaacccccu

SEQ ID NO: 144556 - RNA, 18 nt, Artificial Sequence
  Description of Artificial Sequence: Synthetic oligonucleotide
uaggcuugacaagggaac

SEQ ID NO: 144557 - RNA, 18 nt, Artificial Sequence
  Description of Artificial Sequence: Synthetic oligonucleotide
caggguaggcuugacaag

SEQ ID NO: 144558 - RNA, 18 nt, Artificial Sequence
  Description of Artificial Sequence: Synthetic oligonucleotide
cccagcaggguaggcuug

SEQ ID NO: 144559 - RNA, 18 nt, Artificial Sequence
  Description of Artificial Sequence: Synthetic oligonucleotide
aggugcccagcaggguag

SEQ ID NO: 144560 - RNA, 18 nt, Artificial Sequence
  Description of Artificial Sequence: Synthetic oligonucleotide
aacacaggugcccagcag

SEQ ID NO: 144561 - RNA, 18 nt, Artificial Sequence
  Description of Artificial Sequence: Synthetic oligonucleotide
gggucaacacaggugccc

SEQ ID NO: 144562 - RNA, 18 nt, Artificial Sequence
  Description of Artificial Sequence: Synthetic oligonucleotide
gagcugggucaacacagg

SEQ ID NO: 144563 - RNA, 18 nt, Artificial Sequence
  Description of Artificial Sequence: Synthetic oligonucleotide
ccacagagcugggucaac

SEQ ID NO: 144564 - RNA, 18 nt, Artificial Sequence
  Description of Artificial Sequence: Synthetic oligonucleotide
aucacccacagagcuggg

SEQ ID NO: 144565 - RNA, 18 nt, Artificial Sequence
  Description of Artificial Sequence: Synthetic oligonucleotide
acacaaucacccacagag

SEQ ID NO: 144566 - RNA, 18 nt, Artificial Sequence
  Description of Artificial Sequence: Synthetic oligonucleotide
gggacacaaucacccaca

SEQ ID NO: 144567 - RNA, 18 nt, Artificial Sequence
  Description of Artificial Sequence: Synthetic oligonucleotide
gcugccugguccccaggg

SEQ ID NO: 144568 - RNA, 18 nt, Artificial Sequence
  Description of Artificial Sequence: Synthetic oligonucleotide
cccuagcugccugguccc

SEQ ID NO: 144569 - RNA, 18 nt, Artificial Sequence
  Description of Artificial Sequence: Synthetic oligonucleotide
uucugcccuagcugccug

SEQ ID NO: 144570 - RNA, 18 nt, Artificial Sequence
  Description of Artificial Sequence: Synthetic oligonucleotide
ccucauucugcccuagcu

SEQ ID NO: 144571 - RNA, 18 nt, Artificial Sequence
  Description of Artificial Sequence: Synthetic oligonucleotide
aagacccucauucugccc

SEQ ID NO: 144572 - RNA, 18 nt, Artificial Sequence
  Description of Artificial Sequence: Synthetic oligonucleotide
agcccaagacccucauuc

SEQ ID NO: 144573 - RNA, 18 nt, Artificial Sequence
  Description of Artificial Sequence: Synthetic oligonucleotide
ggcucagcccaagacccu

SEQ ID NO: 144574 - RNA, 18 nt, Artificial Sequence
  Description of Artificial Sequence: Synthetic oligonucleotide
acgauggcucagcccaag

SEQ ID NO: 144575 - RNA, 18 nt, Artificial Sequence
  Description of Artificial Sequence: Synthetic oligonucleotide
guaagacgauggcucagc

SEQ ID NO: 144576 - RNA, 18 nt, Artificial Sequence
  Description of Artificial Sequence: Synthetic oligonucleotide
cucagguaagacgauggc

SEQ ID NO: 144577 - RNA, 18 nt, Artificial Sequence
  Description of Artificial Sequence: Synthetic oligonucleotide
cagaccucagguaagacg

SEQ ID NO: 144578 - RNA, 18 nt, Artificial Sequence
  Description of Artificial Sequence: Synthetic oligonucleotide
aaacccagaccucaggua

SEQ ID NO: 144579 - RNA, 18 nt, Artificial Sequence
  Description of Artificial Sequence: Synthetic oligonucleotide
acaagaaacccagaccuc

SEQ ID NO: 144580 - RNA, 18 nt, Artificial Sequence
  Description of Artificial Sequence: Synthetic oligonucleotide
gagaaacaagaaacccag

SEQ ID NO: 144581 - RNA, 18 nt, Artificial Sequence
  Description of Artificial Sequence: Synthetic oligonucleotide
gccuugagaaacaagaaa

SEQ ID NO: 144582 - RNA, 18 nt, Artificial Sequence
  Description of Artificial Sequence: Synthetic oligonucleotide
uuugagccuugagaaaca

SEQ ID NO: 144583 - RNA, 18 nt, Artificial Sequence
  Description of Artificial Sequence: Synthetic oligonucleotide
cccgcuuugagccuugag

SEQ ID NO: 144584 - RNA, 18 nt, Artificial Sequence
  Description of Artificial Sequence: Synthetic oligonucleotide
cagagcccgcuuugagcc

SEQ ID NO: 144585 - RNA, 18 nt, Artificial Sequence
  Description of Artificial Sequence: Synthetic oligonucleotide
uuucucagagcccgcuuu

SEQ ID NO: 144586 - RNA, 18 nt, Artificial Sequence
  Description of Artificial Sequence: Synthetic oligonucleotide
ccuuuuuucucagagccc

SEQ ID NO: 144587 - RNA, 18 nt, Artificial Sequence
  Description of Artificial Sequence: Synthetic oligonucleotide
ucuguccuuuuuucucag

SEQ ID NO: 144588 - RNA, 18 nt, Artificial Sequence
  Description of Artificial Sequence: Synthetic oligonucleotide
aaaugucuguccuuuuuu

SEQ ID NO: 144589 - RNA, 18 nt, Artificial Sequence
  Description of Artificial Sequence: Synthetic oligonucleotide
aaaacaaaugucuguccu

SEQ ID NO: 144590 - RNA, 18 nt, Artificial Sequence
  Description of Artificial Sequence: Synthetic oligonucleotide
cuggaaaaacaaaugucu

SEQ ID NO: 144591 - RNA, 18 nt, Artificial Sequence
  Description of Artificial Sequence: Synthetic oligonucleotide
uaucacuggaaaaacaaa

SEQ ID NO: 144592 - RNA, 18 nt, Artificial Sequence
  Description of Artificial Sequence: Synthetic oligonucleotide
acaaauaucacuggaaaa

SEQ ID NO: 144593 - RNA, 18 nt, Artificial Sequence
  Description of Artificial Sequence: Synthetic oligonucleotide
gacccacaaauaucacug

SEQ ID NO: 144594 - RNA, 18 nt, Artificial Sequence
  Description of Artificial Sequence: Synthetic oligonucleotide
ggaaggacccacaaauau

SEQ ID NO: 144595 - RNA, 18 nt, Artificial Sequence
  Description of Artificial Sequence: Synthetic oligonucleotide
aguuaggaaggacccaca

SEQ ID NO: 144596 - RNA, 18 nt, Artificial Sequence
  Description of Artificial Sequence: Synthetic oligonucleotide
ugugaaguuaggaaggac

SEQ ID NO: 144597 - RNA, 18 nt, Artificial Sequence
  Description of Artificial Sequence: Synthetic oligonucleotide
augggugugaaguuagga

SEQ ID NO: 144598 - RNA, 18 nt, Artificial Sequence
  Description of Artificial Sequence: Synthetic oligonucleotide
uuuugaugggugugaagu

SEQ ID NO: 144599 - RNA, 18 nt, Artificial Sequence
  Description of Artificial Sequence: Synthetic oligonucleotide
ugagauuuugaugggugu

SEQ ID NO: 144600 - RNA, 18 nt, Artificial Sequence
  Description of Artificial Sequence: Synthetic oligonucleotide
aucugugagauuuugaug

SEQ ID NO: 144601 - RNA, 18 nt, Artificial Sequence
  Description of Artificial Sequence: Synthetic oligonucleotide
aaauaaucugugagauuu

SEQ ID NO: 144602 - RNA, 18 nt, Artificial Sequence
  Description of Artificial Sequence: Synthetic oligonucleotide
caauaaaauaaucuguga

SEQ ID NO: 144603 - RNA, 18 nt, Artificial Sequence
  Description of Artificial Sequence: Synthetic oligonucleotide
ugauucaauaaaauaauc

SEQ ID NO: 144604 - RNA, 18 nt, Artificial Sequence
  Description of Artificial Sequence: Synthetic oligonucleotide
gguggugauucaauaaaa

SEQ ID NO: 144605 - RNA, 18 nt, Artificial Sequence
  Description of Artificial Sequence: Synthetic oligonucleotide
ugugagguggugauucaa

SEQ ID NO: 144606 - RNA, 18 nt, Artificial Sequence
  Description of Artificial Sequence: Synthetic oligonucleotide
guauuugugaggugguga

SEQ ID NO: 144607 - RNA, 18 nt, Artificial Sequence
  Description of Artificial Sequence: Synthetic oligonucleotide
ucuguguauuugugaggu

SEQ ID NO: 144608 - RNA, 18 nt, Artificial Sequence
  Description of Artificial Sequence: Synthetic oligonucleotide
cugguucuguguauuugu

SEQ ID NO: 144609 - RNA, 18 nt, Artificial Sequence
  Description of Artificial Sequence: Synthetic oligonucleotide
uguaucugguucugugua

SEQ ID NO: 144610 - RNA, 18 nt, Artificial Sequence
  Description of Artificial Sequence: Synthetic oligonucleotide
auaaauguaucugguucu

SEQ ID NO: 144611 - RNA, 18 nt, Artificial Sequence
  Description of Artificial Sequence: Synthetic oligonucleotide
ucuucauaaauguaucug

SEQ ID NO: 144612 - RNA, 18 nt, Artificial Sequence
  Description of Artificial Sequence: Synthetic oligonucleotide
ugauuucuucauaaaugu

SEQ ID NO: 144613 - RNA, 18 nt, Artificial Sequence
  Description of Artificial Sequence: Synthetic oligonucleotide
uaacuugauuucuucaua

SEQ ID NO: 144614 - RNA, 18 nt, Artificial Sequence
  Description of Artificial Sequence: Synthetic oligonucleotide
acggcuaacuugauuucu

SEQ ID NO: 144615 - RNA, 18 nt, Artificial Sequence
  Description of Artificial Sequence: Synthetic oligonucleotide
gucucacggcuaacuuga

SEQ ID NO: 144616 - RNA, 18 nt, Artificial Sequence
  Description of Artificial Sequence: Synthetic oligonucleotide
agauugucucacggcuaa

SEQ ID NO: 144617 - RNA, 18 nt, Artificial Sequence
  Description of Artificial Sequence: Synthetic oligonucleotide
aacaaaaaaaaaacacaa

SEQ ID NO: 144618 - RNA, 18 nt, Artificial Sequence
  Description of Artificial Sequence: Synthetic oligonucleotide
aacaaaacaaaaaaaaaa

SEQ ID NO: 144619 - RNA, 18 nt, Artificial Sequence
  Description of Artificial Sequence: Synthetic oligonucleotide
aacaaaacaaaacaaaaa

SEQ ID NO: 144620 - RNA, 18 nt, Artificial Sequence
  Description of Artificial Sequence: Synthetic oligonucleotide
aauaaaacaaaacaaaac

SEQ ID NO: 144621 - RNA, 18 nt, Artificial Sequence
  Description of Artificial Sequence: Synthetic oligonucleotide
aacaaaauaaaacaaaac

SEQ ID NO: 144622 - RNA, 18 nt, Artificial Sequence
  Description of Artificial Sequence: Synthetic oligonucleotide
aacaaaacaaaauaaaac

SEQ ID NO: 144623 - RNA, 18 nt, Artificial Sequence
  Description of Artificial Sequence: Synthetic oligonucleotide
aacaaaacaaaacaaaau

SEQ ID NO: 144624 - RNA, 18 nt, Artificial Sequence
  Description of Artificial Sequence: Synthetic oligonucleotide
cucaaaacaaaacaaaac

SEQ ID NO: 144625 - RNA, 18 nt, Artificial Sequence
  Description of Artificial Sequence: Synthetic oligonucleotide
uccaucucaaaacaaaac

SEQ ID NO: 144626 - RNA, 18 nt, Artificial Sequence
  Description of Artificial Sequence: Synthetic oligonucleotide
gaaacuccaucucaaaac

SEQ ID NO: 144627 - RNA, 18 nt, Artificial Sequence
  Description of Artificial Sequence: Synthetic oligonucleotide
agagugaaacuccaucuc

SEQ ID NO: 144628 - RNA, 18 nt, Artificial Sequence
  Description of Artificial Sequence: Synthetic oligonucleotide
caacaagagugaaacucc

SEQ ID NO: 144629 - RNA, 18 nt, Artificial Sequence
  Description of Artificial Sequence: Synthetic oligonucleotide
cuggacaacaagagugaa

SEQ ID NO: 144630 - RNA, 18 nt, Artificial Sequence
  Description of Artificial Sequence: Synthetic oligonucleotide
ccagccuggacaacaaga

SEQ ID NO: 144631 - RNA, 18 nt, Artificial Sequence
  Description of Artificial Sequence: Synthetic oligonucleotide
acacuccagccuggacaa

SEQ ID NO: 144632 - RNA, 18 nt, Artificial Sequence
  Description of Artificial Sequence: Synthetic oligonucleotide
ccauuacacuccagccug

SEQ ID NO: 144633 - RNA, 18 nt, Artificial Sequence
  Description of Artificial Sequence: Synthetic oligonucleotide
ucgcgccauuacacucca

SEQ ID NO: 144634 - RNA, 18 nt, Artificial Sequence
  Description of Artificial Sequence: Synthetic oligonucleotide
caagaucgcgccauuaca

SEQ ID NO: 144635 - RNA, 18 nt, Artificial Sequence
  Description of Artificial Sequence: Synthetic oligonucleotide
ucagccaagaucgcgcca

SEQ ID NO: 144636 - RNA, 18 nt, Artificial Sequence
  Description of Artificial Sequence: Synthetic oligonucleotide
ugcagucagccaagaucg

SEQ ID NO: 144637 - RNA, 18 nt, Artificial Sequence
  Description of Artificial Sequence: Synthetic oligonucleotide
gagguugcagucagccaa

SEQ ID NO: 144638 - RNA, 18 nt, Artificial Sequence
  Description of Artificial Sequence: Synthetic oligonucleotide
agguggagguugcaguca

SEQ ID NO: 144639 - RNA, 18 nt, Artificial Sequence
  Description of Artificial Sequence: Synthetic oligonucleotide
ccgggagguggagguugc

SEQ ID NO: 144640 - RNA, 18 nt, Artificial Sequence
  Description of Artificial Sequence: Synthetic oligonucleotide
ugaacccgggagguggag

SEQ ID NO: 144641 - RNA, 18 nt, Artificial Sequence
  Description of Artificial Sequence: Synthetic oligonucleotide
ucgcuugaacccgggagg

SEQ ID NO: 144642 - RNA, 18 nt, Artificial Sequence
  Description of Artificial Sequence: Synthetic oligonucleotide
gggaaucgcuugaacccg

SEQ ID NO: 144643 - RNA, 18 nt, Artificial Sequence
  Description of Artificial Sequence: Synthetic oligonucleotide
caggaggcugaggcaggg

SEQ ID NO: 144644 - RNA, 18 nt, Artificial Sequence
  Description of Artificial Sequence: Synthetic oligonucleotide
ucaggaggcugaggcagg

SEQ ID NO: 144645 - RNA, 18 nt, Artificial Sequence
  Description of Artificial Sequence: Synthetic oligonucleotide
gcuacucaggaggcugag

SEQ ID NO: 144646 - RNA, 18 nt, Artificial Sequence
  Description of Artificial Sequence: Synthetic oligonucleotide
ucccagcuacucaggagg

SEQ ID NO: 144647 - RNA, 18 nt, Artificial Sequence
  Description of Artificial Sequence: Synthetic oligonucleotide
uguaaucccagcuacuca

SEQ ID NO: 144648 - RNA, 18 nt, Artificial Sequence
  Description of Artificial Sequence: Synthetic oligonucleotide
accccuguaaucccagcu

SEQ ID NO: 144649 - RNA, 18 nt, Artificial Sequence
  Description of Artificial Sequence: Synthetic oligonucleotide
ggcacaccccuguaaucc

SEQ ID NO: 144650 - RNA, 18 nt, Artificial Sequence
  Description of Artificial Sequence: Synthetic oligonucleotide
guaguggcacaccccugu

SEQ ID NO: 144651 - RNA, 18 nt, Artificial Sequence
  Description of Artificial Sequence: Synthetic oligonucleotide
uggguguaguggcacacc

SEQ ID NO: 144652 - RNA, 18 nt, Artificial Sequence
  Description of Artificial Sequence: Synthetic oligonucleotide
uuagcuggguguaguggc

SEQ ID NO: 144653 - RNA, 18 nt, Artificial Sequence
  Description of Artificial Sequence: Synthetic oligonucleotide
aaaaauuagcugggugua

SEQ ID NO: 144654 - RNA, 18 nt, Artificial Sequence
  Description of Artificial Sequence: Synthetic oligonucleotide
uacagaaaaauuagcugg

SEQ ID NO: 144655 - RNA, 18 nt, Artificial Sequence
  Description of Artificial Sequence: Synthetic oligonucleotide
aaaaauacagaaaaauua

SEQ ID NO: 144656 - RNA, 18 nt, Artificial Sequence
  Description of Artificial Sequence: Synthetic oligonucleotide
cuacuaaaaauacagaaa

SEQ ID NO: 144657 - RNA, 18 nt, Artificial Sequence
  Description of Artificial Sequence: Synthetic oligonucleotide
cgucucuacuaaaaauac

SEQ ID NO: 144658 - RNA, 18 nt, Artificial Sequence
  Description of Artificial Sequence: Synthetic oligonucleotide
aaccccgucucuacuaaa

SEQ ID NO: 144659 - RNA, 18 nt, Artificial Sequence
  Description of Artificial Sequence: Synthetic oligonucleotide
ggugaaaccccgucucua

SEQ ID NO: 144660 - RNA, 18 nt, Artificial Sequence
  Description of Artificial Sequence: Synthetic oligonucleotide
aacauggugaaaccccgu

SEQ ID NO: 144661 - RNA, 18 nt, Artificial Sequence
  Description of Artificial Sequence: Synthetic oligonucleotide
uggccaacauggugaaac

SEQ ID NO: 144662 - RNA, 18 nt, Artificial Sequence
  Description of Artificial Sequence: Synthetic oligonucleotide
cagccuggccaacauggu

SEQ ID NO: 144663 - RNA, 18 nt, Artificial Sequence
  Description of Artificial Sequence: Synthetic oligonucleotide
gagaccagccuggccaac

SEQ ID NO: 144664 - RNA, 18 nt, Artificial Sequence
  Description of Artificial Sequence: Synthetic oligonucleotide
aguuugagaccagccugg

SEQ ID NO: 144665 - RNA, 18 nt, Artificial Sequence
  Description of Artificial Sequence: Synthetic oligonucleotide
ucaggaguuugagaccag

SEQ ID NO: 144666 - RNA, 18 nt, Artificial Sequence
  Description of Artificial Sequence: Synthetic oligonucleotide
ugaggucaggaguuugag

SEQ ID NO: 144667 - RNA, 18 nt, Artificial Sequence
  Description of Artificial Sequence: Synthetic oligonucleotide
ucaccugaggucaggagu

SEQ ID NO: 144668 - RNA, 18 nt, Artificial Sequence
  Description of Artificial Sequence: Synthetic oligonucleotide
gcggaucaccugagguca

SEQ ID NO: 144669 - RNA, 18 nt, Artificial Sequence
  Description of Artificial Sequence: Synthetic oligonucleotide
ggugggcggaucaccuga

SEQ ID NO: 144670 - RNA, 18 nt, Artificial Sequence
  Description of Artificial Sequence: Synthetic oligonucleotide
gccgaggugggcggauca

SEQ ID NO: 144671 - RNA, 18 nt, Artificial Sequence
  Description of Artificial Sequence: Synthetic oligonucleotide
gagaggccgaggugggcg

SEQ ID NO: 144672 - RNA, 18 nt, Artificial Sequence
  Description of Artificial Sequence: Synthetic oligonucleotide
acuuugagaggccgaggu

SEQ ID NO: 144673 - RNA, 18 nt, Artificial Sequence
  Description of Artificial Sequence: Synthetic oligonucleotide
ccagcacuuugagaggcc

SEQ ID NO: 144674 - RNA, 18 nt, Artificial Sequence
  Description of Artificial Sequence: Synthetic oligonucleotide
uaaucccagcacuuugag

SEQ ID NO: 144675 - RNA, 18 nt, Artificial Sequence
  Description of Artificial Sequence: Synthetic oligonucleotide
gccuguaaucccagcacu

SEQ ID NO: 144676 - RNA, 18 nt, Artificial Sequence
  Description of Artificial Sequence: Synthetic oligonucleotide
cucacgccuguaauccca

SEQ ID NO: 144677 - RNA, 18 nt, Artificial Sequence
  Description of Artificial Sequence: Synthetic oligonucleotide
aguggcucacgccuguaa

SEQ ID NO: 144678 - RNA, 18 nt, Artificial Sequence
  Description of Artificial Sequence: Synthetic oligonucleotide
ggcacaguggcucacgcc

SEQ ID NO: 144679 - RNA, 18 nt, Artificial Sequence
  Description of Artificial Sequence: Synthetic oligonucleotide
guucaggcacaguggcuc

SEQ ID NO: 144680 - RNA, 18 nt, Artificial Sequence
  Description of Artificial Sequence: Synthetic oligonucleotide
uuuuaguucaggcacagu

SEQ ID NO: 144681 - RNA, 18 nt, Artificial Sequence
  Description of Artificial Sequence: Synthetic oligonucleotide
aacuauuuuaguucaggc

SEQ ID NO: 144682 - RNA, 18 nt, Artificial Sequence
  Description of Artificial Sequence: Synthetic oligonucleotide
auuaaaacuauuuuaguu

SEQ ID NO: 144683 - RNA, 18 nt, Artificial Sequence
  Description of Artificial Sequence: Synthetic oligonucleotide
cuuuaauuaaaacuauuu

SEQ ID NO: 144684 - RNA, 18 nt, Artificial Sequence
  Description of Artificial Sequence: Synthetic oligonucleotide
uaaaacuuuaauuaaaac

SEQ ID NO: 144685 - RNA, 18 nt, Artificial Sequence
  Description of Artificial Sequence: Synthetic oligonucleotide
aauucuaaaacuuuaauu

SEQ ID NO: 144686 - RNA, 18 nt, Artificial Sequence
  Description of Artificial Sequence: Synthetic oligonucleotide
aaaguaauucuaaaacuu

SEQ ID NO: 144687 - RNA, 18 nt, Artificial Sequence
  Description of Artificial Sequence: Synthetic oligonucleotide
gaaggaaaguaauucuaa

SEQ ID NO: 144688 - RNA, 18 nt, Artificial Sequence
  Description of Artificial Sequence: Synthetic oligonucleotide
auggagaaggaaaguaau

SEQ ID NO: 144689 - RNA, 18 nt, Artificial Sequence
  Description of Artificial Sequence: Synthetic oligonucleotide
gggagauggagaaggaaa

SEQ ID NO: 144690 - RNA, 18 nt, Artificial Sequence
  Description of Artificial Sequence: Synthetic oligonucleotide
agaaauuuuuuuggaggg

SEQ ID NO: 144691 - RNA, 18 nt, Artificial Sequence
  Description of Artificial Sequence: Synthetic oligonucleotide
gagaagaaauuuuuuugg

SEQ ID NO: 144692 - RNA, 18 nt, Artificial Sequence
  Description of Artificial Sequence: Synthetic oligonucleotide
guaacgagaagaaauuuu

SEQ ID NO: 144693 - RNA, 18 nt, Artificial Sequence
  Description of Artificial Sequence: Synthetic oligonucleotide
uggaaguaacgagaagaa

SEQ ID NO: 144694 - RNA, 18 nt, Artificial Sequence
  Description of Artificial Sequence: Synthetic oligonucleotide
acauuuggaaguaacgag

SEQ ID NO: 144695 - RNA, 18 nt, Artificial Sequence
  Description of Artificial Sequence: Synthetic oligonucleotide
uccugacauuuggaagua

SEQ ID NO: 144696 - RNA, 18 nt, Artificial Sequence
  Description of Artificial Sequence: Synthetic oligonucleotide
aacacuccugacauuugg

SEQ ID NO: 144697 - RNA, 18 nt, Artificial Sequence
  Description of Artificial Sequence: Synthetic oligonucleotide
guguaaacacuccugaca

SEQ ID NO: 144698 - RNA, 18 nt, Artificial Sequence
  Description of Artificial Sequence: Synthetic oligonucleotide
auaagguguaaacacucc

SEQ ID NO: 144699 - RNA, 18 nt, Artificial Sequence
  Description of Artificial Sequence: Synthetic oligonucleotide
uauguauaagguguaaac

SEQ ID NO: 144700 - RNA, 18 nt, Artificial Sequence
  Description of Artificial Sequence: Synthetic oligonucleotide
ccgauuauguauaaggug

SEQ ID NO: 144701 - RNA, 18 nt, Artificial Sequence
  Description of Artificial Sequence: Synthetic oligonucleotide
agggcccgauuauguaua

SEQ ID NO: 144702 - RNA, 18 nt, Artificial Sequence
  Description of Artificial Sequence: Synthetic oligonucleotide
gccaaagggcccgauuau

SEQ ID NO: 144703 - RNA, 18 nt, Artificial Sequence
  Description of Artificial Sequence: Synthetic oligonucleotide
gcugugccaaagggcccg

SEQ ID NO: 144704 - RNA, 18 nt, Artificial Sequence
  Description of Artificial Sequence: Synthetic oligonucleotide
gggaggcugugccaaagg

SEQ ID NO: 144705 - RNA, 18 nt, Artificial Sequence
  Description of Artificial Sequence: Synthetic oligonucleotide
ugggagggaggcugugcc

SEQ ID NO: 144706 - RNA, 18 nt, Artificial Sequence
  Description of Artificial Sequence: Synthetic oligonucleotide
ggaggugggagggaggcu

SEQ ID NO: 144707 - RNA, 18 nt, Artificial Sequence
  Description of Artificial Sequence: Synthetic oligonucleotide
caccaggaggugggaggg

SEQ ID NO: 144708 - RNA, 18 nt, Artificial Sequence
  Description of Artificial Sequence: Synthetic oligonucleotide
aaggccaccaggaggugg

SEQ ID NO: 144709 - RNA, 18 nt, Artificial Sequence
  Description of Artificial Sequence: Synthetic oligonucleotide
gaggaaaggccaccagga

SEQ ID NO: 144710 - RNA, 18 nt, Artificial Sequence
  Description of Artificial Sequence: Synthetic oligonucleotide
caggugaggaaaggccac

SEQ ID NO: 144711 - RNA, 18 nt, Artificial Sequence
  Description of Artificial Sequence: Synthetic oligonucleotide
ucguacgacggaagaagc

SEQ ID NO: 144712 - RNA, 18 nt, Artificial Sequence
  Description of Artificial Sequence: Synthetic oligonucleotide
gcggaucguacgacggaa

SEQ ID NO: 144713 - RNA, 18 nt, Artificial Sequence
  Description of Artificial Sequence: Synthetic oligonucleotide
uucaugcggaucguacga

SEQ ID NO: 144714 - RNA, 18 nt, Artificial Sequence
  Description of Artificial Sequence: Synthetic oligonucleotide
ccagcuucaugcggaucg

SEQ ID NO: 144715 - RNA, 18 nt, Artificial Sequence
  Description of Artificial Sequence: Synthetic oligonucleotide
guacuccagcuucaugcg

SEQ ID NO: 144716 - RNA, 18 nt, Artificial Sequence
  Description of Artificial Sequence: Synthetic oligonucleotide
uucucguacuccagcuuc

SEQ ID NO: 144717 - RNA, 18 nt, Artificial Sequence
  Description of Artificial Sequence: Synthetic oligonucleotide
cacacuucucguacucca

SEQ ID NO: 144718 - RNA, 18 nt, Artificial Sequence
  Description of Artificial Sequence: Synthetic oligonucleotide
gcgcucacacuucucgua

SEQ ID NO: 144719 - RNA, 18 nt, Artificial Sequence
  Description of Artificial Sequence: Synthetic oligonucleotide
cagcugcgcucacacuuc

SEQ ID NO: 144720 - RNA, 18 nt, Artificial Sequence
  Description of Artificial Sequence: Synthetic oligonucleotide
ucuugcagcugcgcucac

SEQ ID NO: 144721 - RNA, 18 nt, Artificial Sequence
  Description of Artificial Sequence: Synthetic oligonucleotide
cugaaucuugcagcugcg

SEQ ID NO: 144722 - RNA, 18 nt, Artificial Sequence
  Description of Artificial Sequence: Synthetic oligonucleotide
uucuucugaaucuugcag

SEQ ID NO: 144723 - RNA, 18 nt, Artificial Sequence
  Description of Artificial Sequence: Synthetic oligonucleotide
gguucuucuucugaaucu

SEQ ID NO: 144724 - RNA, 18 nt, Artificial Sequence
  Description of Artificial Sequence: Synthetic oligonucleotide
guugcgguucuucuucug

SEQ ID NO: 144725 - RNA, 18 nt, Artificial Sequence
  Description of Artificial Sequence: Synthetic oligonucleotide
cacuuguugcgguucuuc

SEQ ID NO: 144726 - RNA, 18 nt, Artificial Sequence
  Description of Artificial Sequence: Synthetic oligonucleotide
acuggcacuuguugcggu

SEQ ID NO: 144727 - RNA, 18 nt, Artificial Sequence
  Description of Artificial Sequence: Synthetic oligonucleotide
gcaguacuggcacuuguu

SEQ ID NO: 144728 - RNA, 18 nt, Artificial Sequence
  Description of Artificial Sequence: Synthetic oligonucleotide
aagcggcaguacuggcac

SEQ ID NO: 144729 - RNA, 18 nt, Artificial Sequence
  Description of Artificial Sequence: Synthetic oligonucleotide
ucuggaagcggcaguacu

SEQ ID NO: 144730 - RNA, 18 nt, Artificial Sequence
  Description of Artificial Sequence: Synthetic oligonucleotide
gcacuucuggaagcggca

SEQ ID NO: 144731 - RNA, 18 nt, Artificial Sequence
  Description of Artificial Sequence: Synthetic oligonucleotide
gccaggcacuucuggaag

SEQ ID NO: 144732 - RNA, 18 nt, Artificial Sequence
  Description of Artificial Sequence: Synthetic oligonucleotide
ccagugccaggcacuucu

SEQ ID NO: 144733 - RNA, 18 nt, Artificial Sequence
  Description of Artificial Sequence: Synthetic oligonucleotide
caugcccagugccaggca

SEQ ID NO: 144734 - RNA, 18 nt, Artificial Sequence
  Description of Artificial Sequence: Synthetic oligonucleotide
ugugacaugcccagugcc

SEQ ID NO: 144735 - RNA, 18 nt, Artificial Sequence
  Description of Artificial Sequence: Synthetic oligonucleotide
cguugugugacaugccca

SEQ ID NO: 144736 - RNA, 18 nt, Artificial Sequence
  Description of Artificial Sequence: Synthetic oligonucleotide
gaucguacgacggaagaa

SEQ ID NO: 144737 - RNA, 18 nt, Artificial Sequence
  Description of Artificial Sequence: Synthetic oligonucleotide
augcggaucguacgacgg

SEQ ID NO: 144738 - RNA, 18 nt, Artificial Sequence
  Description of Artificial Sequence: Synthetic oligonucleotide
gcuucaugcggaucguac

SEQ ID NO: 144739 - RNA, 18 nt, Artificial Sequence
  Description of Artificial Sequence: Synthetic oligonucleotide
cuccagcuucaugcggau

SEQ ID NO: 144740 - RNA, 18 nt, Artificial Sequence
  Description of Artificial Sequence: Synthetic oligonucleotide
ucguacuccagcuucaug

SEQ ID NO: 144741 - RNA, 18 nt, Artificial Sequence
  Description of Artificial Sequence: Synthetic oligonucleotide
acuucucguacuccagcu

SEQ ID NO: 144742 - RNA, 18 nt, Artificial Sequence
  Description of Artificial Sequence: Synthetic oligonucleotide
cucacacuucucguacuc

SEQ ID NO: 144743 - RNA, 18 nt, Artificial Sequence
  Description of Artificial Sequence: Synthetic oligonucleotide
cugcgcucacacuucucg

SEQ ID NO: 144744 - RNA, 18 nt, Artificial Sequence
  Description of Artificial Sequence: Synthetic oligonucleotide
ugcagcugcgcucacacu

SEQ ID NO: 144745 - RNA, 18 nt, Artificial Sequence
  Description of Artificial Sequence: Synthetic oligonucleotide
aaucuugcagcugcgcuc

SEQ ID NO: 144746 - RNA, 18 nt, Artificial Sequence
  Description of Artificial Sequence: Synthetic oligonucleotide
uucugaaucuugcagcug

SEQ ID NO: 144747 - RNA, 18 nt, Artificial Sequence
  Description of Artificial Sequence: Synthetic oligonucleotide
ucuucuucugaaucuugc

SEQ ID NO: 144748 - RNA, 18 nt, Artificial Sequence
  Description of Artificial Sequence: Synthetic oligonucleotide
gcgguucuucuucugaau

SEQ ID NO: 144749 - RNA, 18 nt, Artificial Sequence
  Description of Artificial Sequence: Synthetic oligonucleotide
uuguugcgguucuucuuc

SEQ ID NO: 144750 - RNA, 18 nt, Artificial Sequence
  Description of Artificial Sequence: Synthetic oligonucleotide
ggcacuuguugcgguucu

SEQ ID NO: 144751 - RNA, 18 nt, Artificial Sequence
  Description of Artificial Sequence: Synthetic oligonucleotide
guacuggcacuuguugcg

SEQ ID NO: 144752 - RNA, 18 nt, Artificial Sequence
  Description of Artificial Sequence: Synthetic oligonucleotide
cggcaguacuggcacuug

SEQ ID NO: 144753 - RNA, 18 nt, Artificial Sequence
  Description of Artificial Sequence: Synthetic oligonucleotide
ggaagcggcaguacuggc

SEQ ID NO: 144754 - RNA, 18 nt, Artificial Sequence
  Description of Artificial Sequence: Synthetic oligonucleotide
cuucuggaagcggcagua

SEQ ID NO: 144755 - RNA, 18 nt, Artificial Sequence
  Description of Artificial Sequence: Synthetic oligonucleotide
aggcacuucuggaagcgg

SEQ ID NO: 144756 - RNA, 18 nt, Artificial Sequence
  Description of Artificial Sequence: Synthetic oligonucleotide
gugccaggcacuucugga

SEQ ID NO: 144757 - RNA, 18 nt, Artificial Sequence
  Description of Artificial Sequence: Synthetic oligonucleotide
gcccagugccaggcacuu

SEQ ID NO: 144758 - RNA, 18 nt, Artificial Sequence
  Description of Artificial Sequence: Synthetic oligonucleotide
gacaugcccagugccagg

SEQ ID NO: 144759 - RNA, 18 nt, Artificial Sequence
  Description of Artificial Sequence: Synthetic oligonucleotide
ugugugacaugcccagug

SEQ ID NO: 144760 - RNA, 18 nt, Artificial Sequence
  Description of Artificial Sequence: Synthetic oligonucleotide
gaguugcccuggucagcu

SEQ ID NO: 144761 - RNA, 18 nt, Artificial Sequence
  Description of Artificial Sequence: Synthetic oligonucleotide
cccgugaguugcccuggu

SEQ ID NO: 144762 - RNA, 18 nt, Artificial Sequence
  Description of Artificial Sequence: Synthetic oligonucleotide
agcagcccgugaguugcc

SEQ ID NO: 144763 - RNA, 18 nt, Artificial Sequence
  Description of Artificial Sequence: Synthetic oligonucleotide
gagccagcagcccgugag

SEQ ID NO: 144764 - RNA, 18 nt, Artificial Sequence
  Description of Artificial Sequence: Synthetic oligonucleotide
guguggagccagcagccc

SEQ ID NO: 144765 - RNA, 18 nt, Artificial Sequence
  Description of Artificial Sequence: Synthetic oligonucleotide
aggcuguguggagccagc

SEQ ID NO: 144766 - RNA, 18 nt, Artificial Sequence
  Description of Artificial Sequence: Synthetic oligonucleotide
guuucaggcuguguggag

SEQ ID NO: 144767 - RNA, 18 nt, Artificial Sequence
  Description of Artificial Sequence: Synthetic oligonucleotide
ccuugguuucaggcugug

SEQ ID NO: 144768 - RNA, 18 nt, Artificial Sequence
  Description of Artificial Sequence: Synthetic oligonucleotide
cuggaccuugguuucagg

SEQ ID NO: 144769 - RNA, 18 nt, Artificial Sequence
  Description of Artificial Sequence: Synthetic oligonucleotide
gcucccuggaccuugguu

SEQ ID NO: 144770 - RNA, 18 nt, Artificial Sequence
  Description of Artificial Sequence: Synthetic oligonucleotide
caagggcucccuggaccu

SEQ ID NO: 144771 - RNA, 18 nt, Artificial Sequence
  Description of Artificial Sequence: Synthetic oligonucleotide
ugccccaagggcucccug

SEQ ID NO: 144772 - RNA, 18 nt, Artificial Sequence
  Description of Artificial Sequence: Synthetic oligonucleotide
uaggcugccccaagggcu

SEQ ID NO: 144773 - RNA, 18 nt, Artificial Sequence
  Description of Artificial Sequence: Synthetic oligonucleotide
cccucuaggcugccccaa

SEQ ID NO: 144774 - RNA, 18 nt, Artificial Sequence
  Description of Artificial Sequence: Synthetic oligonucleotide
gugcccccucuaggcugc

SEQ ID NO: 144775 - RNA, 18 nt, Artificial Sequence
  Description of Artificial Sequence: Synthetic oligonucleotide
uacaggugcccccucuag

SEQ ID NO: 144776 - RNA, 18 nt, Artificial Sequence
  Description of Artificial Sequence: Synthetic oligonucleotide
ugcucuacaggugccccc

SEQ ID NO: 144777 - RNA, 18 nt, Artificial Sequence
  Description of Artificial Sequence: Synthetic oligonucleotide
ggcacugcucuacaggug

SEQ ID NO: 144778 - RNA, 18 nt, Artificial Sequence
  Description of Artificial Sequence: Synthetic oligonucleotide
cgccaggcacugcucuac

SEQ ID NO: 144779 - RNA, 18 nt, Artificial Sequence
  Description of Artificial Sequence: Synthetic oligonucleotide
cugugcgccaggcacugc

SEQ ID NO: 144780 - RNA, 18 nt, Artificial Sequence
  Description of Artificial Sequence: Synthetic oligonucleotide
gcuuacugugcgccaggc

SEQ ID NO: 144781 - RNA, 18 nt, Artificial Sequence
  Description of Artificial Sequence: Synthetic oligonucleotide
auggugcuuacugugcgc

SEQ ID NO: 144782 - RNA, 18 nt, Artificial Sequence
  Description of Artificial Sequence: Synthetic oligonucleotide
cagccauggugcuuacug

SEQ ID NO: 144783 - RNA, 18 nt, Artificial Sequence
  Description of Artificial Sequence: Synthetic oligonucleotide
gccaacagccauggugcu

SEQ ID NO: 144784 - RNA, 18 nt, Artificial Sequence
  Description of Artificial Sequence: Synthetic oligonucleotide
caacagccaacagccaug

SEQ ID NO: 144785 - RNA, 18 nt, Artificial Sequence
  Description of Artificial Sequence: Synthetic oligonucleotide
aaagccaacagccaacag

SEQ ID NO: 144786 - RNA, 18 nt, Artificial Sequence
  Description of Artificial Sequence: Synthetic oligonucleotide
ucagcaaagccaacagcc

SEQ ID NO: 144787 - RNA, 18 nt, Artificial Sequence
  Description of Artificial Sequence: Synthetic oligonucleotide
ccagaucagcaaagccaa

SEQ ID NO: 144788 - RNA, 18 nt, Artificial Sequence
  Description of Artificial Sequence: Synthetic oligonucleotide
aagguccagaucagcaaa

SEQ ID NO: 144789 - RNA, 18 nt, Artificial Sequence
  Description of Artificial Sequence: Synthetic oligonucleotide
gauccaagguccagauca

SEQ ID NO: 144790 - RNA, 18 nt, Artificial Sequence
  Description of Artificial Sequence: Synthetic oligonucleotide
ucuaagauccaaggucca

SEQ ID NO: 144791 - RNA, 18 nt, Artificial Sequence
  Description of Artificial Sequence: Synthetic oligonucleotide
uaggcucuaagauccaag

SEQ ID NO: 144792 - RNA, 18 nt, Artificial Sequence
  Description of Artificial Sequence: Synthetic oligonucleotide
ggucuuaggcucuaagau

SEQ ID NO: 144793 - RNA, 18 nt, Artificial Sequence
  Description of Artificial Sequence: Synthetic oligonucleotide
uggcaggucuuaggcucu

SEQ ID NO: 144794 - RNA, 18 nt, Artificial Sequence
  Description of Artificial Sequence: Synthetic oligonucleotide
ggaaguggcaggucuuag

SEQ ID NO: 144795 - RNA, 18 nt, Artificial Sequence
  Description of Artificial Sequence: Synthetic oligonucleotide
ucugaggaaguggcaggu

SEQ ID NO: 144796 - RNA, 18 nt, Artificial Sequence
  Description of Artificial Sequence: Synthetic oligonucleotide
ggcagucugaggaagugg

SEQ ID NO: 144797 - RNA, 18 nt, Artificial Sequence
  Description of Artificial Sequence: Synthetic oligonucleotide
augcuggcagucugagga

SEQ ID NO: 144798 - RNA, 18 nt, Artificial Sequence
  Description of Artificial Sequence: Synthetic oligonucleotide
gguagaugcuggcagucu

SEQ ID NO: 144799 - RNA, 18 nt, Artificial Sequence
  Description of Artificial Sequence: Synthetic oligonucleotide
cccaugguagaugcuggc

SEQ ID NO: 144800 - RNA, 18 nt, Artificial Sequence
  Description of Artificial Sequence: Synthetic oligonucleotide
ugggacccaugguagaug

SEQ ID NO: 144801 - RNA, 18 nt, Artificial Sequence
  Description of Artificial Sequence: Synthetic oligonucleotide
acgccugggacccauggu

SEQ ID NO: 144802 - RNA, 18 nt, Artificial Sequence
  Description of Artificial Sequence: Synthetic oligonucleotide
accccacgccugggaccc

SEQ ID NO: 144803 - RNA, 18 nt, Artificial Sequence
  Description of Artificial Sequence: Synthetic oligonucleotide
acacuaccccacgccugg

SEQ ID NO: 144804 - RNA, 18 nt, Artificial Sequence
  Description of Artificial Sequence: Synthetic oligonucleotide
gguaaacacuaccccacg

SEQ ID NO: 144805 - RNA, 18 nt, Artificial Sequence
  Description of Artificial Sequence: Synthetic oligonucleotide
agggagguaaacacuacc

SEQ ID NO: 144806 - RNA, 18 nt, Artificial Sequence
  Description of Artificial Sequence: Synthetic oligonucleotide
gguauagggagguaaaca

SEQ ID NO: 144807 - RNA, 18 nt, Artificial Sequence
  Description of Artificial Sequence: Synthetic oligonucleotide
ccucagguauagggaggu

SEQ ID NO: 144808 - RNA, 18 nt, Artificial Sequence
  Description of Artificial Sequence: Synthetic oligonucleotide
guaaaccucagguauagg

SEQ ID NO: 144809 - RNA, 18 nt, Artificial Sequence
  Description of Artificial Sequence: Synthetic oligonucleotide
aaugcguaaaccucaggu

SEQ ID NO: 144810 - RNA, 18 nt, Artificial Sequence
  Description of Artificial Sequence: Synthetic oligonucleotide
gccagaaugcguaaaccu

SEQ ID NO: 144811 - RNA, 18 nt, Artificial Sequence
  Description of Artificial Sequence: Synthetic oligonucleotide
ucugggccagaaugcgua

SEQ ID NO: 144812 - RNA, 18 nt, Artificial Sequence
  Description of Artificial Sequence: Synthetic oligonucleotide
ucccuucugggccagaau

SEQ ID NO: 144813 - RNA, 18 nt, Artificial Sequence
  Description of Artificial Sequence: Synthetic oligonucleotide
ucaguucccuucugggcc

SEQ ID NO: 144814 - RNA, 18 nt, Artificial Sequence
  Description of Artificial Sequence: Synthetic oligonucleotide
aauuaucaguucccuucu

SEQ ID NO: 144815 - RNA, 18 nt, Artificial Sequence
  Description of Artificial Sequence: Synthetic oligonucleotide
guaucaauuaucaguucc

SEQ ID NO: 144816 - RNA, 18 nt, Artificial Sequence
  Description of Artificial Sequence: Synthetic oligonucleotide
agcugguaucaauuauca

SEQ ID NO: 144817 - RNA, 18 nt, Artificial Sequence
  Description of Artificial Sequence: Synthetic oligonucleotide
guucaagcugguaucaau

SEQ ID NO: 144818 - RNA, 18 nt, Artificial Sequence
  Description of Artificial Sequence: Synthetic oligonucleotide
aaauuguucaagcuggua

SEQ ID NO: 144819 - RNA, 18 nt, Artificial Sequence
  Description of Artificial Sequence: Synthetic oligonucleotide
uccccaaauuguucaagc

SEQ ID NO: 144820 - RNA, 18 nt, Artificial Sequence
  Description of Artificial Sequence: Synthetic oligonucleotide
gguguuccccaaauuguu

SEQ ID NO: 144821 - RNA, 18 nt, Artificial Sequence
  Description of Artificial Sequence: Synthetic oligonucleotide
ggacugguguuccccaaa

SEQ ID NO: 144822 - RNA, 18 nt, Artificial Sequence
  Description of Artificial Sequence: Synthetic oligonucleotide
uucugggacugguguucc

SEQ ID NO: 144823 - RNA, 18 nt, Artificial Sequence
  Description of Artificial Sequence: Synthetic oligonucleotide
ugaguuucugggacuggu

SEQ ID NO: 144824 - RNA, 18 nt, Artificial Sequence
  Description of Artificial Sequence: Synthetic oligonucleotide
aggcuugaguuucuggga

SEQ ID NO: 144825 - RNA, 18 nt, Artificial Sequence
  Description of Artificial Sequence: Synthetic oligonucleotide
gagacaggcuugaguuuc

SEQ ID NO: 144826 - RNA, 18 nt, Artificial Sequence
  Description of Artificial Sequence: Synthetic oligonucleotide
caucugagacaggcuuga

SEQ ID NO: 144827 - RNA, 18 nt, Artificial Sequence
  Description of Artificial Sequence: Synthetic oligonucleotide
caggucaucugagacagg

SEQ ID NO: 144828 - RNA, 18 nt, Artificial Sequence
  Description of Artificial Sequence: Synthetic oligonucleotide
ugugucaggucaucugag

SEQ ID NO: 144829 - RNA, 18 nt, Artificial Sequence
  Description of Artificial Sequence: Synthetic oligonucleotide
caugcugugucaggucau

SEQ ID NO: 144830 - RNA, 18 nt, Artificial Sequence
  Description of Artificial Sequence: Synthetic oligonucleotide
gcuuucaugcugugucag

SEQ ID NO: 144831 - RNA, 18 nt, Artificial Sequence
  Description of Artificial Sequence: Synthetic oligonucleotide
caguagcuuucaugcugu

SEQ ID NO: 144832 - RNA, 18 nt, Artificial Sequence
  Description of Artificial Sequence: Synthetic oligonucleotide
cuuggcaguagcuuucau

SEQ ID NO: 144833 - RNA, 18 nt, Artificial Sequence
  Description of Artificial Sequence: Synthetic oligonucleotide
cuggccuuggcaguagcu

SEQ ID NO: 144834 - RNA, 18 nt, Artificial Sequence
  Description of Artificial Sequence: Synthetic oligonucleotide
gccaccuggccuuggcag

SEQ ID NO: 144835 - RNA, 18 nt, Artificial Sequence
  Description of Artificial Sequence: Synthetic oligonucleotide
gaagggccaccuggccuu

SEQ ID NO: 144836 - RNA, 18 nt, Artificial Sequence
  Description of Artificial Sequence: Synthetic oligonucleotide
accaagaagggccaccug

SEQ ID NO: 144837 - RNA, 18 nt, Artificial Sequence
  Description of Artificial Sequence: Synthetic oligonucleotide
cuauaaccaagaagggcc

SEQ ID NO: 144838 - RNA, 18 nt, Artificial Sequence
  Description of Artificial Sequence: Synthetic oligonucleotide
gccuucuauaaccaagaa

SEQ ID NO: 144839 - RNA, 18 nt, Artificial Sequence
  Description of Artificial Sequence: Synthetic oligonucleotide
ugccugccuucuauaacc

SEQ ID NO: 144840 - RNA, 18 nt, Artificial Sequence
  Description of Artificial Sequence: Synthetic oligonucleotide
guuacugccugccuucua

SEQ ID NO: 144841 - RNA, 18 nt, Artificial Sequence
  Description of Artificial Sequence: Synthetic oligonucleotide
uacugguuacugccugcc

SEQ ID NO: 144842 - RNA, 18 nt, Artificial Sequence
  Description of Artificial Sequence: Synthetic oligonucleotide
uuacuuacugguuacugc

SEQ ID NO: 144843 - RNA, 18 nt, Artificial Sequence
  Description of Artificial Sequence: Synthetic oligonucleotide
ugugguuacuuacugguu

SEQ ID NO: 144844 - RNA, 18 nt, Artificial Sequence
  Description of Artificial Sequence: Synthetic oligonucleotide
acaaaugugguuacuuac

SEQ ID NO: 144845 - RNA, 18 nt, Artificial Sequence
  Description of Artificial Sequence: Synthetic oligonucleotide
aguugacaaaugugguua

SEQ ID NO: 144846 - RNA, 18 nt, Artificial Sequence
  Description of Artificial Sequence: Synthetic oligonucleotide
cuggcaguugacaaaugu

SEQ ID NO: 144847 - RNA, 18 nt, Artificial Sequence
  Description of Artificial Sequence: Synthetic oligonucleotide
ggcuccuggcaguugaca

SEQ ID NO: 144848 - RNA, 18 nt, Artificial Sequence
  Description of Artificial Sequence: Synthetic oligonucleotide
ugccuggcuccuggcagu

SEQ ID NO: 144849 - RNA, 18 nt, Artificial Sequence
  Description of Artificial Sequence: Synthetic oligonucleotide
acuucugccuggcuccug

SEQ ID NO: 144850 - RNA, 18 nt, Artificial Sequence
  Description of Artificial Sequence: Synthetic oligonucleotide
aagaaacuucugccuggc

SEQ ID NO: 144851 - RNA, 18 nt, Artificial Sequence
  Description of Artificial Sequence: Synthetic oligonucleotide
ccuccaagaaacuucugc

SEQ ID NO: 144852 - RNA, 18 nt, Artificial Sequence
  Description of Artificial Sequence: Synthetic oligonucleotide
ggugaccuccaagaaacu

SEQ ID NO: 144853 - RNA, 18 nt, Artificial Sequence
  Description of Artificial Sequence: Synthetic oligonucleotide
gagugggugaccuccaag

SEQ ID NO: 144854 - RNA, 18 nt, Artificial Sequence
  Description of Artificial Sequence: Synthetic oligonucleotide
ccugggagugggugaccu

SEQ ID NO: 144855 - RNA, 18 nt, Artificial Sequence
  Description of Artificial Sequence: Synthetic oligonucleotide
ugucuccugggagugggu

SEQ ID NO: 144856 - RNA, 18 nt, Artificial Sequence
  Description of Artificial Sequence: Synthetic oligonucleotide
ggcucugucuccugggag

SEQ ID NO: 144857 - RNA, 18 nt, Artificial Sequence
  Description of Artificial Sequence: Synthetic oligonucleotide
gagaaggcucugucuccu

SEQ ID NO: 144858 - RNA, 18 nt, Artificial Sequence
  Description of Artificial Sequence: Synthetic oligonucleotide
gggcagagaaggcucugu

SEQ ID NO: 144859 - RNA, 18 nt, Artificial Sequence
  Description of Artificial Sequence: Synthetic oligonucleotide
aauucucugucucagccu

SEQ ID NO: 144860 - RNA, 18 nt, Artificial Sequence
  Description of Artificial Sequence: Synthetic oligonucleotide
caagcaauucucugucuc

SEQ ID NO: 144861 - RNA, 18 nt, Artificial Sequence
  Description of Artificial Sequence: Synthetic oligonucleotide
ggguucaagcaauucucu

SEQ ID NO: 144862 - RNA, 18 nt, Artificial Sequence
  Description of Artificial Sequence: Synthetic oligonucleotide
cucccggguucaagcaau

SEQ ID NO: 144863 - RNA, 18 nt, Artificial Sequence
  Description of Artificial Sequence: Synthetic oligonucleotide
ucugccucccggguucaa

SEQ ID NO: 144864 - RNA, 18 nt, Artificial Sequence
  Description of Artificial Sequence: Synthetic oligonucleotide
caaccucugccucccggg

SEQ ID NO: 144865 - RNA, 18 nt, Artificial Sequence
  Description of Artificial Sequence: Synthetic oligonucleotide
cacugcaaccucugccuc

SEQ ID NO: 144866 - RNA, 18 nt, Artificial Sequence
  Description of Artificial Sequence: Synthetic oligonucleotide
cggcucacugcaaccucu

SEQ ID NO: 144867 - RNA, 18 nt, Artificial Sequence
  Description of Artificial Sequence: Synthetic oligonucleotide
gaucucggcucacugcaa

SEQ ID NO: 144868 - RNA, 18 nt, Artificial Sequence
  Description of Artificial Sequence: Synthetic oligonucleotide
ggcacgaucucggcucac

SEQ ID NO: 144869 - RNA, 18 nt, Artificial Sequence
  Description of Artificial Sequence: Synthetic oligonucleotide
gcaguggcacgaucucgg

SEQ ID NO: 144870 - RNA, 18 nt, Artificial Sequence
  Description of Artificial Sequence: Synthetic oligonucleotide
ggagugcaguggcacgau

SEQ ID NO: 144871 - RNA, 18 nt, Artificial Sequence
  Description of Artificial Sequence: Synthetic oligonucleotide
aggcuggagugcaguggc

SEQ ID NO: 144872 - RNA, 18 nt, Artificial Sequence
  Description of Artificial Sequence: Synthetic oligonucleotide
cucccaggcuggagugca

SEQ ID NO: 144873 - RNA, 18 nt, Artificial Sequence
  Description of Artificial Sequence: Synthetic oligonucleotide
ucugucucccaggcugga

SEQ ID NO: 144874 - RNA, 18 nt, Artificial Sequence
  Description of Artificial Sequence: Synthetic oligonucleotide
cucgcucugucucccagg

SEQ ID NO: 144875 - RNA, 18 nt, Artificial Sequence
  Description of Artificial Sequence: Synthetic oligonucleotide
agagucucgcucugucuc

SEQ ID NO: 144876 - RNA, 18 nt, Artificial Sequence
  Description of Artificial Sequence: Synthetic oligonucleotide
gagacagagucucgcucu

SEQ ID NO: 144877 - RNA, 18 nt, Artificial Sequence
  Description of Artificial Sequence: Synthetic oligonucleotide
uuuuugagacagagucuc

SEQ ID NO: 144878 - RNA, 18 nt, Artificial Sequence
  Description of Artificial Sequence: Synthetic oligonucleotide
uuuuuuuuuugagacaga

SEQ ID NO: 144879 - RNA, 18 nt, Artificial Sequence
  Description of Artificial Sequence: Synthetic oligonucleotide
ucuuuuuuuuuuuuugag

SEQ ID NO: 144880 - RNA, 18 nt, Artificial Sequence
  Description of Artificial Sequence: Synthetic oligonucleotide
ucuuuucuuuuuuuuuuu

SEQ ID NO: 144881 - RNA, 18 nt, Artificial Sequence
  Description of Artificial Sequence: Synthetic oligonucleotide
cuuuuucuuuucuuuuuu

SEQ ID NO: 144882 - RNA, 18 nt, Artificial Sequence
  Description of Artificial Sequence: Synthetic oligonucleotide
cuuuucuuuuucuuuucu

SEQ ID NO: 144883 - RNA, 18 nt, Artificial Sequence
  Description of Artificial Sequence: Synthetic oligonucleotide
cuucacuuuucuuuuucu

SEQ ID NO: 144884 - RNA, 18 nt, Artificial Sequence
  Description of Artificial Sequence: Synthetic oligonucleotide
gacuccuucacuuuucuu

SEQ ID NO: 144885 - RNA, 18 nt, Artificial Sequence
  Description of Artificial Sequence: Synthetic oligonucleotide
gggcagacuccuucacuu

SEQ ID NO: 144886 - RNA, 18 nt, Artificial Sequence
  Description of Artificial Sequence: Synthetic oligonucleotide
cuagcuuugugacuuggg

SEQ ID NO: 144887 - RNA, 18 nt, Artificial Sequence
  Description of Artificial Sequence: Synthetic oligonucleotide
uacuagcuuugugacuug

SEQ ID NO: 144888 - RNA, 18 nt, Artificial Sequence
  Description of Artificial Sequence: Synthetic oligonucleotide
caguuuacuagcuuugug

SEQ ID NO: 144889 - RNA, 18 nt, Artificial Sequence
  Description of Artificial Sequence: Synthetic oligonucleotide
cucagcaguuuacuagcu

SEQ ID NO: 144890 - RNA, 18 nt, Artificial Sequence
  Description of Artificial Sequence: Synthetic oligonucleotide
uccagcucagcaguuuac

SEQ ID NO: 144891 - RNA, 18 nt, Artificial Sequence
  Description of Artificial Sequence: Synthetic oligonucleotide
ugaguuccagcucagcag

SEQ ID NO: 144892 - RNA, 18 nt, Artificial Sequence
  Description of Artificial Sequence: Synthetic oligonucleotide
gggcuugaguuccagcuc

SEQ ID NO: 144893 - RNA, 18 nt, Artificial Sequence
  Description of Artificial Sequence: Synthetic oligonucleotide
ggccugggcuugaguucc

SEQ ID NO: 144894 - RNA, 18 nt, Artificial Sequence
  Description of Artificial Sequence: Synthetic oligonucleotide
acaaaggccugggcuuga

SEQ ID NO: 144895 - RNA, 18 nt, Artificial Sequence
  Description of Artificial Sequence: Synthetic oligonucleotide
uggugacaaaggccuggg

SEQ ID NO: 144896 - RNA, 18 nt, Artificial Sequence
  Description of Artificial Sequence: Synthetic oligonucleotide
gacuuuggugacaaaggc

SEQ ID NO: 144897 - RNA, 18 nt, Artificial Sequence
  Description of Artificial Sequence: Synthetic oligonucleotide
agacagacuuuggugaca

SEQ ID NO: 144898 - RNA, 18 nt, Artificial Sequence
  Description of Artificial Sequence: Synthetic oligonucleotide
ggguaagacagacuuugg

SEQ ID NO: 144899 - RNA, 18 nt, Artificial Sequence
  Description of Artificial Sequence: Synthetic oligonucleotide
ugagcuacgcuagcuggg

SEQ ID NO: 144900 - RNA, 18 nt, Artificial Sequence
  Description of Artificial Sequence: Synthetic oligonucleotide
ugacugagcuacgcuagc

SEQ ID NO: 144901 - RNA, 18 nt, Artificial Sequence
  Description of Artificial Sequence: Synthetic oligonucleotide
cugagugacugagcuacg

SEQ ID NO: 144902 - RNA, 18 nt, Artificial Sequence
  Description of Artificial Sequence: Synthetic oligonucleotide
acuuacugagugacugag

SEQ ID NO: 144903 - RNA, 18 nt, Artificial Sequence
  Description of Artificial Sequence: Synthetic oligonucleotide
cucuaacuuacugaguga

SEQ ID NO: 144904 - RNA, 18 nt, Artificial Sequence
  Description of Artificial Sequence: Synthetic oligonucleotide
aaggacucuaacuuacug

SEQ ID NO: 144905 - RNA, 18 nt, Artificial Sequence
  Description of Artificial Sequence: Synthetic oligonucleotide
cacacaaggacucuaacu

SEQ ID NO: 144906 - RNA, 18 nt, Artificial Sequence
  Description of Artificial Sequence: Synthetic oligonucleotide
cccagcacacaaggacuc

SEQ ID NO: 144907 - RNA, 18 nt, Artificial Sequence
  Description of Artificial Sequence: Synthetic oligonucleotide
cagugcccagcacacaag

SEQ ID NO: 144908 - RNA, 18 nt, Artificial Sequence
  Description of Artificial Sequence: Synthetic oligonucleotide
guucacagugcccagcac

SEQ ID NO: 144909 - RNA, 18 nt, Artificial Sequence
  Description of Artificial Sequence: Synthetic oligonucleotide
guuuuguucacagugccc

SEQ ID NO: 144910 - RNA, 18 nt, Artificial Sequence
  Description of Artificial Sequence: Synthetic oligonucleotide
ugucuguuuuguucacag

SEQ ID NO: 144911 - RNA, 18 nt, Artificial Sequence
  Description of Artificial Sequence: Synthetic oligonucleotide
gauuuugucuguuuuguu

SEQ ID NO: 144912 - RNA, 18 nt, Artificial Sequence
  Description of Artificial Sequence: Synthetic oligonucleotide
gcagugauuuugucuguu

SEQ ID NO: 144913 - RNA, 18 nt, Artificial Sequence
  Description of Artificial Sequence: Synthetic oligonucleotide
caagagcagugauuuugu

SEQ ID NO: 144914 - RNA, 18 nt, Artificial Sequence
  Description of Artificial Sequence: Synthetic oligonucleotide
cuuugcaagagcagugau

SEQ ID NO: 144915 - RNA, 18 nt, Artificial Sequence
  Description of Artificial Sequence: Synthetic oligonucleotide
uguaucuuugcaagagca

SEQ ID NO: 144916 - RNA, 18 nt, Artificial Sequence
  Description of Artificial Sequence: Synthetic oligonucleotide
uuugguguaucuuugcaa

SEQ ID NO: 144917 - RNA, 18 nt, Artificial Sequence
  Description of Artificial Sequence: Synthetic oligonucleotide
uuuuuuuugguguaucuu

SEQ ID NO: 144918 - RNA, 18 nt, Artificial Sequence
  Description of Artificial Sequence: Synthetic oligonucleotide
uuuuuuuuuuuuuggugu

SEQ ID NO: 144919 - RNA, 18 nt, Artificial Sequence
  Description of Artificial Sequence: Synthetic oligonucleotide
ugauuuuuuuuuuuuuuu

SEQ ID NO: 144920 - RNA, 18 nt, Artificial Sequence
  Description of Artificial Sequence: Synthetic oligonucleotide
agaugugauuuuuuuuuu

SEQ ID NO: 144921 - RNA, 18 nt, Artificial Sequence
  Description of Artificial Sequence: Synthetic oligonucleotide
ccacaagaugugauuuuu

SEQ ID NO: 144922 - RNA, 18 nt, Artificial Sequence
  Description of Artificial Sequence: Synthetic oligonucleotide
aagcuccacaagauguga

SEQ ID NO: 144923 - RNA, 18 nt, Artificial Sequence
  Description of Artificial Sequence: Synthetic oligonucleotide
aucgcaagcuccacaaga

SEQ ID NO: 144924 - RNA, 18 nt, Artificial Sequence
  Description of Artificial Sequence: Synthetic oligonucleotide
uccagaucgcaagcucca

SEQ ID NO: 144925 - RNA, 18 nt, Artificial Sequence
  Description of Artificial Sequence: Synthetic oligonucleotide
gccccuccagaucgcaag

SEQ ID NO: 144926 - RNA, 18 nt, Artificial Sequence
  Description of Artificial Sequence: Synthetic oligonucleotide
ggguggccccuccagauc

SEQ ID NO: 144927 - RNA, 18 nt, Artificial Sequence
  Description of Artificial Sequence: Synthetic oligonucleotide
caagguaggaaugauggg

SEQ ID NO: 144928 - RNA, 18 nt, Artificial Sequence
  Description of Artificial Sequence: Synthetic oligonucleotide
ucagcaagguaggaauga

SEQ ID NO: 144929 - RNA, 18 nt, Artificial Sequence
  Description of Artificial Sequence: Synthetic oligonucleotide
uagagucagcaagguagg

SEQ ID NO: 144930 - RNA, 18 nt, Artificial Sequence
  Description of Artificial Sequence: Synthetic oligonucleotide
agcucuagagucagcaag

SEQ ID NO: 144931 - RNA, 18 nt, Artificial Sequence
  Description of Artificial Sequence: Synthetic oligonucleotide
ccagaagcucuagaguca

SEQ ID NO: 144932 - RNA, 18 nt, Artificial Sequence
  Description of Artificial Sequence: Synthetic oligonucleotide
ggcccccagaagcucuag

SEQ ID NO: 144933 - RNA, 18 nt, Artificial Sequence
  Description of Artificial Sequence: Synthetic oligonucleotide
ccuaaggcccccagaagc

SEQ ID NO: 144934 - RNA, 18 nt, Artificial Sequence
  Description of Artificial Sequence: Synthetic oligonucleotide
uggagccuaaggccccca

SEQ ID NO: 144935 - RNA, 18 nt, Artificial Sequence
  Description of Artificial Sequence: Synthetic oligonucleotide
ccuuuuggagccuaaggc

SEQ ID NO: 144936 - RNA, 18 nt, Artificial Sequence
  Description of Artificial Sequence: Synthetic oligonucleotide
caaauccuuuuggagccu

SEQ ID NO: 144937 - RNA, 18 nt, Artificial Sequence
  Description of Artificial Sequence: Synthetic oligonucleotide
ugggccaaauccuuuugg

SEQ ID NO: 144938 - RNA, 18 nt, Artificial Sequence
  Description of Artificial Sequence: Synthetic oligonucleotide
gugcaugggccaaauccu

SEQ ID NO: 144939 - RNA, 18 nt, Artificial Sequence
  Description of Artificial Sequence: Synthetic oligonucleotide
uacaggugcaugggccaa

SEQ ID NO: 144940 - RNA, 18 nt, Artificial Sequence
  Description of Artificial Sequence: Synthetic oligonucleotide
cccuuuacaggugcaugg

SEQ ID NO: 144941 - RNA, 18 nt, Artificial Sequence
  Description of Artificial Sequence: Synthetic oligonucleotide
cccaucccuuuacaggug

SEQ ID NO: 144942 - RNA, 18 nt, Artificial Sequence
  Description of Artificial Sequence: Synthetic oligonucleotide
acauccccaucccuuuac

SEQ ID NO: 144943 - RNA, 18 nt, Artificial Sequence
  Description of Artificial Sequence: Synthetic oligonucleotide
cucugacauccccauccc

SEQ ID NO: 144944 - RNA, 18 nt, Artificial Sequence
  Description of Artificial Sequence: Synthetic oligonucleotide
agcaccucugacaucccc

SEQ ID NO: 144945 - RNA, 18 nt, Artificial Sequence
  Description of Artificial Sequence: Synthetic oligonucleotide
gccccagcaccucugaca

SEQ ID NO: 144946 - RNA, 18 nt, Artificial Sequence
  Description of Artificial Sequence: Synthetic oligonucleotide
ggcaggccccagcaccuc

SEQ ID NO: 144947 - RNA, 18 nt, Artificial Sequence
  Description of Artificial Sequence: Synthetic oligonucleotide
gcccaggcaggccccagc

SEQ ID NO: 144948 - RNA, 18 nt, Artificial Sequence
  Description of Artificial Sequence: Synthetic oligonucleotide
aaggagcccaggcaggcc

SEQ ID NO: 144949 - RNA, 18 nt, Artificial Sequence
  Description of Artificial Sequence: Synthetic oligonucleotide
ucagcaaggagcccaggc

SEQ ID NO: 144950 - RNA, 18 nt, Artificial Sequence
  Description of Artificial Sequence: Synthetic oligonucleotide
ggcagucagcaaggagcc

SEQ ID NO: 144951 - RNA, 18 nt, Artificial Sequence
  Description of Artificial Sequence: Synthetic oligonucleotide
auccgaccaaaacggaua

SEQ ID NO: 144952 - RNA, 18 nt, Artificial Sequence
  Description of Artificial Sequence: Synthetic oligonucleotide
ccggcauccgaccaaaac

SEQ ID NO: 144953 - RNA, 18 nt, Artificial Sequence
  Description of Artificial Sequence: Synthetic oligonucleotide
agccuccggcauccgacc

SEQ ID NO: 144954 - RNA, 18 nt, Artificial Sequence
  Description of Artificial Sequence: Synthetic oligonucleotide
uucucagccuccggcauc

SEQ ID NO: 144955 - RNA, 18 nt, Artificial Sequence
  Description of Artificial Sequence: Synthetic oligonucleotide
uccucuucucagccuccg

SEQ ID NO: 144956 - RNA, 18 nt, Artificial Sequence
  Description of Artificial Sequence: Synthetic oligonucleotide
cagcuuccucuucucagc

SEQ ID NO: 144957 - RNA, 18 nt, Artificial Sequence
  Description of Artificial Sequence: Synthetic oligonucleotide
gccaccagcuuccucuuc

SEQ ID NO: 144958 - RNA, 18 nt, Artificial Sequence
  Description of Artificial Sequence: Synthetic oligonucleotide
gcccugccaccagcuucc

SEQ ID NO: 144959 - RNA, 18 nt, Artificial Sequence
  Description of Artificial Sequence: Synthetic oligonucleotide
agucagcccugccaccag

SEQ ID NO: 144960 - RNA, 18 nt, Artificial Sequence
  Description of Artificial Sequence: Synthetic oligonucleotide
uuugcagucagcccugcc

SEQ ID NO: 144961 - RNA, 18 nt, Artificial Sequence
  Description of Artificial Sequence: Synthetic oligonucleotide
ccucguuugcagucagcc

SEQ ID NO: 144962 - RNA, 18 nt, Artificial Sequence
  Description of Artificial Sequence: Synthetic oligonucleotide
gcuccccucguuugcagu

SEQ ID NO: 144963 - RNA, 18 nt, Artificial Sequence
  Description of Artificial Sequence: Synthetic oligonucleotide
uacuggcuccccucguuu

SEQ ID NO: 144964 - RNA, 18 nt, Artificial Sequence
  Description of Artificial Sequence: Synthetic oligonucleotide
gguuguacuggcuccccu

SEQ ID NO: 144965 - RNA, 18 nt, Artificial Sequence
  Description of Artificial Sequence: Synthetic oligonucleotide
cuguggguuguacuggcu

SEQ ID NO: 144966 - RNA, 18 nt, Artificial Sequence
  Description of Artificial Sequence: Synthetic oligonucleotide
gccaccuguggguuguac

SEQ ID NO: 144967 - RNA, 18 nt, Artificial Sequence
  Description of Artificial Sequence: Synthetic oligonucleotide
ggucggccaccugugggu

SEQ ID NO: 144968 - RNA, 18 nt, Artificial Sequence
  Description of Artificial Sequence: Synthetic oligonucleotide
cuucaggucggccaccug

SEQ ID NO: 144969 - RNA, 18 nt, Artificial Sequence
  Description of Artificial Sequence: Synthetic oligonucleotide
aaggccuucaggucggcc

SEQ ID NO: 144970 - RNA, 18 nt, Artificial Sequence
  Description of Artificial Sequence: Synthetic oligonucleotide
uggagaaggccuucaggu

SEQ ID NO: 144971 - RNA, 18 nt, Artificial Sequence
  Description of Artificial Sequence: Synthetic oligonucleotide
gugcuuggagaaggccuu

SEQ ID NO: 144972 - RNA, 18 nt, Artificial Sequence
  Description of Artificial Sequence: Synthetic oligonucleotide
uagaugugcuuggagaag

SEQ ID NO: 144973 - RNA, 18 nt, Artificial Sequence
  Description of Artificial Sequence: Synthetic oligonucleotide
cauuguagaugugcuugg

SEQ ID NO: 144974 - RNA, 18 nt, Artificial Sequence
  Description of Artificial Sequence: Synthetic oligonucleotide
guaggcauuguagaugug

SEQ ID NO: 144975 - RNA, 18 nt, Artificial Sequence
  Description of Artificial Sequence: Synthetic oligonucleotide
uucagguaggcauuguag

SEQ ID NO: 144976 - RNA, 18 nt, Artificial Sequence
  Description of Artificial Sequence: Synthetic oligonucleotide
aguuuuucagguaggcau

SEQ ID NO: 144977 - RNA, 18 nt, Artificial Sequence
  Description of Artificial Sequence: Synthetic oligonucleotide
guugaaguuuuucaggua

SEQ ID NO: 144978 - RNA, 18 nt, Artificial Sequence
  Description of Artificial Sequence: Synthetic oligonucleotide
gucauguugaaguuuuuc

SEQ ID NO: 144979 - RNA, 18 nt, Artificial Sequence
  Description of Artificial Sequence: Synthetic oligonucleotide
uuuuggucauguugaagu

SEQ ID NO: 144980 - RNA, 18 nt, Artificial Sequence
  Description of Artificial Sequence: Synthetic oligonucleotide
cuucuuuuuggucauguu

SEQ ID NO: 144981 - RNA, 18 nt, Artificial Sequence
  Description of Artificial Sequence: Synthetic oligonucleotide
cgggccuucuuuuugguc

SEQ ID NO: 144982 - RNA, 18 nt, Artificial Sequence
  Description of Artificial Sequence: Synthetic oligonucleotide
ugcugcgggccuucuuuu

SEQ ID NO: 144983 - RNA, 18 nt, Artificial Sequence
  Description of Artificial Sequence: Synthetic oligonucleotide
gaggaugcugcgggccuu

SEQ ID NO: 144984 - RNA, 18 nt, Artificial Sequence
  Description of Artificial Sequence: Synthetic oligonucleotide
ccggugaggaugcugcgg

SEQ ID NO: 144985 - RNA, 18 nt, Artificial Sequence
  Description of Artificial Sequence: Synthetic oligonucleotide
cuuugccggugaggaugc

SEQ ID NO: 144986 - RNA, 18 nt, Artificial Sequence
  Description of Artificial Sequence: Synthetic oligonucleotide
gcuggcuuugccggugag

SEQ ID NO: 144987 - RNA, 18 nt, Artificial Sequence
  Description of Artificial Sequence: Synthetic oligonucleotide
guguggcuggcuuugccg

SEQ ID NO: 144988 - RNA, 18 nt, Artificial Sequence
  Description of Artificial Sequence: Synthetic oligonucleotide
cauccgaccaaaacggau

SEQ ID NO: 144989 - RNA, 18 nt, Artificial Sequence
  Description of Artificial Sequence: Synthetic oligonucleotide
uccggcauccgaccaaaa

SEQ ID NO: 144990 - RNA, 18 nt, Artificial Sequence
  Description of Artificial Sequence: Synthetic oligonucleotide
cagccuccggcauccgac

SEQ ID NO: 144991 - RNA, 18 nt, Artificial Sequence
  Description of Artificial Sequence: Synthetic oligonucleotide
cuucucagccuccggcau

SEQ ID NO: 144992 - RNA, 18 nt, Artificial Sequence
  Description of Artificial Sequence: Synthetic oligonucleotide
uuccucuucucagccucc

SEQ ID NO: 144993 - RNA, 18 nt, Artificial Sequence
  Description of Artificial Sequence: Synthetic oligonucleotide
ccagcuuccucuucucag

SEQ ID NO: 144994 - RNA, 18 nt, Artificial Sequence
  Description of Artificial Sequence: Synthetic oligonucleotide
ugccaccagcuuccucuu

SEQ ID NO: 144995 - RNA, 18 nt, Artificial Sequence
  Description of Artificial Sequence: Synthetic oligonucleotide
agcccugccaccagcuuc

SEQ ID NO: 144996 - RNA, 18 nt, Artificial Sequence
  Description of Artificial Sequence: Synthetic oligonucleotide
cagucagcccugccacca

SEQ ID NO: 144997 - RNA, 18 nt, Artificial Sequence
  Description of Artificial Sequence: Synthetic oligonucleotide
guuugcagucagcccugc

SEQ ID NO: 144998 - RNA, 18 nt, Artificial Sequence
  Description of Artificial Sequence: Synthetic oligonucleotide
cccucguuugcagucagc

SEQ ID NO: 144999 - RNA, 18 nt, Artificial Sequence
  Description of Artificial Sequence: Synthetic oligonucleotide
ggcuccccucguuugcag

SEQ ID NO: 145000 - RNA, 18 nt, Artificial Sequence
  Description of Artificial Sequence: Synthetic oligonucleotide
guacuggcuccccucguu

SEQ ID NO: 145001 - RNA, 18 nt, Artificial Sequence
  Description of Artificial Sequence: Synthetic oligonucleotide
ggguuguacuggcucccc

SEQ ID NO: 145002 - RNA, 18 nt, Artificial Sequence
  Description of Artificial Sequence: Synthetic oligonucleotide
ccuguggguuguacuggc

SEQ ID NO: 145003 - RNA, 18 nt, Artificial Sequence
  Description of Artificial Sequence: Synthetic oligonucleotide
ggccaccuguggguugua

SEQ ID NO: 145004 - RNA, 18 nt, Artificial Sequence
  Description of Artificial Sequence: Synthetic oligonucleotide
aggucggccaccuguggg

SEQ ID NO: 145005 - RNA, 18 nt, Artificial Sequence
  Description of Artificial Sequence: Synthetic oligonucleotide
ccuucaggucggccaccu

SEQ ID NO: 145006 - RNA, 18 nt, Artificial Sequence
  Description of Artificial Sequence: Synthetic oligonucleotide
gaaggccuucaggucggc

SEQ ID NO: 145007 - RNA, 18 nt, Artificial Sequence
  Description of Artificial Sequence: Synthetic oligonucleotide
uuggagaaggccuucagg

SEQ ID NO: 145008 - RNA, 18 nt, Artificial Sequence
  Description of Artificial Sequence: Synthetic oligonucleotide
ugugcuuggagaaggccu

SEQ ID NO: 145009 - RNA, 18 nt, Artificial Sequence
  Description of Artificial Sequence: Synthetic oligonucleotide
guagaugugcuuggagaa

SEQ ID NO: 145010 - RNA, 18 nt, Artificial Sequence
  Description of Artificial Sequence: Synthetic oligonucleotide
gcauuguagaugugcuug

SEQ ID NO: 145011 - RNA, 18 nt, Artificial Sequence
  Description of Artificial Sequence: Synthetic oligonucleotide
gguaggcauuguagaugu

SEQ ID NO: 145012 - RNA, 18 nt, Artificial Sequence
  Description of Artificial Sequence: Synthetic oligonucleotide
uuucagguaggcauugua

SEQ ID NO: 145013 - RNA, 18 nt, Artificial Sequence
  Description of Artificial Sequence: Synthetic oligonucleotide
aaguuuuucagguaggca

SEQ ID NO: 145014 - RNA, 18 nt, Artificial Sequence
  Description of Artificial Sequence: Synthetic oligonucleotide
uguugaaguuuuucaggu

SEQ ID NO: 145015 - RNA, 18 nt, Artificial Sequence
  Description of Artificial Sequence: Synthetic oligonucleotide
ggucauguugaaguuuuu

SEQ ID NO: 145016 - RNA, 18 nt, Artificial Sequence
  Description of Artificial Sequence: Synthetic oligonucleotide
uuuuuggucauguugaag

SEQ ID NO: 145017 - RNA, 18 nt, Artificial Sequence
  Description of Artificial Sequence: Synthetic oligonucleotide
ccuucuuuuuggucaugu

SEQ ID NO: 145018 - RNA, 18 nt, Artificial Sequence
  Description of Artificial Sequence: Synthetic oligonucleotide
gcgggccuucuuuuuggu

SEQ ID NO: 145019 - RNA, 18 nt, Artificial Sequence
  Description of Artificial Sequence: Synthetic oligonucleotide
augcugcgggccuucuuu

SEQ ID NO: 145020 - RNA, 18 nt, Artificial Sequence
  Description of Artificial Sequence: Synthetic oligonucleotide
ugaggaugcugcgggccu

SEQ ID NO: 145021 - RNA, 18 nt, Artificial Sequence
  Description of Artificial Sequence: Synthetic oligonucleotide
gccggugaggaugcugcg

SEQ ID NO: 145022 - RNA, 18 nt, Artificial Sequence
  Description of Artificial Sequence: Synthetic oligonucleotide
gcuuugccggugaggaug

SEQ ID NO: 145023 - RNA, 18 nt, Artificial Sequence
  Description of Artificial Sequence: Synthetic oligonucleotide
ggcuggcuuugccgguga

SEQ ID NO: 145024 - RNA, 18 nt, Artificial Sequence
  Description of Artificial Sequence: Synthetic oligonucleotide
cguguggcuggcuuugcc

SEQ ID NO: 145025 - RNA, 18 nt, Artificial Sequence
  Description of Artificial Sequence: Synthetic oligonucleotide
ggccaagcagcagcaaca

SEQ ID NO: 145026 - RNA, 18 nt, Artificial Sequence
  Description of Artificial Sequence: Synthetic oligonucleotide
ugccaggccaagcagcag

SEQ ID NO: 145027 - RNA, 18 nt, Artificial Sequence
  Description of Artificial Sequence: Synthetic oligonucleotide
gaugcugccaggccaagc

SEQ ID NO: 145028 - RNA, 18 nt, Artificial Sequence
  Description of Artificial Sequence: Synthetic oligonucleotide
cccaggaugcugccaggc

SEQ ID NO: 145029 - RNA, 18 nt, Artificial Sequence
  Description of Artificial Sequence: Synthetic oligonucleotide
cagagcccaggaugcugc

SEQ ID NO: 145030 - RNA, 18 nt, Artificial Sequence
  Description of Artificial Sequence: Synthetic oligonucleotide
ggacccagagcccaggau

SEQ ID NO: 145031 - RNA, 18 nt, Artificial Sequence
  Description of Artificial Sequence: Synthetic oligonucleotide
cagugggacccagagccc

SEQ ID NO: 145032 - RNA, 18 nt, Artificial Sequence
  Description of Artificial Sequence: Synthetic oligonucleotide
ggcggcagugggacccag

SEQ ID NO: 145033 - RNA, 18 nt, Artificial Sequence
  Description of Artificial Sequence: Synthetic oligonucleotide
aggcaggcggcaguggga

SEQ ID NO: 145034 - RNA, 18 nt, Artificial Sequence
  Description of Artificial Sequence: Synthetic oligonucleotide
gagucaggcaggcggcag

SEQ ID NO: 145035 - RNA, 18 nt, Artificial Sequence
  Description of Artificial Sequence: Synthetic oligonucleotide
ucccggagucaggcaggc

SEQ ID NO: 145036 - RNA, 18 nt, Artificial Sequence
  Description of Artificial Sequence: Synthetic oligonucleotide
ggcucucccggagucagg

SEQ ID NO: 145037 - RNA, 18 nt, Artificial Sequence
  Description of Artificial Sequence: Synthetic oligonucleotide
ggccuggcucucccggag

SEQ ID NO: 145038 - RNA, 18 nt, Artificial Sequence
  Description of Artificial Sequence: Synthetic oligonucleotide
gagaaggccuggcucucc

SEQ ID NO: 145039 - RNA, 18 nt, Artificial Sequence
  Description of Artificial Sequence: Synthetic oligonucleotide
ggagggagaaggccuggc

SEQ ID NO: 145040 - RNA, 18 nt, Artificial Sequence
  Description of Artificial Sequence: Synthetic oligonucleotide
uugagggagggagaaggc

SEQ ID NO: 145041 - RNA, 18 nt, Artificial Sequence
  Description of Artificial Sequence: Synthetic oligonucleotide
ugaaguugagggagggag

SEQ ID NO: 145042 - RNA, 18 nt, Artificial Sequence
  Description of Artificial Sequence: Synthetic oligonucleotide
caccaugaaguugaggga

SEQ ID NO: 145043 - RNA, 18 nt, Artificial Sequence
  Description of Artificial Sequence: Synthetic oligonucleotide
gccugcaccaugaaguug

SEQ ID NO: 145044 - RNA, 18 nt, Artificial Sequence
  Description of Artificial Sequence: Synthetic oligonucleotide
cccuugccugcaccauga

SEQ ID NO: 145045 - RNA, 18 nt, Artificial Sequence
  Description of Artificial Sequence: Synthetic oligonucleotide
cuggcucucccggaguca

SEQ ID NO: 145046 - RNA, 18 nt, Artificial Sequence
  Description of Artificial Sequence: Synthetic oligonucleotide
aaggccuggcucucccgg

SEQ ID NO: 145047 - RNA, 18 nt, Artificial Sequence
  Description of Artificial Sequence: Synthetic oligonucleotide
gggagaaggccuggcucu

SEQ ID NO: 145048 - RNA, 18 nt, Artificial Sequence
  Description of Artificial Sequence: Synthetic oligonucleotide
agggagggagaaggccug

SEQ ID NO: 145049 - RNA, 18 nt, Artificial Sequence
  Description of Artificial Sequence: Synthetic oligonucleotide
aguugagggagggagaag

SEQ ID NO: 145050 - RNA, 18 nt, Artificial Sequence
  Description of Artificial Sequence: Synthetic oligonucleotide
caugaaguugagggaggg

SEQ ID NO: 145051 - RNA, 18 nt, Artificial Sequence
  Description of Artificial Sequence: Synthetic oligonucleotide
ugcaccaugaaguugagg

SEQ ID NO: 145052 - RNA, 18 nt, Artificial Sequence
  Description of Artificial Sequence: Synthetic oligonucleotide
uugccugcaccaugaagu

SEQ ID NO: 145053 - RNA, 18 nt, Artificial Sequence
  Description of Artificial Sequence: Synthetic oligonucleotide
gucccuugccugcaccau

SEQ ID NO: 145054 - RNA, 18 nt, Artificial Sequence
  Description of Artificial Sequence: Synthetic oligonucleotide
cccaugucccuugccugc

SEQ ID NO: 145055 - RNA, 18 nt, Artificial Sequence
  Description of Artificial Sequence: Synthetic oligonucleotide
ugcuccccaugucccuug

SEQ ID NO: 145056 - RNA, 18 nt, Artificial Sequence
  Description of Artificial Sequence: Synthetic oligonucleotide
cccugugcuccccauguc

SEQ ID NO: 145057 - RNA, 18 nt, Artificial Sequence
  Description of Artificial Sequence: Synthetic oligonucleotide
ccccacccugugcucccc

SEQ ID NO: 145058 - RNA, 18 nt, Artificial Sequence
  Description of Artificial Sequence: Synthetic oligonucleotide
gagacccccacccugugc

SEQ ID NO: 145059 - RNA, 18 nt, Artificial Sequence
  Description of Artificial Sequence: Synthetic oligonucleotide
cucgggagacccccaccc

SEQ ID NO: 145060 - RNA, 18 nt, Artificial Sequence
  Description of Artificial Sequence: Synthetic oligonucleotide
caggccucgggagacccc

SEQ ID NO: 145061 - RNA, 18 nt, Artificial Sequence
  Description of Artificial Sequence: Synthetic oligonucleotide
gagaucaggccucgggag

SEQ ID NO: 145062 - RNA, 18 nt, Artificial Sequence
  Description of Artificial Sequence: Synthetic oligonucleotide
cguuagagaucaggccuc

SEQ ID NO: 145063 - RNA, 18 nt, Artificial Sequence
  Description of Artificial Sequence: Synthetic oligonucleotide
ugucguggaucacaaagg

SEQ ID NO: 145064 - RNA, 18 nt, Artificial Sequence
  Description of Artificial Sequence: Synthetic oligonucleotide
cucgaugucguggaucac

SEQ ID NO: 145065 - RNA, 18 nt, Artificial Sequence
  Description of Artificial Sequence: Synthetic oligonucleotide
aaugucucgaugucgugg

SEQ ID NO: 145066 - RNA, 18 nt, Artificial Sequence
  Description of Artificial Sequence: Synthetic oligonucleotide
gccacaaugucucgaugu

SEQ ID NO: 145067 - RNA, 18 nt, Artificial Sequence
  Description of Artificial Sequence: Synthetic oligonucleotide
ugccugccacaaugucuc

SEQ ID NO: 145068 - RNA, 18 nt, Artificial Sequence
  Description of Artificial Sequence: Synthetic oligonucleotide
uucucugccugccacaau

SEQ ID NO: 145069 - RNA, 18 nt, Artificial Sequence
  Description of Artificial Sequence: Synthetic oligonucleotide
gccccuucucugccugcc

SEQ ID NO: 145070 - RNA, 18 nt, Artificial Sequence
  Description of Artificial Sequence: Synthetic oligonucleotide
caccagccccuucucugc

SEQ ID NO: 145071 - RNA, 18 nt, Artificial Sequence
  Description of Artificial Sequence: Synthetic oligonucleotide
uuccacaccagccccuuc

SEQ ID NO: 145072 - RNA, 18 nt, Artificial Sequence
  Description of Artificial Sequence: Synthetic oligonucleotide
acugcuuccacaccagcc

SEQ ID NO: 145073 - RNA, 18 nt, Artificial Sequence
  Description of Artificial Sequence: Synthetic oligonucleotide
caccaacugcuuccacac

SEQ ID NO: 145074 - RNA, 18 nt, Artificial Sequence
  Description of Artificial Sequence: Synthetic oligonucleotide
ccauucaccaacugcuuc

SEQ ID NO: 145075 - RNA, 18 nt, Artificial Sequence
  Description of Artificial Sequence: Synthetic oligonucleotide
gcaggccauucaccaacu

SEQ ID NO: 145076 - RNA, 18 nt, Artificial Sequence
  Description of Artificial Sequence: Synthetic oligonucleotide
gggaggcaggccauucac

SEQ ID NO: 145077 - RNA, 18 nt, Artificial Sequence
  Description of Artificial Sequence: Synthetic oligonucleotide
uuguagggaggcaggcca

SEQ ID NO: 145078 - RNA, 18 nt, Artificial Sequence
  Description of Artificial Sequence: Synthetic oligonucleotide
ucuccuuguagggaggca

SEQ ID NO: 145079 - RNA, 18 nt, Artificial Sequence
  Description of Artificial Sequence: Synthetic oligonucleotide
gcugaucuccuuguaggg

SEQ ID NO: 145080 - RNA, 18 nt, Artificial Sequence
  Description of Artificial Sequence: Synthetic oligonucleotide
ugcacgcugaucuccuug

SEQ ID NO: 145081 - RNA, 18 nt, Artificial Sequence
  Description of Artificial Sequence: Synthetic oligonucleotide
agacgugcacgcugaucu

SEQ ID NO: 145082 - RNA, 18 nt, Artificial Sequence
  Description of Artificial Sequence: Synthetic oligonucleotide
guagaagacgugcacgcu

SEQ ID NO: 145083 - RNA, 18 nt, Artificial Sequence
  Description of Artificial Sequence: Synthetic oligonucleotide
cagcgguagaagacgugc

SEQ ID NO: 145084 - RNA, 18 nt, Artificial Sequence
  Description of Artificial Sequence: Synthetic oligonucleotide
acuggcagcgguagaaga

SEQ ID NO: 145085 - RNA, 18 nt, Artificial Sequence
  Description of Artificial Sequence: Synthetic oligonucleotide
ggugcacuggcagcggua

SEQ ID NO: 145086 - RNA, 18 nt, Artificial Sequence
  Description of Artificial Sequence: Synthetic oligonucleotide
acuguggugcacuggcag

SEQ ID NO: 145087 - RNA, 18 nt, Artificial Sequence
  Description of Artificial Sequence: Synthetic oligonucleotide
ucuccacuguggugcacu

SEQ ID NO: 145088 - RNA, 18 nt, Artificial Sequence
  Description of Artificial Sequence: Synthetic oligonucleotide
cacggucuccacuguggu

SEQ ID NO: 145089 - RNA, 18 nt, Artificial Sequence
  Description of Artificial Sequence: Synthetic oligonucleotide
ucccgcacggucuccacu

SEQ ID NO: 145090 - RNA, 18 nt, Artificial Sequence
  Description of Artificial Sequence: Synthetic oligonucleotide
ugagcucccgcacggucu

SEQ ID NO: 145091 - RNA, 18 nt, Artificial Sequence
  Description of Artificial Sequence: Synthetic oligonucleotide
cucagugagcucccgcac

SEQ ID NO: 145092 - RNA, 18 nt, Artificial Sequence
  Description of Artificial Sequence: Synthetic oligonucleotide
gcgaacucagugagcucc

SEQ ID NO: 145093 - RNA, 18 nt, Artificial Sequence
  Description of Artificial Sequence: Synthetic oligonucleotide
ucuuggcgaacucaguga

SEQ ID NO: 145094 - RNA, 18 nt, Artificial Sequence
  Description of Artificial Sequence: Synthetic oligonucleotide
gaugcucuuggcgaacuc

SEQ ID NO: 145095 - RNA, 18 nt, Artificial Sequence
  Description of Artificial Sequence: Synthetic oligonucleotide
gggaugcucuuggcgaac

SEQ ID NO: 145096 - RNA, 18 nt, Artificial Sequence
  Description of Artificial Sequence: Synthetic oligonucleotide
gaggcugcugaagcuggg

SEQ ID NO: 145097 - RNA, 18 nt, Artificial Sequence
  Description of Artificial Sequence: Synthetic oligonucleotide
aggaagaggcugcugaag

SEQ ID NO: 145098 - RNA, 18 nt, Artificial Sequence
  Description of Artificial Sequence: Synthetic oligonucleotide
cguugaggaagaggcugc

SEQ ID NO: 145099 - RNA, 18 nt, Artificial Sequence
  Description of Artificial Sequence: Synthetic oligonucleotide
cuggucguugaggaagag

SEQ ID NO: 145100 - RNA, 18 nt, Artificial Sequence
  Description of Artificial Sequence: Synthetic oligonucleotide
guaaccuggucguugagg

SEQ ID NO: 145101 - RNA, 18 nt, Artificial Sequence
  Description of Artificial Sequence: Synthetic oligonucleotide
gaaggguaaccuggucgu

SEQ ID NO: 145102 - RNA, 18 nt, Artificial Sequence
  Description of Artificial Sequence: Synthetic oligonucleotide
cuugagaaggguaaccug

SEQ ID NO: 145103 - RNA, 18 nt, Artificial Sequence
  Description of Artificial Sequence: Synthetic oligonucleotide
ccauacuugagaagggua

SEQ ID NO: 145104 - RNA, 18 nt, Artificial Sequence
  Description of Artificial Sequence: Synthetic oligonucleotide
gcacgccauacuugagaa

SEQ ID NO: 145105 - RNA, 18 nt, Artificial Sequence
  Description of Artificial Sequence: Synthetic oligonucleotide
cucgugcacgccauacuu

SEQ ID NO: 145106 - RNA, 18 nt, Artificial Sequence
  Description of Artificial Sequence: Synthetic oligonucleotide
auggccucgugcacgcca

SEQ ID NO: 145107 - RNA, 18 nt, Artificial Sequence
  Description of Artificial Sequence: Synthetic oligonucleotide
cgaagauggccucgugca

SEQ ID NO: 145108 - RNA, 18 nt, Artificial Sequence
  Description of Artificial Sequence: Synthetic oligonucleotide
cauggcgaagauggccuc

SEQ ID NO: 145109 - RNA, 18 nt, Artificial Sequence
  Description of Artificial Sequence: Synthetic oligonucleotide
gccagcauggcgaagaug

SEQ ID NO: 145110 - RNA, 18 nt, Artificial Sequence
  Description of Artificial Sequence: Synthetic oligonucleotide
uagaggccagcauggcga

SEQ ID NO: 145111 - RNA, 18 nt, Artificial Sequence
  Description of Artificial Sequence: Synthetic oligonucleotide
gacgauagaggccagcau

SEQ ID NO: 145112 - RNA, 18 nt, Artificial Sequence
  Description of Artificial Sequence: Synthetic oligonucleotide
uuguugacgauagaggcc

SEQ ID NO: 145113 - RNA, 18 nt, Artificial Sequence
  Description of Artificial Sequence: Synthetic oligonucleotide
cguccuuguugacgauag

SEQ ID NO: 145114 - RNA, 18 nt, Artificial Sequence
  Description of Artificial Sequence: Synthetic oligonucleotide
cagcccguccuuguugac

SEQ ID NO: 145115 - RNA, 18 nt, Artificial Sequence
  Description of Artificial Sequence: Synthetic oligonucleotide
accagcagcccguccuug

SEQ ID NO: 145116 - RNA, 18 nt, Artificial Sequence
  Description of Artificial Sequence: Synthetic oligonucleotide
uggcuaccagcagcccgu

SEQ ID NO: 145117 - RNA, 18 nt, Artificial Sequence
  Description of Artificial Sequence: Synthetic oligonucleotide
gccguuggcuaccagcag

SEQ ID NO: 145118 - RNA, 18 nt, Artificial Sequence
  Description of Artificial Sequence: Synthetic oligonucleotide
ccacugccguuggcuacc

SEQ ID NO: 145119 - RNA, 18 nt, Artificial Sequence
  Description of Artificial Sequence: Synthetic oligonucleotide
caaagccacugccguugg

SEQ ID NO: 145120 - RNA, 18 nt, Artificial Sequence
  Description of Artificial Sequence: Synthetic oligonucleotide
ggugacaaagccacugcc

SEQ ID NO: 145121 - RNA, 18 nt, Artificial Sequence
  Description of Artificial Sequence: Synthetic oligonucleotide
ucacgggugacaaagcca

SEQ ID NO: 145122 - RNA, 18 nt, Artificial Sequence
  Description of Artificial Sequence: Synthetic oligonucleotide
ggaacucacgggugacaa

SEQ ID NO: 145123 - RNA, 18 nt, Artificial Sequence
  Description of Artificial Sequence: Synthetic oligonucleotide
gcgcaggaacucacgggu

SEQ ID NO: 145124 - RNA, 18 nt, Artificial Sequence
  Description of Artificial Sequence: Synthetic oligonucleotide
aggcugcgcaggaacuca

SEQ ID NO: 145125 - RNA, 18 nt, Artificial Sequence
  Description of Artificial Sequence: Synthetic oligonucleotide
ugcggaggcugcgcagga

SEQ ID NO: 145126 - RNA, 18 nt, Artificial Sequence
  Description of Artificial Sequence: Synthetic oligonucleotide
ggguuugcggaggcugcg

SEQ ID NO: 145127 - RNA, 18 nt, Artificial Sequence
  Description of Artificial Sequence: Synthetic oligonucleotide
cugaaggguuugcggagg

SEQ ID NO: 145128 - RNA, 18 nt, Artificial Sequence
  Description of Artificial Sequence: Synthetic oligonucleotide
uaucacugaaggguuugc

SEQ ID NO: 145129 - RNA, 18 nt, Artificial Sequence
  Description of Artificial Sequence: Synthetic oligonucleotide
aaugauaucacugaaggg

SEQ ID NO: 145130 - RNA, 18 nt, Artificial Sequence
  Description of Artificial Sequence: Synthetic oligonucleotide
ggcucaaugauaucacug

SEQ ID NO: 145131 - RNA, 18 nt, Artificial Sequence
  Description of Artificial Sequence: Synthetic oligonucleotide
acuuaggcucaaugauau

SEQ ID NO: 145132 - RNA, 18 nt, Artificial Sequence
  Description of Artificial Sequence: Synthetic oligonucleotide
uucaaacuuaggcucaau

SEQ ID NO: 145133 - RNA, 18 nt, Artificial Sequence
  Description of Artificial Sequence: Synthetic oligonucleotide
gcaaauucaaacuuaggc

SEQ ID NO: 145134 - RNA, 18 nt, Artificial Sequence
  Description of Artificial Sequence: Synthetic oligonucleotide
ugacagcaaauucaaacu

SEQ ID NO: 145135 - RNA, 18 nt, Artificial Sequence
  Description of Artificial Sequence: Synthetic oligonucleotide
gaacuugacagcaaauuc

SEQ ID NO: 145136 - RNA, 18 nt, Artificial Sequence
  Description of Artificial Sequence: Synthetic oligonucleotide
gcguugaacuugacagca

SEQ ID NO: 145137 - RNA, 18 nt, Artificial Sequence
  Description of Artificial Sequence: Synthetic oligonucleotide
ccagggcguugaacuuga

SEQ ID NO: 145138 - RNA, 18 nt, Artificial Sequence
  Description of Artificial Sequence: Synthetic oligonucleotide
aaguuccagggcguugaa

SEQ ID NO: 145139 - RNA, 18 nt, Artificial Sequence
  Description of Artificial Sequence: Synthetic oligonucleotide
ucaucaaguuccagggcg

SEQ ID NO: 145140 - RNA, 18 nt, Artificial Sequence
  Description of Artificial Sequence: Synthetic oligonucleotide
cacugucaucaaguucca

SEQ ID NO: 145141 - RNA, 18 nt, Artificial Sequence
  Description of Artificial Sequence: Synthetic oligonucleotide
caggucacugucaucaag

SEQ ID NO: 145142 - RNA, 18 nt, Artificial Sequence
  Description of Artificial Sequence: Synthetic oligonucleotide
agggccaggucacuguca

SEQ ID NO: 145143 - RNA, 18 nt, Artificial Sequence
  Description of Artificial Sequence: Synthetic oligonucleotide
ugaauagggccaggucac

SEQ ID NO: 145144 - RNA, 18 nt, Artificial Sequence
  Description of Artificial Sequence: Synthetic oligonucleotide
cgcaaugaauagggccag

SEQ ID NO: 145145 - RNA, 18 nt, Artificial Sequence
  Description of Artificial Sequence: Synthetic oligonucleotide
auggccgcaaugaauagg

SEQ ID NO: 145146 - RNA, 18 nt, Artificial Sequence
  Description of Artificial Sequence: Synthetic oligonucleotide
gaaugauggccgcaauga

SEQ ID NO: 145147 - RNA, 18 nt, Artificial Sequence
  Description of Artificial Sequence: Synthetic oligonucleotide
acacagaaugauggccgc

SEQ ID NO: 145148 - RNA, 18 nt, Artificial Sequence
  Description of Artificial Sequence: Synthetic oligonucleotide
gaugucguggaucacaaa

SEQ ID NO: 145149 - RNA, 18 nt, Artificial Sequence
  Description of Artificial Sequence: Synthetic oligonucleotide
gucucgaugucguggauc

SEQ ID NO: 145150 - RNA, 18 nt, Artificial Sequence
  Description of Artificial Sequence: Synthetic oligonucleotide
acaaugucucgaugucgu

SEQ ID NO: 145151 - RNA, 18 nt, Artificial Sequence
  Description of Artificial Sequence: Synthetic oligonucleotide
cugccacaaugucucgau

SEQ ID NO: 145152 - RNA, 18 nt, Artificial Sequence
  Description of Artificial Sequence: Synthetic oligonucleotide
ucugccugccacaauguc

SEQ ID NO: 145153 - RNA, 18 nt, Artificial Sequence
  Description of Artificial Sequence: Synthetic oligonucleotide
ccuucucugccugccaca

SEQ ID NO: 145154 - RNA, 18 nt, Artificial Sequence
  Description of Artificial Sequence: Synthetic oligonucleotide
cagccccuucucugccug

SEQ ID NO: 145155 - RNA, 18 nt, Artificial Sequence
  Description of Artificial Sequence: Synthetic oligonucleotide
cacaccagccccuucucu

SEQ ID NO: 145156 - RNA, 18 nt, Artificial Sequence
  Description of Artificial Sequence: Synthetic oligonucleotide
gcuuccacaccagccccu

SEQ ID NO: 145157 - RNA, 18 nt, Artificial Sequence
  Description of Artificial Sequence: Synthetic oligonucleotide
caacugcuuccacaccag

SEQ ID NO: 145158 - RNA, 18 nt, Artificial Sequence
  Description of Artificial Sequence: Synthetic oligonucleotide
uucaccaacugcuuccac

SEQ ID NO: 145159 - RNA, 18 nt, Artificial Sequence
  Description of Artificial Sequence: Synthetic oligonucleotide
ggccauucaccaacugcu

SEQ ID NO: 145160 - RNA, 18 nt, Artificial Sequence
  Description of Artificial Sequence: Synthetic oligonucleotide
aggcaggccauucaccaa

SEQ ID NO: 145161 - RNA, 18 nt, Artificial Sequence
  Description of Artificial Sequence: Synthetic oligonucleotide
uagggaggcaggccauuc

SEQ ID NO: 145162 - RNA, 18 nt, Artificial Sequence
  Description of Artificial Sequence: Synthetic oligonucleotide
ccuuguagggaggcaggc

SEQ ID NO: 145163 - RNA, 18 nt, Artificial Sequence
  Description of Artificial Sequence: Synthetic oligonucleotide
gaucuccuuguagggagg

SEQ ID NO: 145164 - RNA, 18 nt, Artificial Sequence
  Description of Artificial Sequence: Synthetic oligonucleotide
acgcugaucuccuuguag

SEQ ID NO: 145165 - RNA, 18 nt, Artificial Sequence
  Description of Artificial Sequence: Synthetic oligonucleotide
cgugcacgcugaucuccu

SEQ ID NO: 145166 - RNA, 18 nt, Artificial Sequence
  Description of Artificial Sequence: Synthetic oligonucleotide
gaagacgugcacgcugau

SEQ ID NO: 145167 - RNA, 18 nt, Artificial Sequence
  Description of Artificial Sequence: Synthetic oligonucleotide
cgguagaagacgugcacg

SEQ ID NO: 145168 - RNA, 18 nt, Artificial Sequence
  Description of Artificial Sequence: Synthetic oligonucleotide
ggcagcgguagaagacgu

SEQ ID NO: 145169 - RNA, 18 nt, Artificial Sequence
  Description of Artificial Sequence: Synthetic oligonucleotide
gcacuggcagcgguagaa

SEQ ID NO: 145170 - RNA, 18 nt, Artificial Sequence
  Description of Artificial Sequence: Synthetic oligonucleotide
guggugcacuggcagcgg

SEQ ID NO: 145171 - RNA, 18 nt, Artificial Sequence
  Description of Artificial Sequence: Synthetic oligonucleotide
ccacuguggugcacuggc

SEQ ID NO: 145172 - RNA, 18 nt, Artificial Sequence
  Description of Artificial Sequence: Synthetic oligonucleotide
ggucuccacuguggugca

SEQ ID NO: 145173 - RNA, 18 nt, Artificial Sequence
  Description of Artificial Sequence: Synthetic oligonucleotide
cgcacggucuccacugug

SEQ ID NO: 145174 - RNA, 18 nt, Artificial Sequence
  Description of Artificial Sequence: Synthetic oligonucleotide
gcucccgcacggucucca

SEQ ID NO: 145175 - RNA, 18 nt, Artificial Sequence
  Description of Artificial Sequence: Synthetic oligonucleotide
agugagcucccgcacggu

SEQ ID NO: 145176 - RNA, 18 nt, Artificial Sequence
  Description of Artificial Sequence: Synthetic oligonucleotide
aacucagugagcucccgc

SEQ ID NO: 145177 - RNA, 18 nt, Artificial Sequence
  Description of Artificial Sequence: Synthetic oligonucleotide
uggcgaacucagugagcu

SEQ ID NO: 145178 - RNA, 18 nt, Artificial Sequence
  Description of Artificial Sequence: Synthetic oligonucleotide
gcucuuggcgaacucagu

SEQ ID NO: 145179 - RNA, 18 nt, Artificial Sequence
  Description of Artificial Sequence: Synthetic oligonucleotide
gggaugcucuuggcgaac

SEQ ID NO: 145180 - RNA, 18 nt, Artificial Sequence
  Description of Artificial Sequence: Synthetic oligonucleotide
gaggcugcugaagcuggg

SEQ ID NO: 145181 - RNA, 18 nt, Artificial Sequence
  Description of Artificial Sequence: Synthetic oligonucleotide
agaggcugcugaagcugg

SEQ ID NO: 145182 - RNA, 18 nt, Artificial Sequence
  Description of Artificial Sequence: Synthetic oligonucleotide
gaggaagaggcugcugaa

SEQ ID NO: 145183 - RNA, 18 nt, Artificial Sequence
  Description of Artificial Sequence: Synthetic oligonucleotide
ucguugaggaagaggcug

SEQ ID NO: 145184 - RNA, 18 nt, Artificial Sequence
  Description of Artificial Sequence: Synthetic oligonucleotide
ccuggucguugaggaaga

SEQ ID NO: 145185 - RNA, 18 nt, Artificial Sequence
  Description of Artificial Sequence: Synthetic oligonucleotide
gguaaccuggucguugag

SEQ ID NO: 145186 - RNA, 18 nt, Artificial Sequence
  Description of Artificial Sequence: Synthetic oligonucleotide
agaaggguaaccuggucg

SEQ ID NO: 145187 - RNA, 18 nt, Artificial Sequence
  Description of Artificial Sequence: Synthetic oligonucleotide
acuugagaaggguaaccu

SEQ ID NO: 145188 - RNA, 18 nt, Artificial Sequence
  Description of Artificial Sequence: Synthetic oligonucleotide
gccauacuugagaagggu

SEQ ID NO: 145189 - RNA, 18 nt, Artificial Sequence
  Description of Artificial Sequence: Synthetic oligonucleotide
ugcacgccauacuugaga

SEQ ID NO: 145190 - RNA, 18 nt, Artificial Sequence
  Description of Artificial Sequence: Synthetic oligonucleotide
ccucgugcacgccauacu

SEQ ID NO: 145191 - RNA, 18 nt, Artificial Sequence
  Description of Artificial Sequence: Synthetic oligonucleotide
gauggccucgugcacgcc

SEQ ID NO: 145192 - RNA, 18 nt, Artificial Sequence
  Description of Artificial Sequence: Synthetic oligonucleotide
gcgaagauggccucgugc

SEQ ID NO: 145193 - RNA, 18 nt, Artificial Sequence
  Description of Artificial Sequence: Synthetic oligonucleotide
gcauggcgaagauggccu

SEQ ID NO: 145194 - RNA, 18 nt, Artificial Sequence
  Description of Artificial Sequence: Synthetic oligonucleotide
ggccagcauggcgaagau

SEQ ID NO: 145195 - RNA, 18 nt, Artificial Sequence
  Description of Artificial Sequence: Synthetic oligonucleotide
auagaggccagcauggcg

SEQ ID NO: 145196 - RNA, 18 nt, Artificial Sequence
  Description of Artificial Sequence: Synthetic oligonucleotide
ugacgauagaggccagca

SEQ ID NO: 145197 - RNA, 18 nt, Artificial Sequence
  Description of Artificial Sequence: Synthetic oligonucleotide
cuuguugacgauagaggc

SEQ ID NO: 145198 - RNA, 18 nt, Artificial Sequence
  Description of Artificial Sequence: Synthetic oligonucleotide
ccguccuuguugacgaua

SEQ ID NO: 145199 - RNA, 18 nt, Artificial Sequence
  Description of Artificial Sequence: Synthetic oligonucleotide
gcagcccguccuuguuga

SEQ ID NO: 145200 - RNA, 18 nt, Artificial Sequence
  Description of Artificial Sequence: Synthetic oligonucleotide
uaccagcagcccguccuu

SEQ ID NO: 145201 - RNA, 18 nt, Artificial Sequence
  Description of Artificial Sequence: Synthetic oligonucleotide
uuggcuaccagcagcccg

SEQ ID NO: 145202 - RNA, 18 nt, Artificial Sequence
  Description of Artificial Sequence: Synthetic oligonucleotide
ugccguuggcuaccagca

SEQ ID NO: 145203 - RNA, 18 nt, Artificial Sequence
  Description of Artificial Sequence: Synthetic oligonucleotide
gccacugccguuggcuac

SEQ ID NO: 145204 - RNA, 18 nt, Artificial Sequence
  Description of Artificial Sequence: Synthetic oligonucleotide
acaaagccacugccguug

SEQ ID NO: 145205 - RNA, 18 nt, Artificial Sequence
  Description of Artificial Sequence: Synthetic oligonucleotide
gggugacaaagccacugc

SEQ ID NO: 145206 - RNA, 18 nt, Artificial Sequence
  Description of Artificial Sequence: Synthetic oligonucleotide
cucacgggugacaaagcc

SEQ ID NO: 145207 - RNA, 18 nt, Artificial Sequence
  Description of Artificial Sequence: Synthetic oligonucleotide
aggaacucacgggugaca

SEQ ID NO: 145208 - RNA, 18 nt, Artificial Sequence
  Description of Artificial Sequence: Synthetic oligonucleotide
ugcgcaggaacucacggg

SEQ ID NO: 145209 - RNA, 18 nt, Artificial Sequence
  Description of Artificial Sequence: Synthetic oligonucleotide
gaggcugcgcaggaacuc

SEQ ID NO: 145210 - RNA, 18 nt, Artificial Sequence
  Description of Artificial Sequence: Synthetic oligonucleotide
uugcggaggcugcgcagg

SEQ ID NO: 145211 - RNA, 18 nt, Artificial Sequence
  Description of Artificial Sequence: Synthetic oligonucleotide
aggguuugcggaggcugc

SEQ ID NO: 145212 - RNA, 18 nt, Artificial Sequence
  Description of Artificial Sequence: Synthetic oligonucleotide
acugaaggguuugcggag

SEQ ID NO: 145213 - RNA, 18 nt, Artificial Sequence
  Description of Artificial Sequence: Synthetic oligonucleotide
auaucacugaaggguuug

SEQ ID NO: 145214 - RNA, 18 nt, Artificial Sequence
  Description of Artificial Sequence: Synthetic oligonucleotide
caaugauaucacugaagg

SEQ ID NO: 145215 - RNA, 18 nt, Artificial Sequence
  Description of Artificial Sequence: Synthetic oligonucleotide
aggcucaaugauaucacu

SEQ ID NO: 145216 - RNA, 18 nt, Artificial Sequence
  Description of Artificial Sequence: Synthetic oligonucleotide
aacuuaggcucaaugaua

SEQ ID NO: 145217 - RNA, 18 nt, Artificial Sequence
  Description of Artificial Sequence: Synthetic oligonucleotide
auucaaacuuaggcucaa

SEQ ID NO: 145218 - RNA, 18 nt, Artificial Sequence
  Description of Artificial Sequence: Synthetic oligonucleotide
agcaaauucaaacuuagg

SEQ ID NO: 145219 - RNA, 18 nt, Artificial Sequence
  Description of Artificial Sequence: Synthetic oligonucleotide
uugacagcaaauucaaac

SEQ ID NO: 145220 - RNA, 18 nt, Artificial Sequence
  Description of Artificial Sequence: Synthetic oligonucleotide
ugaacuugacagcaaauu

SEQ ID NO: 145221 - RNA, 18 nt, Artificial Sequence
  Description of Artificial Sequence: Synthetic oligonucleotide
ggcguugaacuugacagc

SEQ ID NO: 145222 - RNA, 18 nt, Artificial Sequence
  Description of Artificial Sequence: Synthetic oligonucleotide
uccagggcguugaacuug

SEQ ID NO: 145223 - RNA, 18 nt, Artificial Sequence
  Description of Artificial Sequence: Synthetic oligonucleotide
caaguuccagggcguuga

SEQ ID NO: 145224 - RNA, 18 nt, Artificial Sequence
  Description of Artificial Sequence: Synthetic oligonucleotide
gucaucaaguuccagggc

SEQ ID NO: 145225 - RNA, 18 nt, Artificial Sequence
  Description of Artificial Sequence: Synthetic oligonucleotide
ucacugucaucaaguucc

SEQ ID NO: 145226 - RNA, 18 nt, Artificial Sequence
  Description of Artificial Sequence: Synthetic oligonucleotide
ccaggucacugucaucaa

SEQ ID NO: 145227 - RNA, 18 nt, Artificial Sequence
  Description of Artificial Sequence: Synthetic oligonucleotide
uagggccaggucacuguc

SEQ ID NO: 145228 - RNA, 18 nt, Artificial Sequence
  Description of Artificial Sequence: Synthetic oligonucleotide
augaauagggccagguca

SEQ ID NO: 145229 - RNA, 18 nt, Artificial Sequence
  Description of Artificial Sequence: Synthetic oligonucleotide
ccgcaaugaauagggcca

SEQ ID NO: 145230 - RNA, 18 nt, Artificial Sequence
  Description of Artificial Sequence: Synthetic oligonucleotide
gauggccgcaaugaauag

SEQ ID NO: 145231 - RNA, 18 nt, Artificial Sequence
  Description of Artificial Sequence: Synthetic oligonucleotide
agaaugauggccgcaaug

SEQ ID NO: 145232 - RNA, 18 nt, Artificial Sequence
  Description of Artificial Sequence: Synthetic oligonucleotide
cacacagaaugauggccg

SEQ ID NO: 145233 - RNA, 18 nt, Artificial Sequence
  Description of Artificial Sequence: Synthetic oligonucleotide
ccaccugccccacucuca

SEQ ID NO: 145234 - RNA, 18 nt, Artificial Sequence
  Description of Artificial Sequence: Synthetic oligonucleotide
ccagcccaccugccccac

SEQ ID NO: 145235 - RNA, 18 nt, Artificial Sequence
  Description of Artificial Sequence: Synthetic oligonucleotide
ccaggccagcccaccugc

SEQ ID NO: 145236 - RNA, 18 nt, Artificial Sequence
  Description of Artificial Sequence: Synthetic oligonucleotide
gugugccaggccagccca

SEQ ID NO: 145237 - RNA, 18 nt, Artificial Sequence
  Description of Artificial Sequence: Synthetic oligonucleotide
acugggugugccaggcca

SEQ ID NO: 145238 - RNA, 18 nt, Artificial Sequence
  Description of Artificial Sequence: Synthetic oligonucleotide
ggacgacugggugugcca

SEQ ID NO: 145239 - RNA, 18 nt, Artificial Sequence
  Description of Artificial Sequence: Synthetic oligonucleotide
ccccaggacgacugggug

SEQ ID NO: 145240 - RNA, 18 nt, Artificial Sequence
  Description of Artificial Sequence: Synthetic oligonucleotide
ccaacccccaggacgacu

SEQ ID NO: 145241 - RNA, 18 nt, Artificial Sequence
  Description of Artificial Sequence: Synthetic oligonucleotide
gagggccaacccccagga

SEQ ID NO: 145242 - RNA, 18 nt, Artificial Sequence
  Description of Artificial Sequence: Synthetic oligonucleotide
gcagugagggccaacccc

SEQ ID NO: 145243 - RNA, 18 nt, Artificial Sequence
  Description of Artificial Sequence: Synthetic oligonucleotide
gcccugcagugagggcca

SEQ ID NO: 145244 - RNA, 18 nt, Artificial Sequence
  Description of Artificial Sequence: Synthetic oligonucleotide
acagugcccugcagugag

SEQ ID NO: 145245 - RNA, 18 nt, Artificial Sequence
  Description of Artificial Sequence: Synthetic oligonucleotide
caggcacagugcccugca

SEQ ID NO: 145246 - RNA, 18 nt, Artificial Sequence
  Description of Artificial Sequence: Synthetic oligonucleotide
gagcucaggcacagugcc

SEQ ID NO: 145247 - RNA, 18 nt, Artificial Sequence
  Description of Artificial Sequence: Synthetic oligonucleotide
ugucagagcucaggcaca

SEQ ID NO: 145248 - RNA, 18 nt, Artificial Sequence
  Description of Artificial Sequence: Synthetic oligonucleotide
cacacugucagagcucag

SEQ ID NO: 145249 - RNA, 18 nt, Artificial Sequence
  Description of Artificial Sequence: Synthetic oligonucleotide
uuccccacacugucagag

SEQ ID NO: 145250 - RNA, 18 nt, Artificial Sequence
  Description of Artificial Sequence: Synthetic oligonucleotide
gacacuuccccacacugu

SEQ ID NO: 145251 - RNA, 18 nt, Artificial Sequence
  Description of Artificial Sequence: Synthetic oligonucleotide
acagggacacuuccccac

SEQ ID NO: 145252 - RNA, 18 nt, Artificial Sequence
  Description of Artificial Sequence: Synthetic oligonucleotide
agaucacagggacacuuc

SEQ ID NO: 145253 - RNA, 18 nt, Artificial Sequence
  Description of Artificial Sequence: Synthetic oligonucleotide
ugccaagaucacagggac

SEQ ID NO: 145254 - RNA, 18 nt, Artificial Sequence
  Description of Artificial Sequence: Synthetic oligonucleotide
uccacugccaagaucaca

SEQ ID NO: 145255 - RNA, 18 nt, Artificial Sequence
  Description of Artificial Sequence: Synthetic oligonucleotide
cauguuccacugccaaga

SEQ ID NO: 145256 - RNA, 18 nt, Artificial Sequence
  Description of Artificial Sequence: Synthetic oligonucleotide
ccuugcauguuccacugc

SEQ ID NO: 145257 - RNA, 18 nt, Artificial Sequence
  Description of Artificial Sequence: Synthetic oligonucleotide
cagugccuugcauguucc

SEQ ID NO: 145258 - RNA, 18 nt, Artificial Sequence
  Description of Artificial Sequence: Synthetic oligonucleotide
ucagucagugccuugcau

SEQ ID NO: 145259 - RNA, 18 nt, Artificial Sequence
  Description of Artificial Sequence: Synthetic oligonucleotide
caugcucagucagugccu

SEQ ID NO: 145260 - RNA, 18 nt, Artificial Sequence
  Description of Artificial Sequence: Synthetic oligonucleotide
uccugcaugcucagucag

SEQ ID NO: 145261 - RNA, 18 nt, Artificial Sequence
  Description of Artificial Sequence: Synthetic oligonucleotide
gcugauccugcaugcuca

SEQ ID NO: 145262 - RNA, 18 nt, Artificial Sequence
  Description of Artificial Sequence: Synthetic oligonucleotide
auggagcugauccugcau

SEQ ID NO: 145263 - RNA, 18 nt, Artificial Sequence
  Description of Artificial Sequence: Synthetic oligonucleotide
augagauggagcugaucc

SEQ ID NO: 145264 - RNA, 18 nt, Artificial Sequence
  Description of Artificial Sequence: Synthetic oligonucleotide
acauaaugagauggagcu

SEQ ID NO: 145265 - RNA, 18 nt, Artificial Sequence
  Description of Artificial Sequence: Synthetic oligonucleotide
uacguacauaaugagaug

SEQ ID NO: 145266 - RNA, 18 nt, Artificial Sequence
  Description of Artificial Sequence: Synthetic oligonucleotide
cuaucuacguacauaaug

SEQ ID NO: 145267 - RNA, 18 nt, Artificial Sequence
  Description of Artificial Sequence: Synthetic oligonucleotide
caccucuaucuacguaca

SEQ ID NO: 145268 - RNA, 18 nt, Artificial Sequence
  Description of Artificial Sequence: Synthetic oligonucleotide
gucuccaccucuaucuac

SEQ ID NO: 145269 - RNA, 18 nt, Artificial Sequence
  Description of Artificial Sequence: Synthetic oligonucleotide
uuccugucuccaccucua

SEQ ID NO: 145270 - RNA, 18 nt, Artificial Sequence
  Description of Artificial Sequence: Synthetic oligonucleotide
ucuuuuuccugucuccac

SEQ ID NO: 145271 - RNA, 18 nt, Artificial Sequence
  Description of Artificial Sequence: Synthetic oligonucleotide
cuuagucuuuuuccuguc

SEQ ID NO: 145272 - RNA, 18 nt, Artificial Sequence
  Description of Artificial Sequence: Synthetic oligonucleotide
ucuggcuuagucuuuuuc

SEQ ID NO: 145273 - RNA, 18 nt, Artificial Sequence
  Description of Artificial Sequence: Synthetic oligonucleotide
ccacgucuggcuuagucu

SEQ ID NO: 145274 - RNA, 18 nt, Artificial Sequence
  Description of Artificial Sequence: Synthetic oligonucleotide
agccaccacgucuggcuu

SEQ ID NO: 145275 - RNA, 18 nt, Artificial Sequence
  Description of Artificial Sequence: Synthetic oligonucleotide
gugugagccaccacgucu

SEQ ID NO: 145276 - RNA, 18 nt, Artificial Sequence
  Description of Artificial Sequence: Synthetic oligonucleotide
uacaggugugagccacca

SEQ ID NO: 145277 - RNA, 18 nt, Artificial Sequence
  Description of Artificial Sequence: Synthetic oligonucleotide
gggauuacaggugugagc

SEQ ID NO: 145278 - RNA, 18 nt, Artificial Sequence
  Description of Artificial Sequence: Synthetic oligonucleotide
gugcugggauuacaggug

SEQ ID NO: 145279 - RNA, 18 nt, Artificial Sequence
  Description of Artificial Sequence: Synthetic oligonucleotide
ccaaagugcugggauuac

SEQ ID NO: 145280 - RNA, 18 nt, Artificial Sequence
  Description of Artificial Sequence: Synthetic oligonucleotide
gccugccaaagugcuggg

SEQ ID NO: 145281 - RNA, 18 nt, Artificial Sequence
  Description of Artificial Sequence: Synthetic oligonucleotide
ccucggccugccaaagug

SEQ ID NO: 145282 - RNA, 18 nt, Artificial Sequence
  Description of Artificial Sequence: Synthetic oligonucleotide
acccgccucggccugcca

SEQ ID NO: 145283 - RNA, 18 nt, Artificial Sequence
  Description of Artificial Sequence: Synthetic oligonucleotide
gauccacccgccucggcc

SEQ ID NO: 145284 - RNA, 18 nt, Artificial Sequence
  Description of Artificial Sequence: Synthetic oligonucleotide
caagugauccacccgccu

SEQ ID NO: 145285 - RNA, 18 nt, Artificial Sequence
  Description of Artificial Sequence: Synthetic oligonucleotide
gaccucaagugauccacc

SEQ ID NO: 145286 - RNA, 18 nt, Artificial Sequence
  Description of Artificial Sequence: Synthetic oligonucleotide
cuccugaccucaagugau

SEQ ID NO: 145287 - RNA, 18 nt, Artificial Sequence
  Description of Artificial Sequence: Synthetic oligonucleotide
ucgaacuccugaccucaa

SEQ ID NO: 145288 - RNA, 18 nt, Artificial Sequence
  Description of Artificial Sequence: Synthetic oligonucleotide
ugguuucgaacuccugac

SEQ ID NO: 145289 - RNA, 18 nt, Artificial Sequence
  Description of Artificial Sequence: Synthetic oligonucleotide
caggcugguuucgaacuc

SEQ ID NO: 145290 - RNA, 18 nt, Artificial Sequence
  Description of Artificial Sequence: Synthetic oligonucleotide
uuggccaggcugguuucg

SEQ ID NO: 145291 - RNA, 18 nt, Artificial Sequence
  Description of Artificial Sequence: Synthetic oligonucleotide
ccauguuggccaggcugg

SEQ ID NO: 145292 - RNA, 18 nt, Artificial Sequence
  Description of Artificial Sequence: Synthetic oligonucleotide
uuucaccauguuggccag

SEQ ID NO: 145293 - RNA, 18 nt, Artificial Sequence
  Description of Artificial Sequence: Synthetic oligonucleotide
ggguuucaccauguuggc

SEQ ID NO: 145294 - RNA, 18 nt, Artificial Sequence
  Description of Artificial Sequence: Synthetic oligonucleotide
auuuuuaguagagacggg

SEQ ID NO: 145295 - RNA, 18 nt, Artificial Sequence
  Description of Artificial Sequence: Synthetic oligonucleotide
uuuguauuuuuaguagag

SEQ ID NO: 145296 - RNA, 18 nt, Artificial Sequence
  Description of Artificial Sequence: Synthetic oligonucleotide
aauuuuuuguauuuuuag

SEQ ID NO: 145297 - RNA, 18 nt, Artificial Sequence
  Description of Artificial Sequence: Synthetic oligonucleotide
uggcuaauuuuuuguauu

SEQ ID NO: 145298 - RNA, 18 nt, Artificial Sequence
  Description of Artificial Sequence: Synthetic oligonucleotide
acaucuggcuaauuuuuu

SEQ ID NO: 145299 - RNA, 18 nt, Artificial Sequence
  Description of Artificial Sequence: Synthetic oligonucleotide
ccaccacaucuggcuaau

SEQ ID NO: 145300 - RNA, 18 nt, Artificial Sequence
  Description of Artificial Sequence: Synthetic oligonucleotide
gcgugccaccacaucugg

SEQ ID NO: 145301 - RNA, 18 nt, Artificial Sequence
  Description of Artificial Sequence: Synthetic oligonucleotide
caggcgcgugccaccaca

SEQ ID NO: 145302 - RNA, 18 nt, Artificial Sequence
  Description of Artificial Sequence: Synthetic oligonucleotide
gauuacaggcgcgugcca

SEQ ID NO: 145303 - RNA, 18 nt, Artificial Sequence
  Description of Artificial Sequence: Synthetic oligonucleotide
gcugggauuacaggcgcg

SEQ ID NO: 145304 - RNA, 18 nt, Artificial Sequence
  Description of Artificial Sequence: Synthetic oligonucleotide
aaguagcugggauuacag

SEQ ID NO: 145305 - RNA, 18 nt, Artificial Sequence
  Description of Artificial Sequence: Synthetic oligonucleotide
cucccaaguagcugggau

SEQ ID NO: 145306 - RNA, 18 nt, Artificial Sequence
  Description of Artificial Sequence: Synthetic oligonucleotide
ucagccucccaaguagcu

SEQ ID NO: 145307 - RNA, 18 nt, Artificial Sequence
  Description of Artificial Sequence: Synthetic oligonucleotide
cuggcucagccucccaag

SEQ ID NO: 145308 - RNA, 18 nt, Artificial Sequence
  Description of Artificial Sequence: Synthetic oligonucleotide
uucuccuggcucagccuc

SEQ ID NO: 145309 - RNA, 18 nt, Artificial Sequence
  Description of Artificial Sequence: Synthetic oligonucleotide
agcgauucuccuggcuca

SEQ ID NO: 145310 - RNA, 18 nt, Artificial Sequence
  Description of Artificial Sequence: Synthetic oligonucleotide
guucaagcgauucuccug

SEQ ID NO: 145311 - RNA, 18 nt, Artificial Sequence
  Description of Artificial Sequence: Synthetic oligonucleotide
cucggguucaagcgauuc

SEQ ID NO: 145312 - RNA, 18 nt, Artificial Sequence
  Description of Artificial Sequence: Synthetic oligonucleotide
caccucucggguucaagc

SEQ ID NO: 145313 - RNA, 18 nt, Artificial Sequence
  Description of Artificial Sequence: Synthetic oligonucleotide
accuccaccucucggguu

SEQ ID NO: 145314 - RNA, 18 nt, Artificial Sequence
  Description of Artificial Sequence: Synthetic oligonucleotide
cugcaaccuccaccucuc

SEQ ID NO: 145315 - RNA, 18 nt, Artificial Sequence
  Description of Artificial Sequence: Synthetic oligonucleotide
gcucacugcaaccuccac

SEQ ID NO: 145316 - RNA, 18 nt, Artificial Sequence
  Description of Artificial Sequence: Synthetic oligonucleotide
uuuuggcucacugcaacc

SEQ ID NO: 145317 - RNA, 18 nt, Artificial Sequence
  Description of Artificial Sequence: Synthetic oligonucleotide
ugggauuuuggcucacug

SEQ ID NO: 145318 - RNA, 18 nt, Artificial Sequence
  Description of Artificial Sequence: Synthetic oligonucleotide
aguggugggauuuuggcu

SEQ ID NO: 145319 - RNA, 18 nt, Artificial Sequence
  Description of Artificial Sequence: Synthetic oligonucleotide
agugcaguggugggauuu

SEQ ID NO: 145320 - RNA, 18 nt, Artificial Sequence
  Description of Artificial Sequence: Synthetic oligonucleotide
gcuggagugcaguggugg

SEQ ID NO: 145321 - RNA, 18 nt, Artificial Sequence
  Description of Artificial Sequence: Synthetic oligonucleotide
cccaggcuggagugcagu

SEQ ID NO: 145322 - RNA, 18 nt, Artificial Sequence
  Description of Artificial Sequence: Synthetic oligonucleotide
ugucacccaggcuggagu

SEQ ID NO: 145323 - RNA, 18 nt, Artificial Sequence
  Description of Artificial Sequence: Synthetic oligonucleotide
cacucugucacccaggcu

SEQ ID NO: 145324 - RNA, 18 nt, Artificial Sequence
  Description of Artificial Sequence: Synthetic oligonucleotide
ggucucacucugucaccc

SEQ ID NO: 145325 - RNA, 18 nt, Artificial Sequence
  Description of Artificial Sequence: Synthetic oligonucleotide
gacagggucucacucugu

SEQ ID NO: 145326 - RNA, 18 nt, Artificial Sequence
  Description of Artificial Sequence: Synthetic oligonucleotide
uuugagacagggucucac

SEQ ID NO: 145327 - RNA, 18 nt, Artificial Sequence
  Description of Artificial Sequence: Synthetic oligonucleotide
uuuuuuuugagacagggu

SEQ ID NO: 145328 - RNA, 18 nt, Artificial Sequence
  Description of Artificial Sequence: Synthetic oligonucleotide
uuuccuuuuuuuugagac

SEQ ID NO: 145329 - RNA, 18 nt, Artificial Sequence
  Description of Artificial Sequence: Synthetic oligonucleotide
guccuuuuccuuuuuuuu

SEQ ID NO: 145330 - RNA, 18 nt, Artificial Sequence
  Description of Artificial Sequence: Synthetic oligonucleotide
uguuaguccuuuuccuuu

SEQ ID NO: 145331 - RNA, 18 nt, Artificial Sequence
  Description of Artificial Sequence: Synthetic oligonucleotide
auuuuuccaccccacauu

SEQ ID NO: 145332 - RNA, 18 nt, Artificial Sequence
  Description of Artificial Sequence: Synthetic oligonucleotide
agacaauuuuuccacccc

SEQ ID NO: 145333 - RNA, 18 nt, Artificial Sequence
  Description of Artificial Sequence: Synthetic oligonucleotide
aaugcagacaauuuuucc

SEQ ID NO: 145334 - RNA, 18 nt, Artificial Sequence
  Description of Artificial Sequence: Synthetic oligonucleotide
gaaaaaaugcagacaauu

SEQ ID NO: 145335 - RNA, 18 nt, Artificial Sequence
  Description of Artificial Sequence: Synthetic oligonucleotide
augcagaaaaaaugcaga

SEQ ID NO: 145336 - RNA, 18 nt, Artificial Sequence
  Description of Artificial Sequence: Synthetic oligonucleotide
uaaaaaugcagaaaaaau

SEQ ID NO: 145337 - RNA, 18 nt, Artificial Sequence
  Description of Artificial Sequence: Synthetic oligonucleotide
aauuuuaaaaaugcagaa

SEQ ID NO: 145338 - RNA, 18 nt, Artificial Sequence
  Description of Artificial Sequence: Synthetic oligonucleotide
guuggaauuuuaaaaaug

SEQ ID NO: 145339 - RNA, 18 nt, Artificial Sequence
  Description of Artificial Sequence: Synthetic oligonucleotide
auuguguuggaauuuuaa

SEQ ID NO: 145340 - RNA, 18 nt, Artificial Sequence
  Description of Artificial Sequence: Synthetic oligonucleotide
uauuuauuguguuggaau

SEQ ID NO: 145341 - RNA, 18 nt, Artificial Sequence
  Description of Artificial Sequence: Synthetic oligonucleotide
uauuguauuuauuguguu

SEQ ID NO: 145342 - RNA, 18 nt, Artificial Sequence
  Description of Artificial Sequence: Synthetic oligonucleotide
guuauuauuguauuuauu

SEQ ID NO: 145343 - RNA, 18 nt, Artificial Sequence
  Description of Artificial Sequence: Synthetic oligonucleotide
gcauaguuauuauuguau

SEQ ID NO: 145344 - RNA, 18 nt, Artificial Sequence
  Description of Artificial Sequence: Synthetic oligonucleotide
aguuagcauaguuauuau

SEQ ID NO: 145345 - RNA, 18 nt, Artificial Sequence
  Description of Artificial Sequence: Synthetic oligonucleotide
cuguuaguuagcauaguu

SEQ ID NO: 145346 - RNA, 18 nt, Artificial Sequence
  Description of Artificial Sequence: Synthetic oligonucleotide
gaccacuguuaguuagca

SEQ ID NO: 145347 - RNA, 18 nt, Artificial Sequence
  Description of Artificial Sequence: Synthetic oligonucleotide
cucuagaccacuguuagu

SEQ ID NO: 145348 - RNA, 18 nt, Artificial Sequence
  Description of Artificial Sequence: Synthetic oligonucleotide
guaagcucuagaccacug

SEQ ID NO: 145349 - RNA, 18 nt, Artificial Sequence
  Description of Artificial Sequence: Synthetic oligonucleotide
augaaguaagcucuagac

SEQ ID NO: 145350 - RNA, 18 nt, Artificial Sequence
  Description of Artificial Sequence: Synthetic oligonucleotide
cuggcaugaaguaagcuc

SEQ ID NO: 145351 - RNA, 18 nt, Artificial Sequence
  Description of Artificial Sequence: Synthetic oligonucleotide
agugccuggcaugaagua

SEQ ID NO: 145352 - RNA, 18 nt, Artificial Sequence
  Description of Artificial Sequence: Synthetic oligonucleotide
agaacagugccuggcaug

SEQ ID NO: 145353 - RNA, 18 nt, Artificial Sequence
  Description of Artificial Sequence: Synthetic oligonucleotide
ugaaaagaacagugccug

SEQ ID NO: 145354 - RNA, 18 nt, Artificial Sequence
  Description of Artificial Sequence: Synthetic oligonucleotide
aucgaugaaaagaacagu

SEQ ID NO: 145355 - RNA, 18 nt, Artificial Sequence
  Description of Artificial Sequence: Synthetic oligonucleotide
ucaucaucgaugaaaaga

SEQ ID NO: 145356 - RNA, 18 nt, Artificial Sequence
  Description of Artificial Sequence: Synthetic oligonucleotide
gugagucaucaucgauga

SEQ ID NO: 145357 - RNA, 18 nt, Artificial Sequence
  Description of Artificial Sequence: Synthetic oligonucleotide
aucaagugagucaucauc

SEQ ID NO: 145358 - RNA, 18 nt, Artificial Sequence
  Description of Artificial Sequence: Synthetic oligonucleotide
ugaggaucaagugaguca

SEQ ID NO: 145359 - RNA, 18 nt, Artificial Sequence
  Description of Artificial Sequence: Synthetic oligonucleotide
uguugugaggaucaagug

SEQ ID NO: 145360 - RNA, 18 nt, Artificial Sequence
  Description of Artificial Sequence: Synthetic oligonucleotide
aggguuguugugaggauc

SEQ ID NO: 145361 - RNA, 18 nt, Artificial Sequence
  Description of Artificial Sequence: Synthetic oligonucleotide
ugcacaggguuguuguga

SEQ ID NO: 145362 - RNA, 18 nt, Artificial Sequence
  Description of Artificial Sequence: Synthetic oligonucleotide
cuuccugcacaggguugu

SEQ ID NO: 145363 - RNA, 18 nt, Artificial Sequence
  Description of Artificial Sequence: Synthetic oligonucleotide
acauucuuccugcacagg

SEQ ID NO: 145364 - RNA, 18 nt, Artificial Sequence
  Description of Artificial Sequence: Synthetic oligonucleotide
acaaaacauucuuccugc

SEQ ID NO: 145365 - RNA, 18 nt, Artificial Sequence
  Description of Artificial Sequence: Synthetic oligonucleotide
gagacacaaaacauucuu

SEQ ID NO: 145366 - RNA, 18 nt, Artificial Sequence
  Description of Artificial Sequence: Synthetic oligonucleotide
aaauggagacacaaaaca

SEQ ID NO: 145367 - RNA, 18 nt, Artificial Sequence
  Description of Artificial Sequence: Synthetic oligonucleotide
guguaaaauggagacaca

SEQ ID NO: 145368 - RNA, 18 nt, Artificial Sequence
  Description of Artificial Sequence: Synthetic oligonucleotide
cugauguguaaaauggag

SEQ ID NO: 145369 - RNA, 18 nt, Artificial Sequence
  Description of Artificial Sequence: Synthetic oligonucleotide
ccucucugauguguaaaa

SEQ ID NO: 145370 - RNA, 18 nt, Artificial Sequence
  Description of Artificial Sequence: Synthetic oligonucleotide
uucagccucucugaugug

SEQ ID NO: 145371 - RNA, 18 nt, Artificial Sequence
  Description of Artificial Sequence: Synthetic oligonucleotide
ggucauucagccucucug

SEQ ID NO: 145372 - RNA, 18 nt, Artificial Sequence
  Description of Artificial Sequence: Synthetic oligonucleotide
aggcaggucauucagccu

SEQ ID NO: 145373 - RNA, 18 nt, Artificial Sequence
  Description of Artificial Sequence: Synthetic oligonucleotide
gcuauaggcaggucauuc

SEQ ID NO: 145374 - RNA, 18 nt, Artificial Sequence
  Description of Artificial Sequence: Synthetic oligonucleotide
gugaggcuauaggcaggu

SEQ ID NO: 145375 - RNA, 18 nt, Artificial Sequence
  Description of Artificial Sequence: Synthetic oligonucleotide
ugccugugaggcuauagg

SEQ ID NO: 145376 - RNA, 18 nt, Artificial Sequence
  Description of Artificial Sequence: Synthetic oligonucleotide
gugucugccugugaggcu

SEQ ID NO: 145377 - RNA, 18 nt, Artificial Sequence
  Description of Artificial Sequence: Synthetic oligonucleotide
auccugugucugccugug

SEQ ID NO: 145378 - RNA, 18 nt, Artificial Sequence
  Description of Artificial Sequence: Synthetic oligonucleotide
uucaaauccugugucugc

SEQ ID NO: 145379 - RNA, 18 nt, Artificial Sequence
  Description of Artificial Sequence: Synthetic oligonucleotide
cuuaauucaaauccugug

SEQ ID NO: 145380 - RNA, 18 nt, Artificial Sequence
  Description of Artificial Sequence: Synthetic oligonucleotide
caaugcuuaauucaaauc

SEQ ID NO: 145381 - RNA, 18 nt, Artificial Sequence
  Description of Artificial Sequence: Synthetic oligonucleotide
agacucaaugcuuaauuc

SEQ ID NO: 145382 - RNA, 18 nt, Artificial Sequence
  Description of Artificial Sequence: Synthetic oligonucleotide
uuaagagacucaaugcuu

SEQ ID NO: 145383 - RNA, 18 nt, Artificial Sequence
  Description of Artificial Sequence: Synthetic oligonucleotide
ugugguuaagagacucaa

SEQ ID NO: 145384 - RNA, 18 nt, Artificial Sequence
  Description of Artificial Sequence: Synthetic oligonucleotide
aguauugugguuaagaga

SEQ ID NO: 145385 - RNA, 18 nt, Artificial Sequence
  Description of Artificial Sequence: Synthetic oligonucleotide
aacguaguauugugguua

SEQ ID NO: 145386 - RNA, 18 nt, Artificial Sequence
  Description of Artificial Sequence: Synthetic oligonucleotide
uaggcaacguaguauugu

SEQ ID NO: 145387 - RNA, 18 nt, Artificial Sequence
  Description of Artificial Sequence: Synthetic oligonucleotide
ccgauuaggcaacguagu

SEQ ID NO: 145388 - RNA, 18 nt, Artificial Sequence
  Description of Artificial Sequence: Synthetic oligonucleotide
cccccccgauuaggcaac

SEQ ID NO: 145389 - RNA, 18 nt, Artificial Sequence
  Description of Artificial Sequence: Synthetic oligonucleotide
caccucccccccgauuag

SEQ ID NO: 145390 - RNA, 18 nt, Artificial Sequence
  Description of Artificial Sequence: Synthetic oligonucleotide
guccccaccucccccccg

SEQ ID NO: 145391 - RNA, 18 nt, Artificial Sequence
  Description of Artificial Sequence: Synthetic oligonucleotide
aauuuguccccaccuccc

SEQ ID NO: 145392 - RNA, 18 nt, Artificial Sequence
  Description of Artificial Sequence: Synthetic oligonucleotide
uugccaauuuguccccac

SEQ ID NO: 145393 - RNA, 18 nt, Artificial Sequence
  Description of Artificial Sequence: Synthetic oligonucleotide
guuuuuugccaauuuguc

SEQ ID NO: 145394 - RNA, 18 nt, Artificial Sequence
  Description of Artificial Sequence: Synthetic oligonucleotide
cuuuuguuuuuugccaau

SEQ ID NO: 145395 - RNA, 18 nt, Artificial Sequence
  Description of Artificial Sequence: Synthetic oligonucleotide
cacuucuuuuguuuuuug

SEQ ID NO: 145396 - RNA, 18 nt, Artificial Sequence
  Description of Artificial Sequence: Synthetic oligonucleotide
uaauccacuucuuuuguu

SEQ ID NO: 145397 - RNA, 18 nt, Artificial Sequence
  Description of Artificial Sequence: Synthetic oligonucleotide
ggucuuaauccacuucuu

SEQ ID NO: 145398 - RNA, 18 nt, Artificial Sequence
  Description of Artificial Sequence: Synthetic oligonucleotide
ccccuggucuuaauccac

SEQ ID NO: 145399 - RNA, 18 nt, Artificial Sequence
  Description of Artificial Sequence: Synthetic oligonucleotide
cccuaccccuggucuuaa

SEQ ID NO: 145400 - RNA, 18 nt, Artificial Sequence
  Description of Artificial Sequence: Synthetic oligonucleotide
aaucucccuaccccuggu

SEQ ID NO: 145401 - RNA, 18 nt, Artificial Sequence
  Description of Artificial Sequence: Synthetic oligonucleotide
guucuaaucucccuaccc

SEQ ID NO: 145402 - RNA, 18 nt, Artificial Sequence
  Description of Artificial Sequence: Synthetic oligonucleotide
uggguguucuaaucuccc

SEQ ID NO: 145403 - RNA, 18 nt, Artificial Sequence
  Description of Artificial Sequence: Synthetic oligonucleotide
uccacuggguguucuaau

SEQ ID NO: 145404 - RNA, 18 nt, Artificial Sequence
  Description of Artificial Sequence: Synthetic oligonucleotide
aaugcuccacuggguguu

SEQ ID NO: 145405 - RNA, 18 nt, Artificial Sequence
  Description of Artificial Sequence: Synthetic oligonucleotide
ucagcaaugcuccacugg

SEQ ID NO: 145406 - RNA, 18 nt, Artificial Sequence
  Description of Artificial Sequence: Synthetic oligonucleotide
ucccaucagcaaugcucc

SEQ ID NO: 145407 - RNA, 18 nt, Artificial Sequence
  Description of Artificial Sequence: Synthetic oligonucleotide
cccugucccaucagcaau

SEQ ID NO: 145408 - RNA, 18 nt, Artificial Sequence
  Description of Artificial Sequence: Synthetic oligonucleotide
ccaagcccugucccauca

SEQ ID NO: 145409 - RNA, 18 nt, Artificial Sequence
  Description of Artificial Sequence: Synthetic oligonucleotide
acagaccaagcccugucc

SEQ ID NO: 145410 - RNA, 18 nt, Artificial Sequence
  Description of Artificial Sequence: Synthetic oligonucleotide
ccgugacagaccaagccc

SEQ ID NO: 145411 - RNA, 18 nt, Artificial Sequence
  Description of Artificial Sequence: Synthetic oligonucleotide
cuuggccgugacagacca

SEQ ID NO: 145412 - RNA, 18 nt, Artificial Sequence
  Description of Artificial Sequence: Synthetic oligonucleotide
gccuccuuggccgugaca

SEQ ID NO: 145413 - RNA, 18 nt, Artificial Sequence
  Description of Artificial Sequence: Synthetic oligonucleotide
ggcaggccuccuuggccg

SEQ ID NO: 145414 - RNA, 18 nt, Artificial Sequence
  Description of Artificial Sequence: Synthetic oligonucleotide
gggacggcaggccuccuu

SEQ ID NO: 145415 - RNA, 18 nt, Artificial Sequence
  Description of Artificial Sequence: Synthetic oligonucleotide
aggugacuuggcccaggg

SEQ ID NO: 145416 - RNA, 18 nt, Artificial Sequence
  Description of Artificial Sequence: Synthetic oligonucleotide
agaggugacuuggcccag

SEQ ID NO: 145417 - RNA, 18 nt, Artificial Sequence
  Description of Artificial Sequence: Synthetic oligonucleotide
ccccaagaggugacuugg

SEQ ID NO: 145418 - RNA, 18 nt, Artificial Sequence
  Description of Artificial Sequence: Synthetic oligonucleotide
uuccaccccaagagguga

SEQ ID NO: 145419 - RNA, 18 nt, Artificial Sequence
  Description of Artificial Sequence: Synthetic oligonucleotide
ccuacuuccaccccaaga

SEQ ID NO: 145420 - RNA, 18 nt, Artificial Sequence
  Description of Artificial Sequence: Synthetic oligonucleotide
gcuccccuacuuccaccc

SEQ ID NO: 145421 - RNA, 18 nt, Artificial Sequence
  Description of Artificial Sequence: Synthetic oligonucleotide
guggagcuccccuacuuc

SEQ ID NO: 145422 - RNA, 18 nt, Artificial Sequence
  Description of Artificial Sequence: Synthetic oligonucleotide
aggcaguggagcuccccu

SEQ ID NO: 145423 - RNA, 18 nt, Artificial Sequence
  Description of Artificial Sequence: Synthetic oligonucleotide
cagaaaggcaguggagcu

SEQ ID NO: 145424 - RNA, 18 nt, Artificial Sequence
  Description of Artificial Sequence: Synthetic oligonucleotide
gagcucagaaaggcagug

SEQ ID NO: 145425 - RNA, 18 nt, Artificial Sequence
  Description of Artificial Sequence: Synthetic oligonucleotide
ccagggagcucagaaagg

SEQ ID NO: 145426 - RNA, 18 nt, Artificial Sequence
  Description of Artificial Sequence: Synthetic oligonucleotide
gcacgccagggagcucag

SEQ ID NO: 145427 - RNA, 18 nt, Artificial Sequence
  Description of Artificial Sequence: Synthetic oligonucleotide
uucaugaggccuggccgg

SEQ ID NO: 145428 - RNA, 18 nt, Artificial Sequence
  Description of Artificial Sequence: Synthetic oligonucleotide
gaacguucaugaggccug

SEQ ID NO: 145429 - RNA, 18 nt, Artificial Sequence
  Description of Artificial Sequence: Synthetic oligonucleotide
ccguggaacguucaugag

SEQ ID NO: 145430 - RNA, 18 nt, Artificial Sequence
  Description of Artificial Sequence: Synthetic oligonucleotide
uccacccguggaacguuc

SEQ ID NO: 145431 - RNA, 18 nt, Artificial Sequence
  Description of Artificial Sequence: Synthetic oligonucleotide
uagccuccacccguggaa

SEQ ID NO: 145432 - RNA, 18 nt, Artificial Sequence
  Description of Artificial Sequence: Synthetic oligonucleotide
cuggauagccuccacccg

SEQ ID NO: 145433 - RNA, 18 nt, Artificial Sequence
  Description of Artificial Sequence: Synthetic oligonucleotide
guguccuggauagccucc

SEQ ID NO: 145434 - RNA, 18 nt, Artificial Sequence
  Description of Artificial Sequence: Synthetic oligonucleotide
ggaugguguccuggauag

SEQ ID NO: 145435 - RNA, 18 nt, Artificial Sequence
  Description of Artificial Sequence: Synthetic oligonucleotide
acgcaggaugguguccug

SEQ ID NO: 145436 - RNA, 18 nt, Artificial Sequence
  Description of Artificial Sequence: Synthetic oligonucleotide
agggcacgcaggauggug

SEQ ID NO: 145437 - RNA, 18 nt, Artificial Sequence
  Description of Artificial Sequence: Synthetic oligonucleotide
auucgagggcacgcagga

SEQ ID NO: 145438 - RNA, 18 nt, Artificial Sequence
  Description of Artificial Sequence: Synthetic oligonucleotide
guggaauucgagggcacg

SEQ ID NO: 145439 - RNA, 18 nt, Artificial Sequence
  Description of Artificial Sequence: Synthetic oligonucleotide
ugcagguggaauucgagg

SEQ ID NO: 145440 - RNA, 18 nt, Artificial Sequence
  Description of Artificial Sequence: Synthetic oligonucleotide
uggccugcagguggaauu

SEQ ID NO: 145441 - RNA, 18 nt, Artificial Sequence
  Description of Artificial Sequence: Synthetic oligonucleotide
gugguuggccugcaggug

SEQ ID NO: 145442 - RNA, 18 nt, Artificial Sequence
  Description of Artificial Sequence: Synthetic oligonucleotide
ucagggugguuggccugc

SEQ ID NO: 145443 - RNA, 18 nt, Artificial Sequence
  Description of Artificial Sequence: Synthetic oligonucleotide
gggcaucagggugguugg

SEQ ID NO: 145444 - RNA, 18 nt, Artificial Sequence
  Description of Artificial Sequence: Synthetic oligonucleotide
guacugggcaucagggug

SEQ ID NO: 145445 - RNA, 18 nt, Artificial Sequence
  Description of Artificial Sequence: Synthetic oligonucleotide
aagagguacugggcauca

SEQ ID NO: 145446 - RNA, 18 nt, Artificial Sequence
  Description of Artificial Sequence: Synthetic oligonucleotide
gggaagagguacugggca

SEQ ID NO: 145447 - RNA, 18 nt, Artificial Sequence
  Description of Artificial Sequence: Synthetic oligonucleotide
cuucugcagcagcuuggg

SEQ ID NO: 145448 - RNA, 18 nt, Artificial Sequence
  Description of Artificial Sequence: Synthetic oligonucleotide
gccaucuucugcagcagc

SEQ ID NO: 145449 - RNA, 18 nt, Artificial Sequence
  Description of Artificial Sequence: Synthetic oligonucleotide
ggucagccaucuucugca

SEQ ID NO: 145450 - RNA, 18 nt, Artificial Sequence
  Description of Artificial Sequence: Synthetic oligonucleotide
ccgcaggucagccaucuu

SEQ ID NO: 145451 - RNA, 18 nt, Artificial Sequence
  Description of Artificial Sequence: Synthetic oligonucleotide
aguugccgcaggucagcc

SEQ ID NO: 145452 - RNA, 18 nt, Artificial Sequence
  Description of Artificial Sequence: Synthetic oligonucleotide
ugaccaguugccgcaggu

SEQ ID NO: 145453 - RNA, 18 nt, Artificial Sequence
  Description of Artificial Sequence: Synthetic oligonucleotide
cucggugaccaguugccg

SEQ ID NO: 145454 - RNA, 18 nt, Artificial Sequence
  Description of Artificial Sequence: Synthetic oligonucleotide
gcgugcucggugaccagu

SEQ ID NO: 145455 - RNA, 18 nt, Artificial Sequence
  Description of Artificial Sequence: Synthetic oligonucleotide
ucugggcgugcucgguga

SEQ ID NO: 145456 - RNA, 18 nt, Artificial Sequence
  Description of Artificial Sequence: Synthetic oligonucleotide
caucaucugggcgugcuc

SEQ ID NO: 145457 - RNA, 18 nt, Artificial Sequence
  Description of Artificial Sequence: Synthetic oligonucleotide
cgcugcaucaucugggcg

SEQ ID NO: 145458 - RNA, 18 nt, Artificial Sequence
  Description of Artificial Sequence: Synthetic oligonucleotide
ugauccgcugcaucaucu

SEQ ID NO: 145459 - RNA, 18 nt, Artificial Sequence
  Description of Artificial Sequence: Synthetic oligonucleotide
cuucuugauccgcugcau

SEQ ID NO: 145460 - RNA, 18 nt, Artificial Sequence
  Description of Artificial Sequence: Synthetic oligonucleotide
ucggucuucuugauccgc

SEQ ID NO: 145461 - RNA, 18 nt, Artificial Sequence
  Description of Artificial Sequence: Synthetic oligonucleotide
cgguuucggucuucuuga

SEQ ID NO: 145462 - RNA, 18 nt, Artificial Sequence
  Description of Artificial Sequence: Synthetic oligonucleotide
ggucucgguuucggucuu

SEQ ID NO: 145463 - RNA, 18 nt, Artificial Sequence
  Description of Artificial Sequence: Synthetic oligonucleotide
agcgaggucucgguuucg

SEQ ID NO: 145464 - RNA, 18 nt, Artificial Sequence
  Description of Artificial Sequence: Synthetic oligonucleotide
ggugcagcgaggucucgg

SEQ ID NO: 145465 - RNA, 18 nt, Artificial Sequence
  Description of Artificial Sequence: Synthetic oligonucleotide
cagagggugcagcgaggu

SEQ ID NO: 145466 - RNA, 18 nt, Artificial Sequence
  Description of Artificial Sequence: Synthetic oligonucleotide
uggagcagagggugcagc

SEQ ID NO: 145467 - RNA, 18 nt, Artificial Sequence
  Description of Artificial Sequence: Synthetic oligonucleotide
ucuccuggagcagagggu

SEQ ID NO: 145468 - RNA, 18 nt, Artificial Sequence
  Description of Artificial Sequence: Synthetic oligonucleotide
guagaucuccuggagcag

SEQ ID NO: 145469 - RNA, 18 nt, Artificial Sequence
  Description of Artificial Sequence: Synthetic oligonucleotide
uccuuguagaucuccugg

SEQ ID NO: 145470 - RNA, 18 nt, Artificial Sequence
  Description of Artificial Sequence: Synthetic oligonucleotide
acauguccuuguagaucu

SEQ ID NO: 145471 - RNA, 18 nt, Artificial Sequence
  Description of Artificial Sequence: Synthetic oligonucleotide
uuaguacauguccuugua

SEQ ID NO: 145472 - RNA, 18 nt, Artificial Sequence
  Description of Artificial Sequence: Synthetic oligonucleotide
cgccguuaguacaugucc

SEQ ID NO: 145473 - RNA, 18 nt, Artificial Sequence
  Description of Artificial Sequence: Synthetic oligonucleotide
ggugccgccguuaguaca

SEQ ID NO: 145474 - RNA, 18 nt, Artificial Sequence
  Description of Artificial Sequence: Synthetic oligonucleotide
gccugggugccgccguua

SEQ ID NO: 145475 - RNA, 18 nt, Artificial Sequence
  Description of Artificial Sequence: Synthetic oligonucleotide
gggaggccugggugccgc

SEQ ID NO: 145476 - RNA, 18 nt, Artificial Sequence
  Description of Artificial Sequence: Synthetic oligonucleotide
cugcagggaggccugggu

SEQ ID NO: 145477 - RNA, 18 nt, Artificial Sequence
  Description of Artificial Sequence: Synthetic oligonucleotide
ggagucugcagggaggcc

SEQ ID NO: 145478 - RNA, 18 nt, Artificial Sequence
  Description of Artificial Sequence: Synthetic oligonucleotide
ccauuggagucugcaggg

SEQ ID NO: 145479 - RNA, 18 nt, Artificial Sequence
  Description of Artificial Sequence: Synthetic oligonucleotide
uggccccauuggagucug

SEQ ID NO: 145480 - RNA, 18 nt, Artificial Sequence
  Description of Artificial Sequence: Synthetic oligonucleotide
agugcuggccccauugga

SEQ ID NO: 145481 - RNA, 18 nt, Artificial Sequence
  Description of Artificial Sequence: Synthetic oligonucleotide
ccuccagugcuggcccca

SEQ ID NO: 145482 - RNA, 18 nt, Artificial Sequence
  Description of Artificial Sequence: Synthetic oligonucleotide
gggccccuccagugcugg

SEQ ID NO: 145483 - RNA, 18 nt, Artificial Sequence
  Description of Artificial Sequence: Synthetic oligonucleotide
ugggugggccccuccagu

SEQ ID NO: 145484 - RNA, 18 nt, Artificial Sequence
  Description of Artificial Sequence: Synthetic oligonucleotide
ucaugugggugggccccu

SEQ ID NO: 145485 - RNA, 18 nt, Artificial Sequence
  Description of Artificial Sequence: Synthetic oligonucleotide
aaaagucauguggguggg

SEQ ID NO: 145486 - RNA, 18 nt, Artificial Sequence
  Description of Artificial Sequence: Synthetic oligonucleotide
aauggaaaagucaugugg

SEQ ID NO: 145487 - RNA, 18 nt, Artificial Sequence
  Description of Artificial Sequence: Synthetic oligonucleotide
uggucaauggaaaaguca

SEQ ID NO: 145488 - RNA, 18 nt, Artificial Sequence
  Description of Artificial Sequence: Synthetic oligonucleotide
agggcuggucaauggaaa

SEQ ID NO: 145489 - RNA, 18 nt, Artificial Sequence
  Description of Artificial Sequence: Synthetic oligonucleotide
gcucaagggcuggucaau

SEQ ID NO: 145490 - RNA, 18 nt, Artificial Sequence
  Description of Artificial Sequence: Synthetic oligonucleotide
cgggugcucaagggcugg

SEQ ID NO: 145491 - RNA, 18 nt, Artificial Sequence
  Description of Artificial Sequence: Synthetic oligonucleotide
caggccgggugcucaagg

SEQ ID NO: 145492 - RNA, 18 nt, Artificial Sequence
  Description of Artificial Sequence: Synthetic oligonucleotide
ugcuccaggccgggugcu

SEQ ID NO: 145493 - RNA, 18 nt, Artificial Sequence
  Description of Artificial Sequence: Synthetic oligonucleotide
ucugcugcuccaggccgg

SEQ ID NO: 145494 - RNA, 18 nt, Artificial Sequence
  Description of Artificial Sequence: Synthetic oligonucleotide
gggacucugcugcuccag

SEQ ID NO: 145495 - RNA, 18 nt, Artificial Sequence
  Description of Artificial Sequence: Synthetic oligonucleotide
aucgugggacucugcugc

SEQ ID NO: 145496 - RNA, 18 nt, Artificial Sequence
  Description of Artificial Sequence: Synthetic oligonucleotide
gggcgaucgugggacucu

SEQ ID NO: 145497 - RNA, 18 nt, Artificial Sequence
  Description of Artificial Sequence: Synthetic oligonucleotide
ucugagggcgaucguggg

SEQ ID NO: 145498 - RNA, 18 nt, Artificial Sequence
  Description of Artificial Sequence: Synthetic oligonucleotide
augugucugagggcgauc

SEQ ID NO: 145499 - RNA, 18 nt, Artificial Sequence
  Description of Artificial Sequence: Synthetic oligonucleotide
gugucaugugucugaggg

SEQ ID NO: 145500 - RNA, 18 nt, Artificial Sequence
  Description of Artificial Sequence: Synthetic oligonucleotide
cgugggugucaugugucu

SEQ ID NO: 145501 - RNA, 18 nt, Artificial Sequence
  Description of Artificial Sequence: Synthetic oligonucleotide
gaggccgugggugucaug

SEQ ID NO: 145502 - RNA, 18 nt, Artificial Sequence
  Description of Artificial Sequence: Synthetic oligonucleotide
agccagaggccgugggug

SEQ ID NO: 145503 - RNA, 18 nt, Artificial Sequence
  Description of Artificial Sequence: Synthetic oligonucleotide
cagggagccagaggccgu

SEQ ID NO: 145504 - RNA, 18 nt, Artificial Sequence
  Description of Artificial Sequence: Synthetic oligonucleotide
gggcacagggagccagag

SEQ ID NO: 145505 - RNA, 18 nt, Artificial Sequence
  Description of Artificial Sequence: Synthetic oligonucleotide
agagagggcacagggagc

SEQ ID NO: 145506 - RNA, 18 nt, Artificial Sequence
  Description of Artificial Sequence: Synthetic oligonucleotide
gcgggagagagggcacag

SEQ ID NO: 145507 - RNA, 18 nt, Artificial Sequence
  Description of Artificial Sequence: Synthetic oligonucleotide
aggaagcgggagagaggg

SEQ ID NO: 145508 - RNA, 18 nt, Artificial Sequence
  Description of Artificial Sequence: Synthetic oligonucleotide
gcuggaggaagcgggaga

SEQ ID NO: 145509 - RNA, 18 nt, Artificial Sequence
  Description of Artificial Sequence: Synthetic oligonucleotide
agcuggcuggaggaagcg

SEQ ID NO: 145510 - RNA, 18 nt, Artificial Sequence
  Description of Artificial Sequence: Synthetic oligonucleotide
aagagagcuggcuggagg

SEQ ID NO: 145511 - RNA, 18 nt, Artificial Sequence
  Description of Artificial Sequence: Synthetic oligonucleotide
acaggaagagagcuggcu

SEQ ID NO: 145512 - RNA, 18 nt, Artificial Sequence
  Description of Artificial Sequence: Synthetic oligonucleotide
caaagacaggaagagagc

SEQ ID NO: 145513 - RNA, 18 nt, Artificial Sequence
  Description of Artificial Sequence: Synthetic oligonucleotide
gacaacaaagacaggaag

SEQ ID NO: 145514 - RNA, 18 nt, Artificial Sequence
  Description of Artificial Sequence: Synthetic oligonucleotide
agggagacaacaaagaca

SEQ ID NO: 145515 - RNA, 18 nt, Artificial Sequence
  Description of Artificial Sequence: Synthetic oligonucleotide
gaaagagggagacaacaa

SEQ ID NO: 145516 - RNA, 18 nt, Artificial Sequence
  Description of Artificial Sequence: Synthetic oligonucleotide
acugagaaagagggagac

SEQ ID NO: 145517 - RNA, 18 nt, Artificial Sequence
  Description of Artificial Sequence: Synthetic oligonucleotide
gaggaacugagaaagagg

SEQ ID NO: 145518 - RNA, 18 nt, Artificial Sequence
  Description of Artificial Sequence: Synthetic oligonucleotide
agaaagaggaacugagaa

SEQ ID NO: 145519 - RNA, 18 nt, Artificial Sequence
  Description of Artificial Sequence: Synthetic oligonucleotide
agaaaagaaagaggaacu

SEQ ID NO: 145520 - RNA, 18 nt, Artificial Sequence
  Description of Artificial Sequence: Synthetic oligonucleotide
gaauuagaaaagaaagag

SEQ ID NO: 145521 - RNA, 18 nt, Artificial Sequence
  Description of Artificial Sequence: Synthetic oligonucleotide
aacaggaauuagaaaaga

SEQ ID NO: 145522 - RNA, 18 nt, Artificial Sequence
  Description of Artificial Sequence: Synthetic oligonucleotide
agagcaacaggaauuaga

SEQ ID NO: 145523 - RNA, 18 nt, Artificial Sequence
  Description of Artificial Sequence: Synthetic oligonucleotide
gaaacagagcaacaggaa

SEQ ID NO: 145524 - RNA, 18 nt, Artificial Sequence
  Description of Artificial Sequence: Synthetic oligonucleotide
aggaagaaacagagcaac

SEQ ID NO: 145525 - RNA, 18 nt, Artificial Sequence
  Description of Artificial Sequence: Synthetic oligonucleotide
cagaaaggaagaaacaga

SEQ ID NO: 145526 - RNA, 18 nt, Artificial Sequence
  Description of Artificial Sequence: Synthetic oligonucleotide
accuacagaaaggaagaa

SEQ ID NO: 145527 - RNA, 18 nt, Artificial Sequence
  Description of Artificial Sequence: Synthetic oligonucleotide
gagaaaccuacagaaagg

SEQ ID NO: 145528 - RNA, 18 nt, Artificial Sequence
  Description of Artificial Sequence: Synthetic oligonucleotide
gaagagagaaaccuacag

SEQ ID NO: 145529 - RNA, 18 nt, Artificial Sequence
  Description of Artificial Sequence: Synthetic oligonucleotide
gaagggaagagagaaacc

SEQ ID NO: 145530 - RNA, 18 nt, Artificial Sequence
  Description of Artificial Sequence: Synthetic oligonucleotide
agggagaagggaagagag

SEQ ID NO: 145531 - RNA, 18 nt, Artificial Sequence
  Description of Artificial Sequence: Synthetic oligonucleotide
gggcaagggagaagggaa

SEQ ID NO: 145532 - RNA, 18 nt, Artificial Sequence
  Description of Artificial Sequence: Synthetic oligonucleotide
agggagggcaagggagaa

SEQ ID NO: 145533 - RNA, 18 nt, Artificial Sequence
  Description of Artificial Sequence: Synthetic oligonucleotide
gagaaagggagggcaagg

SEQ ID NO: 145534 - RNA, 18 nt, Artificial Sequence
  Description of Artificial Sequence: Synthetic oligonucleotide
ggagagagaaagggaggg

SEQ ID NO: 145535 - RNA, 18 nt, Artificial Sequence
  Description of Artificial Sequence: Synthetic oligonucleotide
ggguggagagagaaaggg

SEQ ID NO: 145536 - RNA, 18 nt, Artificial Sequence
  Description of Artificial Sequence: Synthetic oligonucleotide
aaggaggacagacguggg

SEQ ID NO: 145537 - RNA, 18 nt, Artificial Sequence
  Description of Artificial Sequence: Synthetic oligonucleotide
uaagaaaggaggacagac

SEQ ID NO: 145538 - RNA, 18 nt, Artificial Sequence
  Description of Artificial Sequence: Synthetic oligonucleotide
cagaauaagaaaggagga

SEQ ID NO: 145539 - RNA, 18 nt, Artificial Sequence
  Description of Artificial Sequence: Synthetic oligonucleotide
ucucacagaauaagaaag

SEQ ID NO: 145540 - RNA, 18 nt, Artificial Sequence
  Description of Artificial Sequence: Synthetic oligonucleotide
aaacaucucacagaauaa

SEQ ID NO: 145541 - RNA, 18 nt, Artificial Sequence
  Description of Artificial Sequence: Synthetic oligonucleotide
auacaaaacaucucacag

SEQ ID NO: 145542 - RNA, 18 nt, Artificial Sequence
  Description of Artificial Sequence: Synthetic oligonucleotide
aaauaauacaaaacaucu

SEQ ID NO: 145543 - RNA, 18 nt, Artificial Sequence
  Description of Artificial Sequence: Synthetic oligonucleotide
uggugaaauaauacaaaa

SEQ ID NO: 145544 - RNA, 18 nt, Artificial Sequence
  Description of Artificial Sequence: Synthetic oligonucleotide
gcugcuggugaaauaaua

SEQ ID NO: 145545 - RNA, 18 nt, Artificial Sequence
  Description of Artificial Sequence: Synthetic oligonucleotide
ucuaugcugcuggugaaa

SEQ ID NO: 145546 - RNA, 18 nt, Artificial Sequence
  Description of Artificial Sequence: Synthetic oligonucleotide
ccuguucuaugcugcugg

SEQ ID NO: 145547 - RNA, 18 nt, Artificial Sequence
  Description of Artificial Sequence: Synthetic oligonucleotide
gagguccuguucuaugcu

SEQ ID NO: 145548 - RNA, 18 nt, Artificial Sequence
  Description of Artificial Sequence: Synthetic oligonucleotide
aagcagagguccuguucu

SEQ ID NO: 145549 - RNA, 18 nt, Artificial Sequence
  Description of Artificial Sequence: Synthetic oligonucleotide
ugcaaaagcagagguccu

SEQ ID NO: 145550 - RNA, 18 nt, Artificial Sequence
  Description of Artificial Sequence: Synthetic oligonucleotide
aggugugcaaaagcagag

SEQ ID NO: 145551 - RNA, 18 nt, Artificial Sequence
  Description of Artificial Sequence: Synthetic oligonucleotide
ggaaaaggugugcaaaag

SEQ ID NO: 145552 - RNA, 18 nt, Artificial Sequence
  Description of Artificial Sequence: Synthetic oligonucleotide
gggaaaaggugugcaaaa

SEQ ID NO: 145553 - RNA, 18 nt, Artificial Sequence
  Description of Artificial Sequence: Synthetic oligonucleotide
cucucuucugcuccuggg

SEQ ID NO: 145554 - RNA, 18 nt, Artificial Sequence
  Description of Artificial Sequence: Synthetic oligonucleotide
ccccacucucuucugcuc

SEQ ID NO: 145555 - RNA, 18 nt, Artificial Sequence
  Description of Artificial Sequence: Synthetic oligonucleotide
gcaggccccacucucuuc

SEQ ID NO: 145556 - RNA, 18 nt, Artificial Sequence
  Description of Artificial Sequence: Synthetic oligonucleotide
agagggcaggccccacuc

SEQ ID NO: 145557 - RNA, 18 nt, Artificial Sequence
  Description of Artificial Sequence: Synthetic oligonucleotide
gggcagagggcaggcccc

SEQ ID NO: 145558 - RNA, 18 nt, Artificial Sequence
  Description of Artificial Sequence: Synthetic oligonucleotide
ugcaggugcaaugauggg

SEQ ID NO: 145559 - RNA, 18 nt, Artificial Sequence
  Description of Artificial Sequence: Synthetic oligonucleotide
aagccugcaggugcaaug

SEQ ID NO: 145560 - RNA, 18 nt, Artificial Sequence
  Description of Artificial Sequence: Synthetic oligonucleotide
gaccuaagccugcaggug

SEQ ID NO: 145561 - RNA, 18 nt, Artificial Sequence
  Description of Artificial Sequence: Synthetic oligonucleotide
gugaggaccuaagccugc

SEQ ID NO: 145562 - RNA, 18 nt, Artificial Sequence
  Description of Artificial Sequence: Synthetic oligonucleotide
cagaagugaggaccuaag

SEQ ID NO: 145563 - RNA, 18 nt, Artificial Sequence
  Description of Artificial Sequence: Synthetic oligonucleotide
ggagacagaagugaggac

SEQ ID NO: 145564 - RNA, 18 nt, Artificial Sequence
  Description of Artificial Sequence: Synthetic oligonucleotide
agacaggagacagaagug

SEQ ID NO: 145565 - RNA, 18 nt, Artificial Sequence
  Description of Artificial Sequence: Synthetic oligonucleotide
ucugaagacaggagacag

SEQ ID NO: 145566 - RNA, 18 nt, Artificial Sequence
  Description of Artificial Sequence: Synthetic oligonucleotide
uuugcucugaagacagga

SEQ ID NO: 145567 - RNA, 18 nt, Artificial Sequence
  Description of Artificial Sequence: Synthetic oligonucleotide
agucuuuugcucugaaga

SEQ ID NO: 145568 - RNA, 18 nt, Artificial Sequence
  Description of Artificial Sequence: Synthetic oligonucleotide
gcucaagucuuuugcucu

SEQ ID NO: 145569 - RNA, 18 nt, Artificial Sequence
  Description of Artificial Sequence: Synthetic oligonucleotide
ggauggcucaagucuuuu

SEQ ID NO: 145570 - RNA, 18 nt, Artificial Sequence
  Description of Artificial Sequence: Synthetic oligonucleotide
ucuuuggauggcucaagu

SEQ ID NO: 145571 - RNA, 18 nt, Artificial Sequence
  Description of Artificial Sequence: Synthetic oligonucleotide
guguuucuuuggauggcu

SEQ ID NO: 145572 - RNA, 18 nt, Artificial Sequence
  Description of Artificial Sequence: Synthetic oligonucleotide
gcuuaguguuucuuugga

SEQ ID NO: 145573 - RNA, 18 nt, Artificial Sequence
  Description of Artificial Sequence: Synthetic oligonucleotide
agagagcuuaguguuucu

SEQ ID NO: 145574 - RNA, 18 nt, Artificial Sequence
  Description of Artificial Sequence: Synthetic oligonucleotide
ggcccagagagcuuagug

SEQ ID NO: 145575 - RNA, 18 nt, Artificial Sequence
  Description of Artificial Sequence: Synthetic oligonucleotide
acccaggcccagagagcu

SEQ ID NO: 145576 - RNA, 18 nt, Artificial Sequence
  Description of Artificial Sequence: Synthetic oligonucleotide
cuggaacccaggcccaga

SEQ ID NO: 145577 - RNA, 18 nt, Artificial Sequence
  Description of Artificial Sequence: Synthetic oligonucleotide
cuucccuggaacccaggc

SEQ ID NO: 145578 - RNA, 18 nt, Artificial Sequence
  Description of Artificial Sequence: Synthetic oligonucleotide
uuagccuucccuggaacc

SEQ ID NO: 145579 - RNA, 18 nt, Artificial Sequence
  Description of Artificial Sequence: Synthetic oligonucleotide
caugcuuagccuucccug

SEQ ID NO: 145580 - RNA, 18 nt, Artificial Sequence
  Description of Artificial Sequence: Synthetic oligonucleotide
caggccaugcuuagccuu

SEQ ID NO: 145581 - RNA, 18 nt, Artificial Sequence
  Description of Artificial Sequence: Synthetic oligonucleotide
caguccaggccaugcuua

SEQ ID NO: 145582 - RNA, 18 nt, Artificial Sequence
  Description of Artificial Sequence: Synthetic oligonucleotide
gcagucaguccaggccau

SEQ ID NO: 145583 - RNA, 18 nt, Artificial Sequence
  Description of Artificial Sequence: Synthetic oligonucleotide
gggcugcagucaguccag

SEQ ID NO: 145584 - RNA, 18 nt, Artificial Sequence
  Description of Artificial Sequence: Synthetic oligonucleotide
agggaccccaugacuaua

SEQ ID NO: 145585 - RNA, 18 nt, Artificial Sequence
  Description of Artificial Sequence: Synthetic oligonucleotide
gcagcagggaccccauga

SEQ ID NO: 145586 - RNA, 18 nt, Artificial Sequence
  Description of Artificial Sequence: Synthetic oligonucleotide
ccuuugcagcagggaccc

SEQ ID NO: 145587 - RNA, 18 nt, Artificial Sequence
  Description of Artificial Sequence: Synthetic oligonucleotide
acuguccuuugcagcagg

SEQ ID NO: 145588 - RNA, 18 nt, Artificial Sequence
  Description of Artificial Sequence: Synthetic oligonucleotide
ugcccacuguccuuugca

SEQ ID NO: 145589 - RNA, 18 nt, Artificial Sequence
  Description of Artificial Sequence: Synthetic oligonucleotide
ccuccugcccacuguccu

SEQ ID NO: 145590 - RNA, 18 nt, Artificial Sequence
  Description of Artificial Sequence: Synthetic oligonucleotide
gggccuccugcccacugu

SEQ ID NO: 145591 - RNA, 18 nt, Artificial Sequence
  Description of Artificial Sequence: Synthetic oligonucleotide
ucuggcucucagccuggg

SEQ ID NO: 145592 - RNA, 18 nt, Artificial Sequence
  Description of Artificial Sequence: Synthetic oligonucleotide
aggcaucuggcucucagc

SEQ ID NO: 145593 - RNA, 18 nt, Artificial Sequence
  Description of Artificial Sequence: Synthetic oligonucleotide
gggaggcaucuggcucuc

SEQ ID NO: 145594 - RNA, 18 nt, Artificial Sequence
  Description of Artificial Sequence: Synthetic oligonucleotide
ggcaaugacagucuuggg

SEQ ID NO: 145595 - RNA, 18 nt, Artificial Sequence
  Description of Artificial Sequence: Synthetic oligonucleotide
gggcaaugacagucuugg

SEQ ID NO: 145596 - RNA, 18 nt, Artificial Sequence
  Description of Artificial Sequence: Synthetic oligonucleotide
ggccucagcaucggaggg

SEQ ID NO: 145597 - RNA, 18 nt, Artificial Sequence
  Description of Artificial Sequence: Synthetic oligonucleotide
uggguggccucagcaucg

SEQ ID NO: 145598 - RNA, 18 nt, Artificial Sequence
  Description of Artificial Sequence: Synthetic oligonucleotide
gucaguggguggccucag

SEQ ID NO: 145599 - RNA, 18 nt, Artificial Sequence
  Description of Artificial Sequence: Synthetic oligonucleotide
guugggucaguggguggc

SEQ ID NO: 145600 - RNA, 18 nt, Artificial Sequence
  Description of Artificial Sequence: Synthetic oligonucleotide
gaucaguugggucagugg

SEQ ID NO: 145601 - RNA, 18 nt, Artificial Sequence
  Description of Artificial Sequence: Synthetic oligonucleotide
agcaggaucaguuggguc

SEQ ID NO: 145602 - RNA, 18 nt, Artificial Sequence
  Description of Artificial Sequence: Synthetic oligonucleotide
gcuggagcaggaucaguu

SEQ ID NO: 145603 - RNA, 18 nt, Artificial Sequence
  Description of Artificial Sequence: Synthetic oligonucleotide
gugcugcuggagcaggau

SEQ ID NO: 145604 - RNA, 18 nt, Artificial Sequence
  Description of Artificial Sequence: Synthetic oligonucleotide
gaggugugcugcuggagc

SEQ ID NO: 145605 - RNA, 18 nt, Artificial Sequence
  Description of Artificial Sequence: Synthetic oligonucleotide
gggcugaggugugcugcu

SEQ ID NO: 145606 - RNA, 18 nt, Artificial Sequence
  Description of Artificial Sequence: Synthetic oligonucleotide
aaggacacugggugucag

SEQ ID NO: 145607 - RNA, 18 nt, Artificial Sequence
  Description of Artificial Sequence: Synthetic oligonucleotide
gauggaaggacacugggu

SEQ ID NO: 145608 - RNA, 18 nt, Artificial Sequence
  Description of Artificial Sequence: Synthetic oligonucleotide
gugaagauggaaggacac

SEQ ID NO: 145609 - RNA, 18 nt, Artificial Sequence
  Description of Artificial Sequence: Synthetic oligonucleotide
ccagugugaagauggaag

SEQ ID NO: 145610 - RNA, 18 nt, Artificial Sequence
  Description of Artificial Sequence: Synthetic oligonucleotide
gcaaaccagugugaagau

SEQ ID NO: 145611 - RNA, 18 nt, Artificial Sequence
  Description of Artificial Sequence: Synthetic oligonucleotide
gccuggcaaaccagugug

SEQ ID NO: 145612 - RNA, 18 nt, Artificial Sequence
  Description of Artificial Sequence: Synthetic oligonucleotide
cauuggccuggcaaacca

SEQ ID NO: 145613 - RNA, 18 nt, Artificial Sequence
  Description of Artificial Sequence: Synthetic oligonucleotide
agcaacauuggccuggca

SEQ ID NO: 145614 - RNA, 18 nt, Artificial Sequence
  Description of Artificial Sequence: Synthetic oligonucleotide
ccaucagcaacauuggcc

SEQ ID NO: 145615 - RNA, 18 nt, Artificial Sequence
  Description of Artificial Sequence: Synthetic oligonucleotide
gggccaucagcaacauug

SEQ ID NO: 145616 - RNA, 18 nt, Artificial Sequence
  Description of Artificial Sequence: Synthetic oligonucleotide
ccagcggccagugcaggg

SEQ ID NO: 145617 - RNA, 18 nt, Artificial Sequence
  Description of Artificial Sequence: Synthetic oligonucleotide
gccguccagcggccagug

SEQ ID NO: 145618 - RNA, 18 nt, Artificial Sequence
  Description of Artificial Sequence: Synthetic oligonucleotide
agagugccguccagcggc

SEQ ID NO: 145619 - RNA, 18 nt, Artificial Sequence
  Description of Artificial Sequence: Synthetic oligonucleotide
cugggagagugccgucca

SEQ ID NO: 145620 - RNA, 18 nt, Artificial Sequence
  Description of Artificial Sequence: Synthetic oligonucleotide
ccaagcugggagagugcc

SEQ ID NO: 145621 - RNA, 18 nt, Artificial Sequence
  Description of Artificial Sequence: Synthetic oligonucleotide
uacuuccaagcugggaga

SEQ ID NO: 145622 - RNA, 18 nt, Artificial Sequence
  Description of Artificial Sequence: Synthetic oligonucleotide
cugccuacuuccaagcug

SEQ ID NO: 145623 - RNA, 18 nt, Artificial Sequence
  Description of Artificial Sequence: Synthetic oligonucleotide
gaacccugccuacuucca

SEQ ID NO: 145624 - RNA, 18 nt, Artificial Sequence
  Description of Artificial Sequence: Synthetic oligonucleotide
ggagggaacccugccuac

SEQ ID NO: 145625 - RNA, 18 nt, Artificial Sequence
  Description of Artificial Sequence: Synthetic oligonucleotide
caccuggagggaacccug

SEQ ID NO: 145626 - RNA, 18 nt, Artificial Sequence
  Description of Artificial Sequence: Synthetic oligonucleotide
gggcccaccuggagggaa

SEQ ID NO: 145627 - RNA, 18 nt, Artificial Sequence
  Description of Artificial Sequence: Synthetic oligonucleotide
gcuccucuucagugaggu

SEQ ID NO: 145628 - RNA, 18 nt, Artificial Sequence
  Description of Artificial Sequence: Synthetic oligonucleotide
gacuugcuccucuucagu

SEQ ID NO: 145629 - RNA, 18 nt, Artificial Sequence
  Description of Artificial Sequence: Synthetic oligonucleotide
cuugagacuugcuccucu

SEQ ID NO: 145630 - RNA, 18 nt, Artificial Sequence
  Description of Artificial Sequence: Synthetic oligonucleotide
cuucucuugagacuugcu

SEQ ID NO: 145631 - RNA, 18 nt, Artificial Sequence
  Description of Artificial Sequence: Synthetic oligonucleotide
cccuccuucucuugagac

SEQ ID NO: 145632 - RNA, 18 nt, Artificial Sequence
  Description of Artificial Sequence: Synthetic oligonucleotide
auccccccuccuucucuu

SEQ ID NO: 145633 - RNA, 18 nt, Artificial Sequence
  Description of Artificial Sequence: Synthetic oligonucleotide
caccaauccccccuccuu

SEQ ID NO: 145634 - RNA, 18 nt, Artificial Sequence
  Description of Artificial Sequence: Synthetic oligonucleotide
ccaaccaccaaucccccc

SEQ ID NO: 145635 - RNA, 18 nt, Artificial Sequence
  Description of Artificial Sequence: Synthetic oligonucleotide
uuccuccaaccaccaauc

SEQ ID NO: 145636 - RNA, 18 nt, Artificial Sequence
  Description of Artificial Sequence: Synthetic oligonucleotide
gcugcuuccuccaaccac

SEQ ID NO: 145637 - RNA, 18 nt, Artificial Sequence
  Description of Artificial Sequence: Synthetic oligonucleotide
ggugugcugcuuccucca

SEQ ID NO: 145638 - RNA, 18 nt, Artificial Sequence
  Description of Artificial Sequence: Synthetic oligonucleotide
aauugggugugcugcuuc

SEQ ID NO: 145639 - RNA, 18 nt, Artificial Sequence
  Description of Artificial Sequence: Synthetic oligonucleotide
ggcagaauugggugugcu

SEQ ID NO: 145640 - RNA, 18 nt, Artificial Sequence
  Description of Artificial Sequence: Synthetic oligonucleotide
gggcagaauugggugugc

SEQ ID NO: 145641 - RNA, 18 nt, Artificial Sequence
  Description of Artificial Sequence: Synthetic oligonucleotide
agaccccgaguccuaggg

SEQ ID NO: 145642 - RNA, 18 nt, Artificial Sequence
  Description of Artificial Sequence: Synthetic oligonucleotide
gacucagaccccgagucc

SEQ ID NO: 145643 - RNA, 18 nt, Artificial Sequence
  Description of Artificial Sequence: Synthetic oligonucleotide
cccaggacucagaccccg

SEQ ID NO: 145644 - RNA, 18 nt, Artificial Sequence
  Description of Artificial Sequence: Synthetic oligonucleotide
cugaccccaggacucaga

SEQ ID NO: 145645 - RNA, 18 nt, Artificial Sequence
  Description of Artificial Sequence: Synthetic oligonucleotide
cuggccugaccccaggac

SEQ ID NO: 145646 - RNA, 18 nt, Artificial Sequence
  Description of Artificial Sequence: Synthetic oligonucleotide
ucucccuggccugacccc

SEQ ID NO: 145647 - RNA, 18 nt, Artificial Sequence
  Description of Artificial Sequence: Synthetic oligonucleotide
cgagcucucccuggccug

SEQ ID NO: 145648 - RNA, 18 nt, Artificial Sequence
  Description of Artificial Sequence: Synthetic oligonucleotide
ugccccgagcucucccug

SEQ ID NO: 145649 - RNA, 18 nt, Artificial Sequence
  Description of Artificial Sequence: Synthetic oligonucleotide
aggccugccccgagcucu

SEQ ID NO: 145650 - RNA, 18 nt, Artificial Sequence
  Description of Artificial Sequence: Synthetic oligonucleotide
gcggaaggccugccccga

SEQ ID NO: 145651 - RNA, 18 nt, Artificial Sequence
  Description of Artificial Sequence: Synthetic oligonucleotide
ugcuggcggaaggccugc

SEQ ID NO: 145652 - RNA, 18 nt, Artificial Sequence
  Description of Artificial Sequence: Synthetic oligonucleotide
gggagugcuggcggaagg

SEQ ID NO: 145653 - RNA, 18 nt, Artificial Sequence
  Description of Artificial Sequence: Synthetic oligonucleotide
gcagugggagugcuggcg

SEQ ID NO: 145654 - RNA, 18 nt, Artificial Sequence
  Description of Artificial Sequence: Synthetic oligonucleotide
gggcagugggagugcugg

SEQ ID NO: 145655 - RNA, 18 nt, Artificial Sequence
  Description of Artificial Sequence: Synthetic oligonucleotide
ggcugcuacugggcaggg

SEQ ID NO: 145656 - RNA, 18 nt, Artificial Sequence
  Description of Artificial Sequence: Synthetic oligonucleotide
ugggcggcugcuacuggg

SEQ ID NO: 145657 - RNA, 18 nt, Artificial Sequence
  Description of Artificial Sequence: Synthetic oligonucleotide
caaugugggcggcugcua

SEQ ID NO: 145658 - RNA, 18 nt, Artificial Sequence
  Description of Artificial Sequence: Synthetic oligonucleotide
ugacacaaugugggcggc

SEQ ID NO: 145659 - RNA, 18 nt, Artificial Sequence
  Description of Artificial Sequence: Synthetic oligonucleotide
gaugcugacacaaugugg

SEQ ID NO: 145660 - RNA, 18 nt, Artificial Sequence
  Description of Artificial Sequence: Synthetic oligonucleotide
cccuggaugcugacacaa

SEQ ID NO: 145661 - RNA, 18 nt, Artificial Sequence
  Description of Artificial Sequence: Synthetic oligonucleotide
ccuggcccuggaugcuga

SEQ ID NO: 145662 - RNA, 18 nt, Artificial Sequence
  Description of Artificial Sequence: Synthetic oligonucleotide
caggcccuggcccuggau

SEQ ID NO: 145663 - RNA, 18 nt, Artificial Sequence
  Description of Artificial Sequence: Synthetic oligonucleotide
gaggccaggcccuggccc

SEQ ID NO: 145664 - RNA, 18 nt, Artificial Sequence
  Description of Artificial Sequence: Synthetic oligonucleotide
gaugugaggccaggcccu

SEQ ID NO: 145665 - RNA, 18 nt, Artificial Sequence
  Description of Artificial Sequence: Synthetic oligonucleotide
gggaugugaggccaggcc

SEQ ID NO: 145666 - RNA, 18 nt, Artificial Sequence
  Description of Artificial Sequence: Synthetic oligonucleotide
cuagagaaaggagcaggg

SEQ ID NO: 145667 - RNA, 18 nt, Artificial Sequence
  Description of Artificial Sequence: Synthetic oligonucleotide
gccagcuagagaaaggag

SEQ ID NO: 145668 - RNA, 18 nt, Artificial Sequence
  Description of Artificial Sequence: Synthetic oligonucleotide
guggagccagcuagagaa

SEQ ID NO: 145669 - RNA, 18 nt, Artificial Sequence
  Description of Artificial Sequence: Synthetic oligonucleotide
cucccguggagccagcua

SEQ ID NO: 145670 - RNA, 18 nt, Artificial Sequence
  Description of Artificial Sequence: Synthetic oligonucleotide
cugaacucccguggagcc

SEQ ID NO: 145671 - RNA, 18 nt, Artificial Sequence
  Description of Artificial Sequence: Synthetic oligonucleotide
gggccugaacucccgugg

SEQ ID NO: 145672 - RNA, 18 nt, Artificial Sequence
  Description of Artificial Sequence: Synthetic oligonucleotide
ugugugugugcuggaggg

SEQ ID NO: 145673 - RNA, 18 nt, Artificial Sequence
  Description of Artificial Sequence: Synthetic oligonucleotide
gcuuaugugugugugcug

SEQ ID NO: 145674 - RNA, 18 nt, Artificial Sequence
  Description of Artificial Sequence: Synthetic oligonucleotide
ucagugcuuaugugugug

SEQ ID NO: 145675 - RNA, 18 nt, Artificial Sequence
  Description of Artificial Sequence: Synthetic oligonucleotide
ugauuucagugcuuaugu

SEQ ID NO: 145676 - RNA, 18 nt, Artificial Sequence
  Description of Artificial Sequence: Synthetic oligonucleotide
uaaagugauuucagugcu

SEQ ID NO: 145677 - RNA, 18 nt, Artificial Sequence
  Description of Artificial Sequence: Synthetic oligonucleotide
gcagguaaagugauuuca

SEQ ID NO: 145678 - RNA, 18 nt, Artificial Sequence
  Description of Artificial Sequence: Synthetic oligonucleotide
agccugcagguaaaguga

SEQ ID NO: 145679 - RNA, 18 nt, Artificial Sequence
  Description of Artificial Sequence: Synthetic oligonucleotide
cauggagccugcagguaa

SEQ ID NO: 145680 - RNA, 18 nt, Artificial Sequence
  Description of Artificial Sequence: Synthetic oligonucleotide
aggugcauggagccugca

SEQ ID NO: 145681 - RNA, 18 nt, Artificial Sequence
  Description of Artificial Sequence: Synthetic oligonucleotide
aagggaggugcauggagc

SEQ ID NO: 145682 - RNA, 18 nt, Artificial Sequence
  Description of Artificial Sequence: Synthetic oligonucleotide
gagggaagggaggugcau

SEQ ID NO: 145683 - RNA, 18 nt, Artificial Sequence
  Description of Artificial Sequence: Synthetic oligonucleotide
ucagggagggaagggagg

SEQ ID NO: 145684 - RNA, 18 nt, Artificial Sequence
  Description of Artificial Sequence: Synthetic oligonucleotide
cugccucagggagggaag

SEQ ID NO: 145685 - RNA, 18 nt, Artificial Sequence
  Description of Artificial Sequence: Synthetic oligonucleotide
cucaccugccucagggag

SEQ ID NO: 145686 - RNA, 18 nt, Artificial Sequence
  Description of Artificial Sequence: Synthetic oligonucleotide
ggguucucaccugccuca

SEQ ID NO: 145687 - RNA, 18 nt, Artificial Sequence
  Description of Artificial Sequence: Synthetic oligonucleotide
ucucuggguucucaccug

SEQ ID NO: 145688 - RNA, 18 nt, Artificial Sequence
  Description of Artificial Sequence: Synthetic oligonucleotide
cccucucucuggguucuc

SEQ ID NO: 145689 - RNA, 18 nt, Artificial Sequence
  Description of Artificial Sequence: Synthetic oligonucleotide
caggccccucucucuggg

SEQ ID NO: 145690 - RNA, 18 nt, Artificial Sequence
  Description of Artificial Sequence: Synthetic oligonucleotide
accugcaggccccucucu

SEQ ID NO: 145691 - RNA, 18 nt, Artificial Sequence
  Description of Artificial Sequence: Synthetic oligonucleotide
ugcucaccugcaggcccc

SEQ ID NO: 145692 - RNA, 18 nt, Artificial Sequence
  Description of Artificial Sequence: Synthetic oligonucleotide
cugccugcucaccugcag

SEQ ID NO: 145693 - RNA, 18 nt, Artificial Sequence
  Description of Artificial Sequence: Synthetic oligonucleotide
cagcccugccugcucacc

SEQ ID NO: 145694 - RNA, 18 nt, Artificial Sequence
  Description of Artificial Sequence: Synthetic oligonucleotide
uggcccagcccugccugc

SEQ ID NO: 145695 - RNA, 18 nt, Artificial Sequence
  Description of Artificial Sequence: Synthetic oligonucleotide
agaccuggcccagcccug

SEQ ID NO: 145696 - RNA, 18 nt, Artificial Sequence
  Description of Artificial Sequence: Synthetic oligonucleotide
cccggagaccuggcccag

SEQ ID NO: 145697 - RNA, 18 nt, Artificial Sequence
  Description of Artificial Sequence: Synthetic oligonucleotide
gccuccccggagaccugg

SEQ ID NO: 145698 - RNA, 18 nt, Artificial Sequence
  Description of Artificial Sequence: Synthetic oligonucleotide
ccccugccuccccggaga

SEQ ID NO: 145699 - RNA, 18 nt, Artificial Sequence
  Description of Artificial Sequence: Synthetic oligonucleotide
caggaccccugccucccc

SEQ ID NO: 145700 - RNA, 18 nt, Artificial Sequence
  Description of Artificial Sequence: Synthetic oligonucleotide
accugcaggaccccugcc

SEQ ID NO: 145701 - RNA, 18 nt, Artificial Sequence
  Description of Artificial Sequence: Synthetic oligonucleotide
ccaggaccugcaggaccc

SEQ ID NO: 145702 - RNA, 18 nt, Artificial Sequence
  Description of Artificial Sequence: Synthetic oligonucleotide
acccaccaggaccugcag

SEQ ID NO: 145703 - RNA, 18 nt, Artificial Sequence
  Description of Artificial Sequence: Synthetic oligonucleotide
ggcugacccaccaggacc

SEQ ID NO: 145704 - RNA, 18 nt, Artificial Sequence
  Description of Artificial Sequence: Synthetic oligonucleotide
ugcugggcugacccacca

SEQ ID NO: 145705 - RNA, 18 nt, Artificial Sequence
  Description of Artificial Sequence: Synthetic oligonucleotide
gcaggugcugggcugacc

SEQ ID NO: 145706 - RNA, 18 nt, Artificial Sequence
  Description of Artificial Sequence: Synthetic oligonucleotide
ugggagcaggugcugggc

SEQ ID NO: 145707 - RNA, 18 nt, Artificial Sequence
  Description of Artificial Sequence: Synthetic oligonucleotide
cccacugggagcaggugc

SEQ ID NO: 145708 - RNA, 18 nt, Artificial Sequence
  Description of Artificial Sequence: Synthetic oligonucleotide
aagcucccacugggagca

SEQ ID NO: 145709 - RNA, 18 nt, Artificial Sequence
  Description of Artificial Sequence: Synthetic oligonucleotide
ccgggaagcucccacugg

SEQ ID NO: 145710 - RNA, 18 nt, Artificial Sequence
  Description of Artificial Sequence: Synthetic oligonucleotide
uuaucccgggaagcuccc

SEQ ID NO: 145711 - RNA, 18 nt, Artificial Sequence
  Description of Artificial Sequence: Synthetic oligonucleotide
ucaguuuaucccgggaag

SEQ ID NO: 145712 - RNA, 18 nt, Artificial Sequence
  Description of Artificial Sequence: Synthetic oligonucleotide
caggcucaguuuaucccg

SEQ ID NO: 145713 - RNA, 18 nt, Artificial Sequence
  Description of Artificial Sequence: Synthetic oligonucleotide
augaacaggcucaguuua

SEQ ID NO: 145714 - RNA, 18 nt, Artificial Sequence
  Description of Artificial Sequence: Synthetic oligonucleotide
ucagaaugaacaggcuca

SEQ ID NO: 145715 - RNA, 18 nt, Artificial Sequence
  Description of Artificial Sequence: Synthetic oligonucleotide
ggacaucagaaugaacag

SEQ ID NO: 145716 - RNA, 18 nt, Artificial Sequence
  Description of Artificial Sequence: Synthetic oligonucleotide
caaauggacaucagaaug

SEQ ID NO: 145717 - RNA, 18 nt, Artificial Sequence
  Description of Artificial Sequence: Synthetic oligonucleotide
ugggacaaauggacauca

SEQ ID NO: 145718 - RNA, 18 nt, Artificial Sequence
  Description of Artificial Sequence: Synthetic oligonucleotide
gcuauugggacaaaugga

SEQ ID NO: 145719 - RNA, 18 nt, Artificial Sequence
  Description of Artificial Sequence: Synthetic oligonucleotide
guagagcuauugggacaa

SEQ ID NO: 145720 - RNA, 18 nt, Artificial Sequence
  Description of Artificial Sequence: Synthetic oligonucleotide
gggcaguagagcuauugg

SEQ ID NO: 145721 - RNA, 18 nt, Artificial Sequence
  Description of Artificial Sequence: Synthetic oligonucleotide
gggagggcaguagagcua

SEQ ID NO: 145722 - RNA, 18 nt, Artificial Sequence
  Description of Artificial Sequence: Synthetic oligonucleotide
gcugggcugaguaaaggg

SEQ ID NO: 145723 - RNA, 18 nt, Artificial Sequence
  Description of Artificial Sequence: Synthetic oligonucleotide
ggccagcugggcugagua

SEQ ID NO: 145724 - RNA, 18 nt, Artificial Sequence
  Description of Artificial Sequence: Synthetic oligonucleotide
uagguggccagcugggcu

SEQ ID NO: 145725 - RNA, 18 nt, Artificial Sequence
  Description of Artificial Sequence: Synthetic oligonucleotide
acuucuagguggccagcu

SEQ ID NO: 145726 - RNA, 18 nt, Artificial Sequence
  Description of Artificial Sequence: Synthetic oligonucleotide
gggagacuucuagguggc

SEQ ID NO: 145727 - RNA, 18 nt, Artificial Sequence
  Description of Artificial Sequence: Synthetic oligonucleotide
gugcagggagacuucuag

SEQ ID NO: 145728 - RNA, 18 nt, Artificial Sequence
  Description of Artificial Sequence: Synthetic oligonucleotide
aggcugugcagggagacu

SEQ ID NO: 145729 - RNA, 18 nt, Artificial Sequence
  Description of Artificial Sequence: Synthetic oligonucleotide
acuagaggcugugcaggg

SEQ ID NO: 145730 - RNA, 18 nt, Artificial Sequence
  Description of Artificial Sequence: Synthetic oligonucleotide
cggacacuagaggcugug

SEQ ID NO: 145731 - RNA, 18 nt, Artificial Sequence
  Description of Artificial Sequence: Synthetic oligonucleotide
guccccggacacuagagg

SEQ ID NO: 145732 - RNA, 18 nt, Artificial Sequence
  Description of Artificial Sequence: Synthetic oligonucleotide
acaagguccccggacacu

SEQ ID NO: 145733 - RNA, 18 nt, Artificial Sequence
  Description of Artificial Sequence: Synthetic oligonucleotide
gucccacaagguccccgg

SEQ ID NO: 145734 - RNA, 18 nt, Artificial Sequence
  Description of Artificial Sequence: Synthetic oligonucleotide
gacuggucccacaagguc

SEQ ID NO: 145735 - RNA, 18 nt, Artificial Sequence
  Description of Artificial Sequence: Synthetic oligonucleotide
ugugggacuggucccaca

SEQ ID NO: 145736 - RNA, 18 nt, Artificial Sequence
  Description of Artificial Sequence: Synthetic oligonucleotide
agcggugugggacugguc

SEQ ID NO: 145737 - RNA, 18 nt, Artificial Sequence
  Description of Artificial Sequence: Synthetic oligonucleotide
ggaccagcggugugggac

SEQ ID NO: 145738 - RNA, 18 nt, Artificial Sequence
  Description of Artificial Sequence: Synthetic oligonucleotide
ggcagggaccagcggugu

SEQ ID NO: 145739 - RNA, 18 nt, Artificial Sequence
  Description of Artificial Sequence: Synthetic oligonucleotide
gggagggcagggaccagc

SEQ ID NO: 145740 - RNA, 18 nt, Artificial Sequence
  Description of Artificial Sequence: Synthetic oligonucleotide
gcaccucaaccugggagc

SEQ ID NO: 145741 - RNA, 18 nt, Artificial Sequence
  Description of Artificial Sequence: Synthetic oligonucleotide
ugagcgcaccucaaccug

SEQ ID NO: 145742 - RNA, 18 nt, Artificial Sequence
  Description of Artificial Sequence: Synthetic oligonucleotide
ugaggugagcgcaccuca

SEQ ID NO: 145743 - RNA, 18 nt, Artificial Sequence
  Description of Artificial Sequence: Synthetic oligonucleotide
ugcucugaggugagcgca

SEQ ID NO: 145744 - RNA, 18 nt, Artificial Sequence
  Description of Artificial Sequence: Synthetic oligonucleotide
ggcccugcucugagguga

SEQ ID NO: 145745 - RNA, 18 nt, Artificial Sequence
  Description of Artificial Sequence: Synthetic oligonucleotide
gcuuuggcccugcucuga

SEQ ID NO: 145746 - RNA, 18 nt, Artificial Sequence
  Description of Artificial Sequence: Synthetic oligonucleotide
gcugugcuuuggcccugc

SEQ ID NO: 145747 - RNA, 18 nt, Artificial Sequence
  Description of Artificial Sequence: Synthetic oligonucleotide
gcccagcugugcuuuggc

SEQ ID NO: 145748 - RNA, 18 nt, Artificial Sequence
  Description of Artificial Sequence: Synthetic oligonucleotide
ggcaugcccagcugugcu

SEQ ID NO: 145749 - RNA, 18 nt, Artificial Sequence
  Description of Artificial Sequence: Synthetic oligonucleotide
gacauggcaugcccagcu

SEQ ID NO: 145750 - RNA, 18 nt, Artificial Sequence
  Description of Artificial Sequence: Synthetic oligonucleotide
gcucagacauggcaugcc

SEQ ID NO: 145751 - RNA, 18 nt, Artificial Sequence
  Description of Artificial Sequence: Synthetic oligonucleotide
gcgccgcucagacauggc

SEQ ID NO: 145752 - RNA, 18 nt, Artificial Sequence
  Description of Artificial Sequence: Synthetic oligonucleotide
gcucugcgccgcucagac

SEQ ID NO: 145753 - RNA, 18 nt, Artificial Sequence
  Description of Artificial Sequence: Synthetic oligonucleotide
ggagggcucugcgccgcu

SEQ ID NO: 145754 - RNA, 18 nt, Artificial Sequence
  Description of Artificial Sequence: Synthetic oligonucleotide
ggccuggagggcucugcg

SEQ ID NO: 145755 - RNA, 18 nt, Artificial Sequence
  Description of Artificial Sequence: Synthetic oligonucleotide
cugcaggccuggagggcu

SEQ ID NO: 145756 - RNA, 18 nt, Artificial Sequence
  Description of Artificial Sequence: Synthetic oligonucleotide
ugccccugcaggccugga

SEQ ID NO: 145757 - RNA, 18 nt, Artificial Sequence
  Description of Artificial Sequence: Synthetic oligonucleotide
ccccuugccccugcaggc

SEQ ID NO: 145758 - RNA, 18 nt, Artificial Sequence
  Description of Artificial Sequence: Synthetic oligonucleotide
gccagccccuugccccug

SEQ ID NO: 145759 - RNA, 18 nt, Artificial Sequence
  Description of Artificial Sequence: Synthetic oligonucleotide
cuccagccagccccuugc

SEQ ID NO: 145760 - RNA, 18 nt, Artificial Sequence
  Description of Artificial Sequence: Synthetic oligonucleotide
ugagacuccagccagccc

SEQ ID NO: 145761 - RNA, 18 nt, Artificial Sequence
  Description of Artificial Sequence: Synthetic oligonucleotide
ugcucugagacuccagcc

SEQ ID NO: 145762 - RNA, 18 nt, Artificial Sequence
  Description of Artificial Sequence: Synthetic oligonucleotide
cucugugcucugagacuc

SEQ ID NO: 145763 - RNA, 18 nt, Artificial Sequence
  Description of Artificial Sequence: Synthetic oligonucleotide
ccuaccucugugcucuga

SEQ ID NO: 145764 - RNA, 18 nt, Artificial Sequence
  Description of Artificial Sequence: Synthetic oligonucleotide
guucuccuaccucugugc

SEQ ID NO: 145765 - RNA, 18 nt, Artificial Sequence
  Description of Artificial Sequence: Synthetic oligonucleotide
ccccaguucuccuaccuc

SEQ ID NO: 145766 - RNA, 18 nt, Artificial Sequence
  Description of Artificial Sequence: Synthetic oligonucleotide
uugaaccccaguucuccu

SEQ ID NO: 145767 - RNA, 18 nt, Artificial Sequence
  Description of Artificial Sequence: Synthetic oligonucleotide
ugggcuugaaccccaguu

SEQ ID NO: 145768 - RNA, 18 nt, Artificial Sequence
  Description of Artificial Sequence: Synthetic oligonucleotide
aagccugggcuugaaccc

SEQ ID NO: 145769 - RNA, 18 nt, Artificial Sequence
  Description of Artificial Sequence: Synthetic oligonucleotide
ccaggaagccugggcuug

SEQ ID NO: 145770 - RNA, 18 nt, Artificial Sequence
  Description of Artificial Sequence: Synthetic oligonucleotide
aggacccaggaagccugg

SEQ ID NO: 145771 - RNA, 18 nt, Artificial Sequence
  Description of Artificial Sequence: Synthetic oligonucleotide
caggcaggacccaggaag

SEQ ID NO: 145772 - RNA, 18 nt, Artificial Sequence
  Description of Artificial Sequence: Synthetic oligonucleotide
aggaccaggcaggaccca

SEQ ID NO: 145773 - RNA, 18 nt, Artificial Sequence
  Description of Artificial Sequence: Synthetic oligonucleotide
gagggaggaccaggcagg

SEQ ID NO: 145774 - RNA, 18 nt, Artificial Sequence
  Description of Artificial Sequence: Synthetic oligonucleotide
cuugggagggaggaccag

SEQ ID NO: 145775 - RNA, 18 nt, Artificial Sequence
  Description of Artificial Sequence: Synthetic oligonucleotide
ggcuccuugggagggagg

SEQ ID NO: 145776 - RNA, 18 nt, Artificial Sequence
  Description of Artificial Sequence: Synthetic oligonucleotide
agaauggcuccuugggag

SEQ ID NO: 145777 - RNA, 18 nt, Artificial Sequence
  Description of Artificial Sequence: Synthetic oligonucleotide
cacacagaauggcuccuu

SEQ ID NO: 145778 - RNA, 18 nt, Artificial Sequence
  Description of Artificial Sequence: Synthetic oligonucleotide
agucacacacagaauggc

SEQ ID NO: 145779 - RNA, 18 nt, Artificial Sequence
  Description of Artificial Sequence: Synthetic oligonucleotide
cccagagucacacacaga

SEQ ID NO: 145780 - RNA, 18 nt, Artificial Sequence
  Description of Artificial Sequence: Synthetic oligonucleotide
uuccacccagagucacac

SEQ ID NO: 145781 - RNA, 18 nt, Artificial Sequence
  Description of Artificial Sequence: Synthetic oligonucleotide
ggcacuuccacccagagu

SEQ ID NO: 145782 - RNA, 18 nt, Artificial Sequence
  Description of Artificial Sequence: Synthetic oligonucleotide
ggcugggcacuuccaccc

SEQ ID NO: 145783 - RNA, 18 nt, Artificial Sequence
  Description of Artificial Sequence: Synthetic oligonucleotide
gggcugggcacuuccacc

SEQ ID NO: 145784 - RNA, 18 nt, Artificial Sequence
  Description of Artificial Sequence: Synthetic oligonucleotide
gcugcagcgcccguaggg

SEQ ID NO: 145785 - RNA, 18 nt, Artificial Sequence
  Description of Artificial Sequence: Synthetic oligonucleotide
gggaggcugcagcgcccg

SEQ ID NO: 145786 - RNA, 18 nt, Artificial Sequence
  Description of Artificial Sequence: Synthetic oligonucleotide
uggaagggaggcugcagc

SEQ ID NO: 145787 - RNA, 18 nt, Artificial Sequence
  Description of Artificial Sequence: Synthetic oligonucleotide
gggcauggaagggaggcu

SEQ ID NO: 145788 - RNA, 18 nt, Artificial Sequence
  Description of Artificial Sequence: Synthetic oligonucleotide
gccagcagagagugaucc

SEQ ID NO: 145789 - RNA, 18 nt, Artificial Sequence
  Description of Artificial Sequence: Synthetic oligonucleotide
auccugccagcagagagu

SEQ ID NO: 145790 - RNA, 18 nt, Artificial Sequence
  Description of Artificial Sequence: Synthetic oligonucleotide
gaagaauccugccagcag

SEQ ID NO: 145791 - RNA, 18 nt, Artificial Sequence
  Description of Artificial Sequence: Synthetic oligonucleotide
agcgggaagaauccugcc

SEQ ID NO: 145792 - RNA, 18 nt, Artificial Sequence
  Description of Artificial Sequence: Synthetic oligonucleotide
gggagcgggaagaauccu

SEQ ID NO: 145793 - RNA, 18 nt, Artificial Sequence
  Description of Artificial Sequence: Synthetic oligonucleotide
aucagcuggguagguggg

SEQ ID NO: 145794 - RNA, 18 nt, Artificial Sequence
  Description of Artificial Sequence: Synthetic oligonucleotide
cccccaucagcuggguag

SEQ ID NO: 145795 - RNA, 18 nt, Artificial Sequence
  Description of Artificial Sequence: Synthetic oligonucleotide
cccaacccccaucagcug

SEQ ID NO: 145796 - RNA, 18 nt, Artificial Sequence
  Description of Artificial Sequence: Synthetic oligonucleotide
agcaccccaacccccauc

SEQ ID NO: 145797 - RNA, 18 nt, Artificial Sequence
  Description of Artificial Sequence: Synthetic oligonucleotide
aaggaagcaccccaaccc

SEQ ID NO: 145798 - RNA, 18 nt, Artificial Sequence
  Description of Artificial Sequence: Synthetic oligonucleotide
ccugaaaggaagcacccc

SEQ ID NO: 145799 - RNA, 18 nt, Artificial Sequence
  Description of Artificial Sequence: Synthetic oligonucleotide
cuuggccugaaaggaagc

SEQ ID NO: 145800 - RNA, 18 nt, Artificial Sequence
  Description of Artificial Sequence: Synthetic oligonucleotide
auagccuuggccugaaag

SEQ ID NO: 145801 - RNA, 18 nt, Artificial Sequence
  Description of Artificial Sequence: Synthetic oligonucleotide
ccuucauagccuuggccu

SEQ ID NO: 145802 - RNA, 18 nt, Artificial Sequence
  Description of Artificial Sequence: Synthetic oligonucleotide
cugucccuucauagccuu

SEQ ID NO: 145803 - RNA, 18 nt, Artificial Sequence
  Description of Artificial Sequence: Synthetic oligonucleotide
agcagcugucccuucaua

SEQ ID NO: 145804 - RNA, 18 nt, Artificial Sequence
  Description of Artificial Sequence: Synthetic oligonucleotide
gucccagcagcugucccu

SEQ ID NO: 145805 - RNA, 18 nt, Artificial Sequence
  Description of Artificial Sequence: Synthetic oligonucleotide
ggugggucccagcagcug

SEQ ID NO: 145806 - RNA, 18 nt, Artificial Sequence
  Description of Artificial Sequence: Synthetic oligonucleotide
gggaggugggucccagca

SEQ ID NO: 145807 - RNA, 18 nt, Artificial Sequence
  Description of Artificial Sequence: Synthetic oligonucleotide
acgcggcauguggccggg

SEQ ID NO: 145808 - RNA, 18 nt, Artificial Sequence
  Description of Artificial Sequence: Synthetic oligonucleotide
cagggacgcggcaugugg

SEQ ID NO: 145809 - RNA, 18 nt, Artificial Sequence
  Description of Artificial Sequence: Synthetic oligonucleotide
gggcagggacgcggcaug

SEQ ID NO: 145810 - RNA, 18 nt, Artificial Sequence
  Description of Artificial Sequence: Synthetic oligonucleotide
caccagacccgggucggg

SEQ ID NO: 145811 - RNA, 18 nt, Artificial Sequence
  Description of Artificial Sequence: Synthetic oligonucleotide
cucagcaccagacccggg

SEQ ID NO: 145812 - RNA, 18 nt, Artificial Sequence
  Description of Artificial Sequence: Synthetic oligonucleotide
guauccucagcaccagac

SEQ ID NO: 145813 - RNA, 18 nt, Artificial Sequence
  Description of Artificial Sequence: Synthetic oligonucleotide
gagcuguauccucagcac

SEQ ID NO: 145814 - RNA, 18 nt, Artificial Sequence
  Description of Artificial Sequence: Synthetic oligonucleotide
gagaagagcuguauccuc

SEQ ID NO: 145815 - RNA, 18 nt, Artificial Sequence
  Description of Artificial Sequence: Synthetic oligonucleotide
acacugagaagagcugua

SEQ ID NO: 145816 - RNA, 18 nt, Artificial Sequence
  Description of Artificial Sequence: Synthetic oligonucleotide
uucagacacugagaagag

SEQ ID NO: 145817 - RNA, 18 nt, Artificial Sequence
  Description of Artificial Sequence: Synthetic oligonucleotide
gauuguucagacacugag

SEQ ID NO: 145818 - RNA, 18 nt, Artificial Sequence
  Description of Artificial Sequence: Synthetic oligonucleotide
uuggagauuguucagaca

SEQ ID NO: 145819 - RNA, 18 nt, Artificial Sequence
  Description of Artificial Sequence: Synthetic oligonucleotide
caauuuuggagauuguuc

SEQ ID NO: 145820 - RNA, 18 nt, Artificial Sequence
  Description of Artificial Sequence: Synthetic oligonucleotide
cauuucaauuuuggagau

SEQ ID NO: 145821 - RNA, 18 nt, Artificial Sequence
  Description of Artificial Sequence: Synthetic oligonucleotide
auauacauuucaauuuug

SEQ ID NO: 145822 - RNA, 18 nt, Artificial Sequence
  Description of Artificial Sequence: Synthetic oligonucleotide
caaaaauauacauuucaa

SEQ ID NO: 145823 - RNA, 18 nt, Artificial Sequence
  Description of Artificial Sequence: Synthetic oligonucleotide
ccuagcaaaaauauacau

SEQ ID NO: 145824 - RNA, 18 nt, Artificial Sequence
  Description of Artificial Sequence: Synthetic oligonucleotide
gggcuccuagcaaaaaua

SEQ ID NO: 145825 - RNA, 18 nt, Artificial Sequence
  Description of Artificial Sequence: Synthetic oligonucleotide
auuaaaaacacaggaagc

SEQ ID NO: 145826 - RNA, 18 nt, Artificial Sequence
  Description of Artificial Sequence: Synthetic oligonucleotide
uuuauauuaaaaacacag

SEQ ID NO: 145827 - RNA, 18 nt, Artificial Sequence
  Description of Artificial Sequence: Synthetic oligonucleotide
cacuauuuauauuaaaaa

SEQ ID NO: 145828 - RNA, 18 nt, Artificial Sequence
  Description of Artificial Sequence: Synthetic oligonucleotide
guguacacuauuuauauu

SEQ ID NO: 145829 - RNA, 18 nt, Artificial Sequence
  Description of Artificial Sequence: Synthetic oligonucleotide
agucuguguacacuauuu

SEQ ID NO: 145830 - RNA, 18 nt, Artificial Sequence
  Description of Artificial Sequence: Synthetic oligonucleotide
ucgucagucuguguacac

SEQ ID NO: 145831 - RNA, 18 nt, Artificial Sequence
  Description of Artificial Sequence: Synthetic oligonucleotide
aaguuucgucagucugug

SEQ ID NO: 145832 - RNA, 18 nt, Artificial Sequence
  Description of Artificial Sequence: Synthetic oligonucleotide
auuuaaaguuucgucagu

SEQ ID NO: 145833 - RNA, 18 nt, Artificial Sequence
  Description of Artificial Sequence: Synthetic oligonucleotide
cauuuauuuaaaguuucg

SEQ ID NO: 145834 - RNA, 18 nt, Artificial Sequence
  Description of Artificial Sequence: Synthetic oligonucleotide
auucccauuuauuuaaag

SEQ ID NO: 145835 - RNA, 18 nt, Artificial Sequence
  Description of Artificial Sequence: Synthetic oligonucleotide
auuuaauucccauuuauu

SEQ ID NO: 145836 - RNA, 18 nt, Artificial Sequence
  Description of Artificial Sequence: Synthetic oligonucleotide
uaaauauuuaauucccau

SEQ ID NO: 145837 - RNA, 18 nt, Artificial Sequence
  Description of Artificial Sequence: Synthetic oligonucleotide
gcucuuaaauauuuaauu

SEQ ID NO: 145838 - RNA, 18 nt, Artificial Sequence
  Description of Artificial Sequence: Synthetic oligonucleotide
agucagcucuuaaauauu

SEQ ID NO: 145839 - RNA, 18 nt, Artificial Sequence
  Description of Artificial Sequence: Synthetic oligonucleotide
uacagggugguucccauc

SEQ ID NO: 145840 - RNA, 18 nt, Artificial Sequence
  Description of Artificial Sequence: Synthetic oligonucleotide
accucuacagggugguuc

SEQ ID NO: 145841 - RNA, 18 nt, Artificial Sequence
  Description of Artificial Sequence: Synthetic oligonucleotide
gauggaccucuacagggu

SEQ ID NO: 145842 - RNA, 18 nt, Artificial Sequence
  Description of Artificial Sequence: Synthetic oligonucleotide
acgcagauggaccucuac

SEQ ID NO: 145843 - RNA, 18 nt, Artificial Sequence
  Description of Artificial Sequence: Synthetic oligonucleotide
ucugaacgcagauggacc

SEQ ID NO: 145844 - RNA, 18 nt, Artificial Sequence
  Description of Artificial Sequence: Synthetic oligonucleotide
cugggucugaacgcagau

SEQ ID NO: 145845 - RNA, 18 nt, Artificial Sequence
  Description of Artificial Sequence: Synthetic oligonucleotide
aucgucugggucugaacg

SEQ ID NO: 145846 - RNA, 18 nt, Artificial Sequence
  Description of Artificial Sequence: Synthetic oligonucleotide
cuggcaucgucugggucu

SEQ ID NO: 145847 - RNA, 18 nt, Artificial Sequence
  Description of Artificial Sequence: Synthetic oligonucleotide
uagcucuggcaucgucug

SEQ ID NO: 145848 - RNA, 18 nt, Artificial Sequence
  Description of Artificial Sequence: Synthetic oligonucleotide
agucauagcucuggcauc

SEQ ID NO: 145849 - RNA, 18 nt, Artificial Sequence
  Description of Artificial Sequence: Synthetic oligonucleotide
ggcccagucauagcucug

SEQ ID NO: 145850 - RNA, 18 nt, Artificial Sequence
  Description of Artificial Sequence: Synthetic oligonucleotide
cugcaggcccagucauag

SEQ ID NO: 145851 - RNA, 18 nt, Artificial Sequence
  Description of Artificial Sequence: Synthetic oligonucleotide
cacaccugcaggcccagu

SEQ ID NO: 145852 - RNA, 18 nt, Artificial Sequence
  Description of Artificial Sequence: Synthetic oligonucleotide
ggcgccacaccugcaggc

SEQ ID NO: 145853 - RNA, 18 nt, Artificial Sequence
  Description of Artificial Sequence: Synthetic oligonucleotide
cccucggcgccacaccug

SEQ ID NO: 145854 - RNA, 18 nt, Artificial Sequence
  Description of Artificial Sequence: Synthetic oligonucleotide
aucuccccucggcgccac

SEQ ID NO: 145855 - RNA, 18 nt, Artificial Sequence
  Description of Artificial Sequence: Synthetic oligonucleotide
ggcugaucuccccucggc

SEQ ID NO: 145856 - RNA, 18 nt, Artificial Sequence
  Description of Artificial Sequence: Synthetic oligonucleotide
uccauggcugaucucccc

SEQ ID NO: 145857 - RNA, 18 nt, Artificial Sequence
  Description of Artificial Sequence: Synthetic oligonucleotide
gcugcuccauggcugauc

SEQ ID NO: 145858 - RNA, 18 nt, Artificial Sequence
  Description of Artificial Sequence: Synthetic oligonucleotide
cuguggcugcuccauggc

SEQ ID NO: 145859 - RNA, 18 nt, Artificial Sequence
  Description of Artificial Sequence: Synthetic oligonucleotide
uccuccuguggcugcucc

SEQ ID NO: 145860 - RNA, 18 nt, Artificial Sequence
  Description of Artificial Sequence: Synthetic oligonucleotide
gggcuuccuccuguggcu

SEQ ID NO: 145861 - RNA, 18 nt, Artificial Sequence
  Description of Artificial Sequence: Synthetic oligonucleotide
ucuucccggaccucaggg

SEQ ID NO: 145862 - RNA, 18 nt, Artificial Sequence
  Description of Artificial Sequence: Synthetic oligonucleotide
uccucuucccggaccuca

SEQ ID NO: 145863 - RNA, 18 nt, Artificial Sequence
  Description of Artificial Sequence: Synthetic oligonucleotide
ucuccuccucuucccgga

SEQ ID NO: 145864 - RNA, 18 nt, Artificial Sequence
  Description of Artificial Sequence: Synthetic oligonucleotide
cucuuucuccuccucuuc

SEQ ID NO: 145865 - RNA, 18 nt, Artificial Sequence
  Description of Artificial Sequence: Synthetic oligonucleotide
acuuccucuuucuccucc

SEQ ID NO: 145866 - RNA, 18 nt, Artificial Sequence
  Description of Artificial Sequence: Synthetic oligonucleotide
cugccacuuccucuuucu

SEQ ID NO: 145867 - RNA, 18 nt, Artificial Sequence
  Description of Artificial Sequence: Synthetic oligonucleotide
ugccucugccacuuccuc

SEQ ID NO: 145868 - RNA, 18 nt, Artificial Sequence
  Description of Artificial Sequence: Synthetic oligonucleotide
ccuucugccucugccacu

SEQ ID NO: 145869 - RNA, 18 nt, Artificial Sequence
  Description of Artificial Sequence: Synthetic oligonucleotide
gggcuccuucugccucug

SEQ ID NO: 145870 - RNA, 18 nt, Artificial Sequence
  Description of Artificial Sequence: Synthetic oligonucleotide
cccccauugagcucuggg

SEQ ID NO: 145871 - RNA, 18 nt, Artificial Sequence
  Description of Artificial Sequence: Synthetic oligonucleotide
gucccccauugagcucug

SEQ ID NO: 145872 - RNA, 18 nt, Artificial Sequence
  Description of Artificial Sequence: Synthetic oligonucleotide
cuguggucccccauugag

SEQ ID NO: 145873 - RNA, 18 nt, Artificial Sequence
  Description of Artificial Sequence: Synthetic oligonucleotide
gcaugcugugguccccca

SEQ ID NO: 145874 - RNA, 18 nt, Artificial Sequence
  Description of Artificial Sequence: Synthetic oligonucleotide
gaagugcaugcugugguc

SEQ ID NO: 145875 - RNA, 18 nt, Artificial Sequence
  Description of Artificial Sequence: Synthetic oligonucleotide
ggaaggaagugcaugcug

SEQ ID NO: 145876 - RNA, 18 nt, Artificial Sequence
  Description of Artificial Sequence: Synthetic oligonucleotide
cugcuggaaggaagugca

SEQ ID NO: 145877 - RNA, 18 nt, Artificial Sequence
  Description of Artificial Sequence: Synthetic oligonucleotide
uguagcugcuggaaggaa

SEQ ID NO: 145878 - RNA, 18 nt, Artificial Sequence
  Description of Artificial Sequence: Synthetic oligonucleotide
uccccugccaguccucuc

SEQ ID NO: 145879 - RNA, 18 nt, Artificial Sequence
  Description of Artificial Sequence: Synthetic oligonucleotide
ccguguccccugccaguc

SEQ ID NO: 145880 - RNA, 18 nt, Artificial Sequence
  Description of Artificial Sequence: Synthetic oligonucleotide
cugccccguguccccugc

SEQ ID NO: 145881 - RNA, 18 nt, Artificial Sequence
  Description of Artificial Sequence: Synthetic oligonucleotide
cuccucugccccgugucc

SEQ ID NO: 145882 - RNA, 18 nt, Artificial Sequence
  Description of Artificial Sequence: Synthetic oligonucleotide
ugugccuccucugccccg

SEQ ID NO: 145883 - RNA, 18 nt, Artificial Sequence
  Description of Artificial Sequence: Synthetic oligonucleotide
ugggcugugccuccucug

SEQ ID NO: 145884 - RNA, 18 nt, Artificial Sequence
  Description of Artificial Sequence: Synthetic oligonucleotide
ugcacugggcugugccuc

SEQ ID NO: 145885 - RNA, 18 nt, Artificial Sequence
  Description of Artificial Sequence: Synthetic oligonucleotide
cccacugcacugggcugu

SEQ ID NO: 145886 - RNA, 18 nt, Artificial Sequence
  Description of Artificial Sequence: Synthetic oligonucleotide
ggauccccacugcacugg

SEQ ID NO: 145887 - RNA, 18 nt, Artificial Sequence
  Description of Artificial Sequence: Synthetic oligonucleotide
ggccaggauccccacugc

SEQ ID NO: 145888 - RNA, 18 nt, Artificial Sequence
  Description of Artificial Sequence: Synthetic oligonucleotide
cagagggccaggaucccc

SEQ ID NO: 145889 - RNA, 18 nt, Artificial Sequence
  Description of Artificial Sequence: Synthetic oligonucleotide
guuugcagagggccagga

SEQ ID NO: 145890 - RNA, 18 nt, Artificial Sequence
  Description of Artificial Sequence: Synthetic oligonucleotide
auggcguuugcagagggc

SEQ ID NO: 145891 - RNA, 18 nt, Artificial Sequence
  Description of Artificial Sequence: Synthetic oligonucleotide
acaugauggcguuugcag

SEQ ID NO: 145892 - RNA, 18 nt, Artificial Sequence
  Description of Artificial Sequence: Synthetic oligonucleotide
gccccacaugauggcguu

SEQ ID NO: 145893 - RNA, 18 nt, Artificial Sequence
  Description of Artificial Sequence: Synthetic oligonucleotide
ucugcgccccacaugaug

SEQ ID NO: 145894 - RNA, 18 nt, Artificial Sequence
  Description of Artificial Sequence: Synthetic oligonucleotide
gcuacucugcgccccaca

SEQ ID NO: 145895 - RNA, 18 nt, Artificial Sequence
  Description of Artificial Sequence: Synthetic oligonucleotide
acucugcuacucugcgcc

SEQ ID NO: 145896 - RNA, 18 nt, Artificial Sequence
  Description of Artificial Sequence: Synthetic oligonucleotide
ucagcacucugcuacucu

SEQ ID NO: 145897 - RNA, 18 nt, Artificial Sequence
  Description of Artificial Sequence: Synthetic oligonucleotide
guccuucagcacucugcu

SEQ ID NO: 145898 - RNA, 18 nt, Artificial Sequence
  Description of Artificial Sequence: Synthetic oligonucleotide
cuccaguccuucagcacu

SEQ ID NO: 145899 - RNA, 18 nt, Artificial Sequence
  Description of Artificial Sequence: Synthetic oligonucleotide
uccggcuccaguccuuca

SEQ ID NO: 145900 - RNA, 18 nt, Artificial Sequence
  Description of Artificial Sequence: Synthetic oligonucleotide
aggcuuccggcuccaguc

SEQ ID NO: 145901 - RNA, 18 nt, Artificial Sequence
  Description of Artificial Sequence: Synthetic oligonucleotide
aacccaggcuuccggcuc

SEQ ID NO: 145902 - RNA, 18 nt, Artificial Sequence
  Description of Artificial Sequence: Synthetic oligonucleotide
gcgugaacccaggcuucc

SEQ ID NO: 145903 - RNA, 18 nt, Artificial Sequence
  Description of Artificial Sequence: Synthetic oligonucleotide
acugggcgugaacccagg

SEQ ID NO: 145904 - RNA, 18 nt, Artificial Sequence
  Description of Artificial Sequence: Synthetic oligonucleotide
accgcacugggcgugaac

SEQ ID NO: 145905 - RNA, 18 nt, Artificial Sequence
  Description of Artificial Sequence: Synthetic oligonucleotide
uccccaccgcacugggcg

SEQ ID NO: 145906 - RNA, 18 nt, Artificial Sequence
  Description of Artificial Sequence: Synthetic oligonucleotide
gcagauccccaccgcacu

SEQ ID NO: 145907 - RNA, 18 nt, Artificial Sequence
  Description of Artificial Sequence: Synthetic oligonucleotide
gcagagcagauccccacc

SEQ ID NO: 145908 - RNA, 18 nt, Artificial Sequence
  Description of Artificial Sequence: Synthetic oligonucleotide
gaguggcagagcagaucc

SEQ ID NO: 145909 - RNA, 18 nt, Artificial Sequence
  Description of Artificial Sequence: Synthetic oligonucleotide
cuggugaguggcagagca

SEQ ID NO: 145910 - RNA, 18 nt, Artificial Sequence
  Description of Artificial Sequence: Synthetic oligonucleotide
cacugcuggugaguggca

SEQ ID NO: 145911 - RNA, 18 nt, Artificial Sequence
  Description of Artificial Sequence: Synthetic oligonucleotide
ggccccacugcuggugag

SEQ ID NO: 145912 - RNA, 18 nt, Artificial Sequence
  Description of Artificial Sequence: Synthetic oligonucleotide
cuccaggccccacugcug

SEQ ID NO: 145913 - RNA, 18 nt, Artificial Sequence
  Description of Artificial Sequence: Synthetic oligonucleotide
gcuugcuccaggccccac

SEQ ID NO: 145914 - RNA, 18 nt, Artificial Sequence
  Description of Artificial Sequence: Synthetic oligonucleotide
gugcagcuugcuccaggc

SEQ ID NO: 145915 - RNA, 18 nt, Artificial Sequence
  Description of Artificial Sequence: Synthetic oligonucleotide
aaguggugcagcuugcuc

SEQ ID NO: 145916 - RNA, 18 nt, Artificial Sequence
  Description of Artificial Sequence: Synthetic oligonucleotide
gaaggaaguggugcagcu

SEQ ID NO: 145917 - RNA, 18 nt, Artificial Sequence
  Description of Artificial Sequence: Synthetic oligonucleotide
uuacagaaggaaguggug

SEQ ID NO: 145918 - RNA, 18 nt, Artificial Sequence
  Description of Artificial Sequence: Synthetic oligonucleotide
cuguuuuacagaaggaag

SEQ ID NO: 145919 - RNA, 18 nt, Artificial Sequence
  Description of Artificial Sequence: Synthetic oligonucleotide
uuggccuguuuuacagaa

SEQ ID NO: 145920 - RNA, 18 nt, Artificial Sequence
  Description of Artificial Sequence: Synthetic oligonucleotide
auccuuuggccuguuuua

SEQ ID NO: 145921 - RNA, 18 nt, Artificial Sequence
  Description of Artificial Sequence: Synthetic oligonucleotide
cuaccauccuuuggccug

SEQ ID NO: 145922 - RNA, 18 nt, Artificial Sequence
  Description of Artificial Sequence: Synthetic oligonucleotide
aucaccuaccauccuuug

SEQ ID NO: 145923 - RNA, 18 nt, Artificial Sequence
  Description of Artificial Sequence: Synthetic oligonucleotide
uccacaucaccuaccauc

SEQ ID NO: 145924 - RNA, 18 nt, Artificial Sequence
  Description of Artificial Sequence: Synthetic oligonucleotide
ccauauccacaucaccua

SEQ ID NO: 145925 - RNA, 18 nt, Artificial Sequence
  Description of Artificial Sequence: Synthetic oligonucleotide
aaagcccauauccacauc

SEQ ID NO: 145926 - RNA, 18 nt, Artificial Sequence
  Description of Artificial Sequence: Synthetic oligonucleotide
ucacgaaagcccauaucc

SEQ ID NO: 145927 - RNA, 18 nt, Artificial Sequence
  Description of Artificial Sequence: Synthetic oligonucleotide
aauucucacgaaagccca

SEQ ID NO: 145928 - RNA, 18 nt, Artificial Sequence
  Description of Artificial Sequence: Synthetic oligonucleotide
cauuuaauucucacgaaa

SEQ ID NO: 145929 - RNA, 18 nt, Artificial Sequence
  Description of Artificial Sequence: Synthetic oligonucleotide
ccacucauuuaauucuca

SEQ ID NO: 145930 - RNA, 18 nt, Artificial Sequence
  Description of Artificial Sequence: Synthetic oligonucleotide
gaugcccacucauuuaau

SEQ ID NO: 145931 - RNA, 18 nt, Artificial Sequence
  Description of Artificial Sequence: Synthetic oligonucleotide
uuacagaugcccacucau

SEQ ID NO: 145932 - RNA, 18 nt, Artificial Sequence
  Description of Artificial Sequence: Synthetic oligonucleotide
auguguuacagaugccca

SEQ ID NO: 145933 - RNA, 18 nt, Artificial Sequence
  Description of Artificial Sequence: Synthetic oligonucleotide
augacauguguuacagau

SEQ ID NO: 145934 - RNA, 18 nt, Artificial Sequence
  Description of Artificial Sequence: Synthetic oligonucleotide
ugaugaugacauguguua

SEQ ID NO: 145935 - RNA, 18 nt, Artificial Sequence
  Description of Artificial Sequence: Synthetic oligonucleotide
aauaaugaugaugacaug

SEQ ID NO: 145936 - RNA, 18 nt, Artificial Sequence
  Description of Artificial Sequence: Synthetic oligonucleotide
auacuaauaaugaugaug

SEQ ID NO: 145937 - RNA, 18 nt, Artificial Sequence
  Description of Artificial Sequence: Synthetic oligonucleotide
ugggaauacuaauaauga

SEQ ID NO: 145938 - RNA, 18 nt, Artificial Sequence
  Description of Artificial Sequence: Synthetic oligonucleotide
aguggugggaauacuaau

SEQ ID NO: 145939 - RNA, 18 nt, Artificial Sequence
  Description of Artificial Sequence: Synthetic oligonucleotide
uuaacaguggugggaaua

SEQ ID NO: 145940 - RNA, 18 nt, Artificial Sequence
  Description of Artificial Sequence: Synthetic oligonucleotide
uuguguuaacaguggugg

SEQ ID NO: 145941 - RNA, 18 nt, Artificial Sequence
  Description of Artificial Sequence: Synthetic oligonucleotide
augccuuguguuaacagu

SEQ ID NO: 145942 - RNA, 18 nt, Artificial Sequence
  Description of Artificial Sequence: Synthetic oligonucleotide
cucagaugccuuguguua

SEQ ID NO: 145943 - RNA, 18 nt, Artificial Sequence
  Description of Artificial Sequence: Synthetic oligonucleotide
uuggucucagaugccuug

SEQ ID NO: 145944 - RNA, 18 nt, Artificial Sequence
  Description of Artificial Sequence: Synthetic oligonucleotide
ggagauuggucucagaug

SEQ ID NO: 145945 - RNA, 18 nt, Artificial Sequence
  Description of Artificial Sequence: Synthetic oligonucleotide
uuaguggagauuggucuc

SEQ ID NO: 145946 - RNA, 18 nt, Artificial Sequence
  Description of Artificial Sequence: Synthetic oligonucleotide
ugcuguuaguggagauug

SEQ ID NO: 145947 - RNA, 18 nt, Artificial Sequence
  Description of Artificial Sequence: Synthetic oligonucleotide
uagugugcuguuagugga

SEQ ID NO: 145948 - RNA, 18 nt, Artificial Sequence
  Description of Artificial Sequence: Synthetic oligonucleotide
cuuucuagugugcuguua

SEQ ID NO: 145949 - RNA, 18 nt, Artificial Sequence
  Description of Artificial Sequence: Synthetic oligonucleotide
cugaucuuucuagugugc

SEQ ID NO: 145950 - RNA, 18 nt, Artificial Sequence
  Description of Artificial Sequence: Synthetic oligonucleotide
uacagcugaucuuucuag

SEQ ID NO: 145951 - RNA, 18 nt, Artificial Sequence
  Description of Artificial Sequence: Synthetic oligonucleotide
ccagguacagcugaucuu

SEQ ID NO: 145952 - RNA, 18 nt, Artificial Sequence
  Description of Artificial Sequence: Synthetic oligonucleotide
caaucccagguacagcug

SEQ ID NO: 145953 - RNA, 18 nt, Artificial Sequence
  Description of Artificial Sequence: Synthetic oligonucleotide
cauaacaaucccagguac

SEQ ID NO: 145954 - RNA, 18 nt, Artificial Sequence
  Description of Artificial Sequence: Synthetic oligonucleotide
cugaucauaacaauccca

SEQ ID NO: 145955 - RNA, 18 nt, Artificial Sequence
  Description of Artificial Sequence: Synthetic oligonucleotide
uucgacugaucauaacaa

SEQ ID NO: 145956 - RNA, 18 nt, Artificial Sequence
  Description of Artificial Sequence: Synthetic oligonucleotide
uguguuucgacugaucau

SEQ ID NO: 145957 - RNA, 18 nt, Artificial Sequence
  Description of Artificial Sequence: Synthetic oligonucleotide
aacuguguguuucgacug

SEQ ID NO: 145958 - RNA, 18 nt, Artificial Sequence
  Description of Artificial Sequence: Synthetic oligonucleotide
aauugaacuguguguuuc

SEQ ID NO: 145959 - RNA, 18 nt, Artificial Sequence
  Description of Artificial Sequence: Synthetic oligonucleotide
agaccaauugaacugugu

SEQ ID NO: 145960 - RNA, 18 nt, Artificial Sequence
  Description of Artificial Sequence: Synthetic oligonucleotide
uuaccagaccaauugaac

SEQ ID NO: 145961 - RNA, 18 nt, Artificial Sequence
  Description of Artificial Sequence: Synthetic oligonucleotide
aauuauuaccagaccaau

SEQ ID NO: 145962 - RNA, 18 nt, Artificial Sequence
  Description of Artificial Sequence: Synthetic oligonucleotide
uguauaauuauuaccaga

SEQ ID NO: 145963 - RNA, 18 nt, Artificial Sequence
  Description of Artificial Sequence: Synthetic oligonucleotide
ugauguguauaauuauua

SEQ ID NO: 145964 - RNA, 18 nt, Artificial Sequence
  Description of Artificial Sequence: Synthetic oligonucleotide
aaugaugauguguauaau

SEQ ID NO: 145965 - RNA, 18 nt, Artificial Sequence
  Description of Artificial Sequence: Synthetic oligonucleotide
ggcucaaugaugaugugu

SEQ ID NO: 145966 - RNA, 18 nt, Artificial Sequence
  Description of Artificial Sequence: Synthetic oligonucleotide
gauacggcucaaugauga

SEQ ID NO: 145967 - RNA, 18 nt, Artificial Sequence
  Description of Artificial Sequence: Synthetic oligonucleotide
auuaugauacggcucaau

SEQ ID NO: 145968 - RNA, 18 nt, Artificial Sequence
  Description of Artificial Sequence: Synthetic oligonucleotide
aucuaauuaugauacggc

SEQ ID NO: 145969 - RNA, 18 nt, Artificial Sequence
  Description of Artificial Sequence: Synthetic oligonucleotide
uuuuuaucuaauuaugau

SEQ ID NO: 145970 - RNA, 18 nt, Artificial Sequence
  Description of Artificial Sequence: Synthetic oligonucleotide
uagcauuuuuaucuaauu

SEQ ID NO: 145971 - RNA, 18 nt, Artificial Sequence
  Description of Artificial Sequence: Synthetic oligonucleotide
cugcuuagcauuuuuauc

SEQ ID NO: 145972 - RNA, 18 nt, Artificial Sequence
  Description of Artificial Sequence: Synthetic oligonucleotide
acuaacugcuuagcauuu

SEQ ID NO: 145973 - RNA, 18 nt, Artificial Sequence
  Description of Artificial Sequence: Synthetic oligonucleotide
uucauacuaacugcuuag

SEQ ID NO: 145974 - RNA, 18 nt, Artificial Sequence
  Description of Artificial Sequence: Synthetic oligonucleotide
aguuauucauacuaacug

SEQ ID NO: 145975 - RNA, 18 nt, Artificial Sequence
  Description of Artificial Sequence: Synthetic oligonucleotide
aguugaguuauucauacu

SEQ ID NO: 145976 - RNA, 18 nt, Artificial Sequence
  Description of Artificial Sequence: Synthetic oligonucleotide
auauuaguugaguuauuc

SEQ ID NO: 145977 - RNA, 18 nt, Artificial Sequence
  Description of Artificial Sequence: Synthetic oligonucleotide
aauucucugucucagccu

SEQ ID NO: 145978 - RNA, 18 nt, Artificial Sequence
  Description of Artificial Sequence: Synthetic oligonucleotide
caagcaauucucugucuc

SEQ ID NO: 145979 - RNA, 18 nt, Artificial Sequence
  Description of Artificial Sequence: Synthetic oligonucleotide
ggguucaagcaauucucu

SEQ ID NO: 145980 - RNA, 18 nt, Artificial Sequence
  Description of Artificial Sequence: Synthetic oligonucleotide
cucccggguucaagcaau

SEQ ID NO: 145981 - RNA, 18 nt, Artificial Sequence
  Description of Artificial Sequence: Synthetic oligonucleotide
ucugccucccggguucaa

SEQ ID NO: 145982 - RNA, 18 nt, Artificial Sequence
  Description of Artificial Sequence: Synthetic oligonucleotide
caaccucugccucccggg

SEQ ID NO: 145983 - RNA, 18 nt, Artificial Sequence
  Description of Artificial Sequence: Synthetic oligonucleotide
cacugcaaccucugccuc

SEQ ID NO: 145984 - RNA, 18 nt, Artificial Sequence
  Description of Artificial Sequence: Synthetic oligonucleotide
cggcucacugcaaccucu

SEQ ID NO: 145985 - RNA, 18 nt, Artificial Sequence
  Description of Artificial Sequence: Synthetic oligonucleotide
gaucucggcucacugcaa

SEQ ID NO: 145986 - RNA, 18 nt, Artificial Sequence
  Description of Artificial Sequence: Synthetic oligonucleotide
ggcacgaucucggcucac

SEQ ID NO: 145987 - RNA, 18 nt, Artificial Sequence
  Description of Artificial Sequence: Synthetic oligonucleotide
gcaguggcacgaucucgg

SEQ ID NO: 145988 - RNA, 18 nt, Artificial Sequence
  Description of Artificial Sequence: Synthetic oligonucleotide
ggagugcaguggcacgau

SEQ ID NO: 145989 - RNA, 18 nt, Artificial Sequence
  Description of Artificial Sequence: Synthetic oligonucleotide
aggcuggagugcaguggc

SEQ ID NO: 145990 - RNA, 18 nt, Artificial Sequence
  Description of Artificial Sequence: Synthetic oligonucleotide
cucccaggcuggagugca

SEQ ID NO: 145991 - RNA, 18 nt, Artificial Sequence
  Description of Artificial Sequence: Synthetic oligonucleotide
ucugucucccaggcugga

SEQ ID NO: 145992 - RNA, 18 nt, Artificial Sequence
  Description of Artificial Sequence: Synthetic oligonucleotide
cucgcucugucucccagg

SEQ ID NO: 145993 - RNA, 18 nt, Artificial Sequence
  Description of Artificial Sequence: Synthetic oligonucleotide
agagucucgcucugucuc

SEQ ID NO: 145994 - RNA, 18 nt, Artificial Sequence
  Description of Artificial Sequence: Synthetic oligonucleotide
gagacagagucucgcucu

SEQ ID NO: 145995 - RNA, 18 nt, Artificial Sequence
  Description of Artificial Sequence: Synthetic oligonucleotide
uuuuugagacagagucuc

SEQ ID NO: 145996 - RNA, 18 nt, Artificial Sequence
  Description of Artificial Sequence: Synthetic oligonucleotide
uuuuuuuuuugagacaga

SEQ ID NO: 145997 - RNA, 18 nt, Artificial Sequence
  Description of Artificial Sequence: Synthetic oligonucleotide
ucuuuuuuuuuuuuugag

SEQ ID NO: 145998 - RNA, 18 nt, Artificial Sequence
  Description of Artificial Sequence: Synthetic oligonucleotide
ucuuuucuuuuuuuuuuu

SEQ ID NO: 145999 - RNA, 18 nt, Artificial Sequence
  Description of Artificial Sequence: Synthetic oligonucleotide
cuuuuucuuuucuuuuuu

SEQ ID NO: 146000 - RNA, 18 nt, Artificial Sequence
  Description of Artificial Sequence: Synthetic oligonucleotide
cuuuucuuuuucuuuucu

SEQ ID NO: 146001 - RNA, 18 nt, Artificial Sequence
  Description of Artificial Sequence: Synthetic oligonucleotide
cuucacuuuucuuuuucu

SEQ ID NO: 146002 - RNA, 18 nt, Artificial Sequence
  Description of Artificial Sequence: Synthetic oligonucleotide
gacuccuucacuuuucuu

SEQ ID NO: 146003 - RNA, 18 nt, Artificial Sequence
  Description of Artificial Sequence: Synthetic oligonucleotide
gggcagacuccuucacuu

SEQ ID NO: 146004 - RNA, 18 nt, Artificial Sequence
  Description of Artificial Sequence: Synthetic oligonucleotide
cuagcuuugugacuuggg

SEQ ID NO: 146005 - RNA, 18 nt, Artificial Sequence
  Description of Artificial Sequence: Synthetic oligonucleotide
uacuagcuuugugacuug

SEQ ID NO: 146006 - RNA, 18 nt, Artificial Sequence
  Description of Artificial Sequence: Synthetic oligonucleotide
caguuuacuagcuuugug

SEQ ID NO: 146007 - RNA, 18 nt, Artificial Sequence
  Description of Artificial Sequence: Synthetic oligonucleotide
cucagcaguuuacuagcu

SEQ ID NO: 146008 - RNA, 18 nt, Artificial Sequence
  Description of Artificial Sequence: Synthetic oligonucleotide
uccagcucagcaguuuac

SEQ ID NO: 146009 - RNA, 18 nt, Artificial Sequence
  Description of Artificial Sequence: Synthetic oligonucleotide
ugaguuccagcucagcag

SEQ ID NO: 146010 - RNA, 18 nt, Artificial Sequence
  Description of Artificial Sequence: Synthetic oligonucleotide
gggcuugaguuccagcuc

SEQ ID NO: 146011 - RNA, 18 nt, Artificial Sequence
  Description of Artificial Sequence: Synthetic oligonucleotide
ggccugggcuugaguucc

SEQ ID NO: 146012 - RNA, 18 nt, Artificial Sequence
  Description of Artificial Sequence: Synthetic oligonucleotide
acaaaggccugggcuuga

SEQ ID NO: 146013 - RNA, 18 nt, Artificial Sequence
  Description of Artificial Sequence: Synthetic oligonucleotide
uggugacaaaggccuggg

SEQ ID NO: 146014 - RNA, 18 nt, Artificial Sequence
  Description of Artificial Sequence: Synthetic oligonucleotide
gacuuuggugacaaaggc

SEQ ID NO: 146015 - RNA, 18 nt, Artificial Sequence
  Description of Artificial Sequence: Synthetic oligonucleotide
agacagacuuuggugaca

SEQ ID NO: 146016 - RNA, 18 nt, Artificial Sequence
  Description of Artificial Sequence: Synthetic oligonucleotide
ggguaagacagacuuugg

SEQ ID NO: 146017 - RNA, 18 nt, Artificial Sequence
  Description of Artificial Sequence: Synthetic oligonucleotide
ugagcuacgcuagcuggg

SEQ ID NO: 146018 - RNA, 18 nt, Artificial Sequence
  Description of Artificial Sequence: Synthetic oligonucleotide
ugacugagcuacgcuagc

SEQ ID NO: 146019 - RNA, 18 nt, Artificial Sequence
  Description of Artificial Sequence: Synthetic oligonucleotide
cugagugacugagcuacg

SEQ ID NO: 146020 - RNA, 18 nt, Artificial Sequence
  Description of Artificial Sequence: Synthetic oligonucleotide
acuuacugagugacugag

SEQ ID NO: 146021 - RNA, 18 nt, Artificial Sequence
  Description of Artificial Sequence: Synthetic oligonucleotide
cucuaacuuacugaguga

SEQ ID NO: 146022 - RNA, 18 nt, Artificial Sequence
  Description of Artificial Sequence: Synthetic oligonucleotide
aaggacucuaacuuacug

SEQ ID NO: 146023 - RNA, 18 nt, Artificial Sequence
  Description of Artificial Sequence: Synthetic oligonucleotide
cacacaaggacucuaacu

SEQ ID NO: 146024 - RNA, 18 nt, Artificial Sequence
  Description of Artificial Sequence: Synthetic oligonucleotide
cccagcacacaaggacuc

SEQ ID NO: 146025 - RNA, 18 nt, Artificial Sequence
  Description of Artificial Sequence: Synthetic oligonucleotide
cagugcccagcacacaag

SEQ ID NO: 146026 - RNA, 18 nt, Artificial Sequence
  Description of Artificial Sequence: Synthetic oligonucleotide
guucacagugcccagcac

SEQ ID NO: 146027 - RNA, 18 nt, Artificial Sequence
  Description of Artificial Sequence: Synthetic oligonucleotide
guuuuguucacagugccc

SEQ ID NO: 146028 - RNA, 18 nt, Artificial Sequence
  Description of Artificial Sequence: Synthetic oligonucleotide
ugucuguuuuguucacag

SEQ ID NO: 146029 - RNA, 18 nt, Artificial Sequence
  Description of Artificial Sequence: Synthetic oligonucleotide
gauuuugucuguuuuguu

SEQ ID NO: 146030 - RNA, 18 nt, Artificial Sequence
  Description of Artificial Sequence: Synthetic oligonucleotide
gcagugauuuugucuguu

SEQ ID NO: 146031 - RNA, 18 nt, Artificial Sequence
  Description of Artificial Sequence: Synthetic oligonucleotide
caagagcagugauuuugu

SEQ ID NO: 146032 - RNA, 18 nt, Artificial Sequence
  Description of Artificial Sequence: Synthetic oligonucleotide
cuuugcaagagcagugau

SEQ ID NO: 146033 - RNA, 18 nt, Artificial Sequence
  Description of Artificial Sequence: Synthetic oligonucleotide
uguaucuuugcaagagca

SEQ ID NO: 146034 - RNA, 18 nt, Artificial Sequence
  Description of Artificial Sequence: Synthetic oligonucleotide
uuugguguaucuuugcaa

SEQ ID NO: 146035 - RNA, 18 nt, Artificial Sequence
  Description of Artificial Sequence: Synthetic oligonucleotide
uuuuuuuugguguaucuu

SEQ ID NO: 146036 - RNA, 18 nt, Artificial Sequence
  Description of Artificial Sequence: Synthetic oligonucleotide
uuuuuuuuuuuuuggugu

SEQ ID NO: 146037 - RNA, 18 nt, Artificial Sequence
  Description of Artificial Sequence: Synthetic oligonucleotide
ugauuuuuuuuuuuuuuu

SEQ ID NO: 146038 - RNA, 18 nt, Artificial Sequence
  Description of Artificial Sequence: Synthetic oligonucleotide
agaugugauuuuuuuuuu

SEQ ID NO: 146039 - RNA, 18 nt, Artificial Sequence
  Description of Artificial Sequence: Synthetic oligonucleotide
ccacaagaugugauuuuu

SEQ ID NO: 146040 - RNA, 18 nt, Artificial Sequence
  Description of Artificial Sequence: Synthetic oligonucleotide
aagcuccacaagauguga

SEQ ID NO: 146041 - RNA, 18 nt, Artificial Sequence
  Description of Artificial Sequence: Synthetic oligonucleotide
aucgcaagcuccacaaga

SEQ ID NO: 146042 - RNA, 18 nt, Artificial Sequence
  Description of Artificial Sequence: Synthetic oligonucleotide
uccagaucgcaagcucca

SEQ ID NO: 146043 - RNA, 18 nt, Artificial Sequence
  Description of Artificial Sequence: Synthetic oligonucleotide
gccccuccagaucgcaag

SEQ ID NO: 146044 - RNA, 18 nt, Artificial Sequence
  Description of Artificial Sequence: Synthetic oligonucleotide
ggguggccccuccagauc

SEQ ID NO: 146045 - RNA, 18 nt, Artificial Sequence
  Description of Artificial Sequence: Synthetic oligonucleotide
caagguaggaaugauggg

SEQ ID NO: 146046 - RNA, 18 nt, Artificial Sequence
  Description of Artificial Sequence: Synthetic oligonucleotide
ucagcaagguaggaauga

SEQ ID NO: 146047 - RNA, 18 nt, Artificial Sequence
  Description of Artificial Sequence: Synthetic oligonucleotide
uagagucagcaagguagg

SEQ ID NO: 146048 - RNA, 18 nt, Artificial Sequence
  Description of Artificial Sequence: Synthetic oligonucleotide
agcucuagagucagcaag

SEQ ID NO: 146049 - RNA, 18 nt, Artificial Sequence
  Description of Artificial Sequence: Synthetic oligonucleotide
ccagaagcucuagaguca

SEQ ID NO: 146050 - RNA, 18 nt, Artificial Sequence
  Description of Artificial Sequence: Synthetic oligonucleotide
ggcccccagaagcucuag

SEQ ID NO: 146051 - RNA, 18 nt, Artificial Sequence
  Description of Artificial Sequence: Synthetic oligonucleotide
ccuaaggcccccagaagc

SEQ ID NO: 146052 - RNA, 18 nt, Artificial Sequence
  Description of Artificial Sequence: Synthetic oligonucleotide
uggagccuaaggccccca

SEQ ID NO: 146053 - RNA, 18 nt, Artificial Sequence
  Description of Artificial Sequence: Synthetic oligonucleotide
ccuuuuggagccuaaggc

SEQ ID NO: 146054 - RNA, 18 nt, Artificial Sequence
  Description of Artificial Sequence: Synthetic oligonucleotide
caaauccuuuuggagccu

SEQ ID NO: 146055 - RNA, 18 nt, Artificial Sequence
  Description of Artificial Sequence: Synthetic oligonucleotide
ugggccaaauccuuuugg

SEQ ID NO: 146056 - RNA, 18 nt, Artificial Sequence
  Description of Artificial Sequence: Synthetic oligonucleotide
gugcaugggccaaauccu

SEQ ID NO: 146057 - RNA, 18 nt, Artificial Sequence
  Description of Artificial Sequence: Synthetic oligonucleotide
uacaggugcaugggccaa

SEQ ID NO: 146058 - RNA, 18 nt, Artificial Sequence
  Description of Artificial Sequence: Synthetic oligonucleotide
cccuuuacaggugcaugg

SEQ ID NO: 146059 - RNA, 18 nt, Artificial Sequence
  Description of Artificial Sequence: Synthetic oligonucleotide
cccaucccuuuacaggug

SEQ ID NO: 146060 - RNA, 18 nt, Artificial Sequence
  Description of Artificial Sequence: Synthetic oligonucleotide
acauccccaucccuuuac

SEQ ID NO: 146061 - RNA, 18 nt, Artificial Sequence
  Description of Artificial Sequence: Synthetic oligonucleotide
cucugacauccccauccc

SEQ ID NO: 146062 - RNA, 18 nt, Artificial Sequence
  Description of Artificial Sequence: Synthetic oligonucleotide
agcaccucugacaucccc

SEQ ID NO: 146063 - RNA, 18 nt, Artificial Sequence
  Description of Artificial Sequence: Synthetic oligonucleotide
gccccagcaccucugaca

SEQ ID NO: 146064 - RNA, 18 nt, Artificial Sequence
  Description of Artificial Sequence: Synthetic oligonucleotide
ggcaggccccagcaccuc

SEQ ID NO: 146065 - RNA, 18 nt, Artificial Sequence
  Description of Artificial Sequence: Synthetic oligonucleotide
gcccaggcaggccccagc

SEQ ID NO: 146066 - RNA, 18 nt, Artificial Sequence
  Description of Artificial Sequence: Synthetic oligonucleotide
aaggagcccaggcaggcc

SEQ ID NO: 146067 - RNA, 18 nt, Artificial Sequence
  Description of Artificial Sequence: Synthetic oligonucleotide
ucagcaaggagcccaggc

SEQ ID NO: 146068 - RNA, 18 nt, Artificial Sequence
  Description of Artificial Sequence: Synthetic oligonucleotide
ggcagucagcaaggagcc

SEQ ID NO: 146069 - RNA, 18 nt, Artificial Sequence
  Description of Artificial Sequence: Synthetic oligonucleotide
auccgaccaaaacggaua

SEQ ID NO: 146070 - RNA, 18 nt, Artificial Sequence
  Description of Artificial Sequence: Synthetic oligonucleotide
ccggcauccgaccaaaac

SEQ ID NO: 146071 - RNA, 18 nt, Artificial Sequence
  Description of Artificial Sequence: Synthetic oligonucleotide
agccuccggcauccgacc

SEQ ID NO: 146072 - RNA, 18 nt, Artificial Sequence
  Description of Artificial Sequence: Synthetic oligonucleotide
uucucagccuccggcauc

SEQ ID NO: 146073 - RNA, 18 nt, Artificial Sequence
  Description of Artificial Sequence: Synthetic oligonucleotide
uccucuucucagccuccg

SEQ ID NO: 146074 - RNA, 18 nt, Artificial Sequence
  Description of Artificial Sequence: Synthetic oligonucleotide
cagcuuccucuucucagc

SEQ ID NO: 146075 - RNA, 18 nt, Artificial Sequence
  Description of Artificial Sequence: Synthetic oligonucleotide
gccaccagcuuccucuuc

SEQ ID NO: 146076 - RNA, 18 nt, Artificial Sequence
  Description of Artificial Sequence: Synthetic oligonucleotide
gcccugccaccagcuucc

SEQ ID NO: 146077 - RNA, 18 nt, Artificial Sequence
  Description of Artificial Sequence: Synthetic oligonucleotide
agucagcccugccaccag

SEQ ID NO: 146078 - RNA, 18 nt, Artificial Sequence
  Description of Artificial Sequence: Synthetic oligonucleotide
uuugcagucagcccugcc

SEQ ID NO: 146079 - RNA, 18 nt, Artificial Sequence
  Description of Artificial Sequence: Synthetic oligonucleotide
ccucguuugcagucagcc

SEQ ID NO: 146080 - RNA, 18 nt, Artificial Sequence
  Description of Artificial Sequence: Synthetic oligonucleotide
gcuccccucguuugcagu

SEQ ID NO: 146081 - RNA, 18 nt, Artificial Sequence
  Description of Artificial Sequence: Synthetic oligonucleotide
uacuggcuccccucguuu

SEQ ID NO: 146082 - RNA, 18 nt, Artificial Sequence
  Description of Artificial Sequence: Synthetic oligonucleotide
gguuguacuggcuccccu

SEQ ID NO: 146083 - RNA, 18 nt, Artificial Sequence
  Description of Artificial Sequence: Synthetic oligonucleotide
cuguggguuguacuggcu

SEQ ID NO: 146084 - RNA, 18 nt, Artificial Sequence
  Description of Artificial Sequence: Synthetic oligonucleotide
gccaccuguggguuguac

SEQ ID NO: 146085 - RNA, 18 nt, Artificial Sequence
  Description of Artificial Sequence: Synthetic oligonucleotide
ggucggccaccugugggu

SEQ ID NO: 146086 - RNA, 18 nt, Artificial Sequence
  Description of Artificial Sequence: Synthetic oligonucleotide
cuucaggucggccaccug

SEQ ID NO: 146087 - RNA, 18 nt, Artificial Sequence
  Description of Artificial Sequence: Synthetic oligonucleotide
aaggccuucaggucggcc

SEQ ID NO: 146088 - RNA, 18 nt, Artificial Sequence
  Description of Artificial Sequence: Synthetic oligonucleotide
uggagaaggccuucaggu

SEQ ID NO: 146089 - RNA, 18 nt, Artificial Sequence
  Description of Artificial Sequence: Synthetic oligonucleotide
gugcuuggagaaggccuu

SEQ ID NO: 146090 - RNA, 18 nt, Artificial Sequence
  Description of Artificial Sequence: Synthetic oligonucleotide
uagaugugcuuggagaag

SEQ ID NO: 146091 - RNA, 18 nt, Artificial Sequence
  Description of Artificial Sequence: Synthetic oligonucleotide
cauuguagaugugcuugg

SEQ ID NO: 146092 - RNA, 18 nt, Artificial Sequence
  Description of Artificial Sequence: Synthetic oligonucleotide
guaggcauuguagaugug

SEQ ID NO: 146093 - RNA, 18 nt, Artificial Sequence
  Description of Artificial Sequence: Synthetic oligonucleotide
uucagguaggcauuguag

SEQ ID NO: 146094 - RNA, 18 nt, Artificial Sequence
  Description of Artificial Sequence: Synthetic oligonucleotide
aguuuuucagguaggcau

SEQ ID NO: 146095 - RNA, 18 nt, Artificial Sequence
  Description of Artificial Sequence: Synthetic oligonucleotide
guugaaguuuuucaggua

SEQ ID NO: 146096 - RNA, 18 nt, Artificial Sequence
  Description of Artificial Sequence: Synthetic oligonucleotide
gucauguugaaguuuuuc

SEQ ID NO: 146097 - RNA, 18 nt, Artificial Sequence
  Description of Artificial Sequence: Synthetic oligonucleotide
uuuuggucauguugaagu

SEQ ID NO: 146098 - RNA, 18 nt, Artificial Sequence
  Description of Artificial Sequence: Synthetic oligonucleotide
cuucuuuuuggucauguu

SEQ ID NO: 146099 - RNA, 18 nt, Artificial Sequence
  Description of Artificial Sequence: Synthetic oligonucleotide
cgggccuucuuuuugguc

SEQ ID NO: 146100 - RNA, 18 nt, Artificial Sequence
  Description of Artificial Sequence: Synthetic oligonucleotide
ugcugcgggccuucuuuu

SEQ ID NO: 146101 - RNA, 18 nt, Artificial Sequence
  Description of Artificial Sequence: Synthetic oligonucleotide
gaggaugcugcgggccuu

SEQ ID NO: 146102 - RNA, 18 nt, Artificial Sequence
  Description of Artificial Sequence: Synthetic oligonucleotide
ccggugaggaugcugcgg

SEQ ID NO: 146103 - RNA, 18 nt, Artificial Sequence
  Description of Artificial Sequence: Synthetic oligonucleotide
cuuugccggugaggaugc

SEQ ID NO: 146104 - RNA, 18 nt, Artificial Sequence
  Description of Artificial Sequence: Synthetic oligonucleotide
gcuggcuuugccggugag

SEQ ID NO: 146105 - RNA, 18 nt, Artificial Sequence
  Description of Artificial Sequence: Synthetic oligonucleotide
guguggcuggcuuugccg

SEQ ID NO: 146106 - RNA, 18 nt, Artificial Sequence
  Description of Artificial Sequence: Synthetic oligonucleotide
cauccgaccaaaacggau

SEQ ID NO: 146107 - RNA, 18 nt, Artificial Sequence
  Description of Artificial Sequence: Synthetic oligonucleotide
uccggcauccgaccaaaa

SEQ ID NO: 146108 - RNA, 18 nt, Artificial Sequence
  Description of Artificial Sequence: Synthetic oligonucleotide
cagccuccggcauccgac

SEQ ID NO: 146109 - RNA, 18 nt, Artificial Sequence
  Description of Artificial Sequence: Synthetic oligonucleotide
cuucucagccuccggcau

SEQ ID NO: 146110 - RNA, 18 nt, Artificial Sequence
  Description of Artificial Sequence: Synthetic oligonucleotide
uuccucuucucagccucc

SEQ ID NO: 146111 - RNA, 18 nt, Artificial Sequence
  Description of Artificial Sequence: Synthetic oligonucleotide
ccagcuuccucuucucag

SEQ ID NO: 146112 - RNA, 18 nt, Artificial Sequence
  Description of Artificial Sequence: Synthetic oligonucleotide
ugccaccagcuuccucuu

SEQ ID NO: 146113 - RNA, 18 nt, Artificial Sequence
  Description of Artificial Sequence: Synthetic oligonucleotide
agcccugccaccagcuuc

SEQ ID NO: 146114 - RNA, 18 nt, Artificial Sequence
  Description of Artificial Sequence: Synthetic oligonucleotide
cagucagcccugccacca

SEQ ID NO: 146115 - RNA, 18 nt, Artificial Sequence
  Description of Artificial Sequence: Synthetic oligonucleotide
guuugcagucagcccugc

SEQ ID NO: 146116 - RNA, 18 nt, Artificial Sequence
  Description of Artificial Sequence: Synthetic oligonucleotide
cccucguuugcagucagc

SEQ ID NO: 146117 - RNA, 18 nt, Artificial Sequence
  Description of Artificial Sequence: Synthetic oligonucleotide
ggcuccccucguuugcag

SEQ ID NO: 146118 - RNA, 18 nt, Artificial Sequence
  Description of Artificial Sequence: Synthetic oligonucleotide
guacuggcuccccucguu

SEQ ID NO: 146119 - RNA, 18 nt, Artificial Sequence
  Description of Artificial Sequence: Synthetic oligonucleotide
ggguuguacuggcucccc

SEQ ID NO: 146120 - RNA, 18 nt, Artificial Sequence
  Description of Artificial Sequence: Synthetic oligonucleotide
ccuguggguuguacuggc

SEQ ID NO: 146121 - RNA, 18 nt, Artificial Sequence
  Description of Artificial Sequence: Synthetic oligonucleotide
ggccaccuguggguugua

SEQ ID NO: 146122 - RNA, 18 nt, Artificial Sequence
  Description of Artificial Sequence: Synthetic oligonucleotide
aggucggccaccuguggg

SEQ ID NO: 146123 - RNA, 18 nt, Artificial Sequence
  Description of Artificial Sequence: Synthetic oligonucleotide
ccuucaggucggccaccu

SEQ ID NO: 146124 - RNA, 18 nt, Artificial Sequence
  Description of Artificial Sequence: Synthetic oligonucleotide
gaaggccuucaggucggc

SEQ ID NO: 146125 - RNA, 18 nt, Artificial Sequence
  Description of Artificial Sequence: Synthetic oligonucleotide
uuggagaaggccuucagg

SEQ ID NO: 146126 - RNA, 18 nt, Artificial Sequence
  Description of Artificial Sequence: Synthetic oligonucleotide
ugugcuuggagaaggccu

SEQ ID NO: 146127 - RNA, 18 nt, Artificial Sequence
  Description of Artificial Sequence: Synthetic oligonucleotide
guagaugugcuuggagaa

SEQ ID NO: 146128 - RNA, 18 nt, Artificial Sequence
  Description of Artificial Sequence: Synthetic oligonucleotide
gcauuguagaugugcuug

SEQ ID NO: 146129 - RNA, 18 nt, Artificial Sequence
  Description of Artificial Sequence: Synthetic oligonucleotide
gguaggcauuguagaugu

SEQ ID NO: 146130 - RNA, 18 nt, Artificial Sequence
  Description of Artificial Sequence: Synthetic oligonucleotide
uuucagguaggcauugua

SEQ ID NO: 146131 - RNA, 18 nt, Artificial Sequence
  Description of Artificial Sequence: Synthetic oligonucleotide
aaguuuuucagguaggca

SEQ ID NO: 146132 - RNA, 18 nt, Artificial Sequence
  Description of Artificial Sequence: Synthetic oligonucleotide
uguugaaguuuuucaggu

SEQ ID NO: 146133 - RNA, 18 nt, Artificial Sequence
  Description of Artificial Sequence: Synthetic oligonucleotide
ggucauguugaaguuuuu

SEQ ID NO: 146134 - RNA, 18 nt, Artificial Sequence
  Description of Artificial Sequence: Synthetic oligonucleotide
uuuuuggucauguugaag

SEQ ID NO: 146135 - RNA, 18 nt, Artificial Sequence
  Description of Artificial Sequence: Synthetic oligonucleotide
ccuucuuuuuggucaugu

SEQ ID NO: 146136 - RNA, 18 nt, Artificial Sequence
  Description of Artificial Sequence: Synthetic oligonucleotide
gcgggccuucuuuuuggu

SEQ ID NO: 146137 - RNA, 18 nt, Artificial Sequence
  Description of Artificial Sequence: Synthetic oligonucleotide
augcugcgggccuucuuu

SEQ ID NO: 146138 - RNA, 18 nt, Artificial Sequence
  Description of Artificial Sequence: Synthetic oligonucleotide
ugaggaugcugcgggccu

SEQ ID NO: 146139 - RNA, 18 nt, Artificial Sequence
  Description of Artificial Sequence: Synthetic oligonucleotide
gccggugaggaugcugcg

SEQ ID NO: 146140 - RNA, 18 nt, Artificial Sequence
  Description of Artificial Sequence: Synthetic oligonucleotide
gcuuugccggugaggaug

SEQ ID NO: 146141 - RNA, 18 nt, Artificial Sequence
  Description of Artificial Sequence: Synthetic oligonucleotide
ggcuggcuuugccgguga

SEQ ID NO: 146142 - RNA, 18 nt, Artificial Sequence
  Description of Artificial Sequence: Synthetic oligonucleotide
cguguggcuggcuuugcc

SEQ ID NO: 146143 - RNA, 18 nt, Artificial Sequence
  Description of Artificial Sequence: Synthetic oligonucleotide
ggccaagcagcagcaaca

SEQ ID NO: 146144 - RNA, 18 nt, Artificial Sequence
  Description of Artificial Sequence: Synthetic oligonucleotide
ugccaggccaagcagcag

SEQ ID NO: 146145 - RNA, 18 nt, Artificial Sequence
  Description of Artificial Sequence: Synthetic oligonucleotide
gaugcugccaggccaagc

SEQ ID NO: 146146 - RNA, 18 nt, Artificial Sequence
  Description of Artificial Sequence: Synthetic oligonucleotide
cccaggaugcugccaggc

SEQ ID NO: 146147 - RNA, 18 nt, Artificial Sequence
  Description of Artificial Sequence: Synthetic oligonucleotide
cagagcccaggaugcugc

SEQ ID NO: 146148 - RNA, 18 nt, Artificial Sequence
  Description of Artificial Sequence: Synthetic oligonucleotide
ggacccagagcccaggau

SEQ ID NO: 146149 - RNA, 18 nt, Artificial Sequence
  Description of Artificial Sequence: Synthetic oligonucleotide
cagugggacccagagccc

SEQ ID NO: 146150 - RNA, 18 nt, Artificial Sequence
  Description of Artificial Sequence: Synthetic oligonucleotide
ggcggcagugggacccag

SEQ ID NO: 146151 - RNA, 18 nt, Artificial Sequence
  Description of Artificial Sequence: Synthetic oligonucleotide
aggcaggcggcaguggga

SEQ ID NO: 146152 - RNA, 18 nt, Artificial Sequence
  Description of Artificial Sequence: Synthetic oligonucleotide
gagucaggcaggcggcag

SEQ ID NO: 146153 - RNA, 18 nt, Artificial Sequence
  Description of Artificial Sequence: Synthetic oligonucleotide
ucccggagucaggcaggc

SEQ ID NO: 146154 - RNA, 18 nt, Artificial Sequence
  Description of Artificial Sequence: Synthetic oligonucleotide
ggcucucccggagucagg

SEQ ID NO: 146155 - RNA, 18 nt, Artificial Sequence
  Description of Artificial Sequence: Synthetic oligonucleotide
ggccuggcucucccggag

SEQ ID NO: 146156 - RNA, 18 nt, Artificial Sequence
  Description of Artificial Sequence: Synthetic oligonucleotide
gagaaggccuggcucucc

SEQ ID NO: 146157 - RNA, 18 nt, Artificial Sequence
  Description of Artificial Sequence: Synthetic oligonucleotide
ggagggagaaggccuggc

SEQ ID NO: 146158 - RNA, 18 nt, Artificial Sequence
  Description of Artificial Sequence: Synthetic oligonucleotide
uugagggagggagaaggc

SEQ ID NO: 146159 - RNA, 18 nt, Artificial Sequence
  Description of Artificial Sequence: Synthetic oligonucleotide
ugaaguugagggagggag

SEQ ID NO: 146160 - RNA, 18 nt, Artificial Sequence
  Description of Artificial Sequence: Synthetic oligonucleotide
caccaugaaguugaggga

SEQ ID NO: 146161 - RNA, 18 nt, Artificial Sequence
  Description of Artificial Sequence: Synthetic oligonucleotide
gccugcaccaugaaguug

SEQ ID NO: 146162 - RNA, 18 nt, Artificial Sequence
  Description of Artificial Sequence: Synthetic oligonucleotide
cccuugccugcaccauga

SEQ ID NO: 146163 - RNA, 18 nt, Artificial Sequence
  Description of Artificial Sequence: Synthetic oligonucleotide
cuggcucucccggaguca

SEQ ID NO: 146164 - RNA, 18 nt, Artificial Sequence
  Description of Artificial Sequence: Synthetic oligonucleotide
aaggccuggcucucccgg

SEQ ID NO: 146165 - RNA, 18 nt, Artificial Sequence
  Description of Artificial Sequence: Synthetic oligonucleotide
gggagaaggccuggcucu

SEQ ID NO: 146166 - RNA, 18 nt, Artificial Sequence
  Description of Artificial Sequence: Synthetic oligonucleotide
agggagggagaaggccug

SEQ ID NO: 146167 - RNA, 18 nt, Artificial Sequence
  Description of Artificial Sequence: Synthetic oligonucleotide
aguugagggagggagaag

SEQ ID NO: 146168 - RNA, 18 nt, Artificial Sequence
  Description of Artificial Sequence: Synthetic oligonucleotide
caugaaguugagggaggg

SEQ ID NO: 146169 - RNA, 18 nt, Artificial Sequence
  Description of Artificial Sequence: Synthetic oligonucleotide
ugcaccaugaaguugagg

SEQ ID NO: 146170 - RNA, 18 nt, Artificial Sequence
  Description of Artificial Sequence: Synthetic oligonucleotide
uugccugcaccaugaagu

SEQ ID NO: 146171 - RNA, 18 nt, Artificial Sequence
  Description of Artificial Sequence: Synthetic oligonucleotide
gucccuugccugcaccau

SEQ ID NO: 146172 - RNA, 18 nt, Artificial Sequence
  Description of Artificial Sequence: Synthetic oligonucleotide
cccaugucccuugccugc

SEQ ID NO: 146173 - RNA, 18 nt, Artificial Sequence
  Description of Artificial Sequence: Synthetic oligonucleotide
ugcuccccaugucccuug

SEQ ID NO: 146174 - RNA, 18 nt, Artificial Sequence
  Description of Artificial Sequence: Synthetic oligonucleotide
cccugugcuccccauguc

SEQ ID NO: 146175 - RNA, 18 nt, Artificial Sequence
  Description of Artificial Sequence: Synthetic oligonucleotide
ccccacccugugcucccc

SEQ ID NO: 146176 - RNA, 18 nt, Artificial Sequence
  Description of Artificial Sequence: Synthetic oligonucleotide
gagacccccacccugugc

SEQ ID NO: 146177 - RNA, 18 nt, Artificial Sequence
  Description of Artificial Sequence: Synthetic oligonucleotide
cucgggagacccccaccc

SEQ ID NO: 146178 - RNA, 18 nt, Artificial Sequence
  Description of Artificial Sequence: Synthetic oligonucleotide
caggccucgggagacccc

SEQ ID NO: 146179 - RNA, 18 nt, Artificial Sequence
  Description of Artificial Sequence: Synthetic oligonucleotide
gagaucaggccucgggag

SEQ ID NO: 146180 - RNA, 18 nt, Artificial Sequence
  Description of Artificial Sequence: Synthetic oligonucleotide
cguuagagaucaggccuc

SEQ ID NO: 146181 - RNA, 18 nt, Artificial Sequence
  Description of Artificial Sequence: Synthetic oligonucleotide
ugucguggaucacaaagg

SEQ ID NO: 146182 - RNA, 18 nt, Artificial Sequence
  Description of Artificial Sequence: Synthetic oligonucleotide
cucgaugucguggaucac

SEQ ID NO: 146183 - RNA, 18 nt, Artificial Sequence
  Description of Artificial Sequence: Synthetic oligonucleotide
aaugucucgaugucgugg

SEQ ID NO: 146184 - RNA, 18 nt, Artificial Sequence
  Description of Artificial Sequence: Synthetic oligonucleotide
gccacaaugucucgaugu

SEQ ID NO: 146185 - RNA, 18 nt, Artificial Sequence
  Description of Artificial Sequence: Synthetic oligonucleotide
ugccugccacaaugucuc

SEQ ID NO: 146186 - RNA, 18 nt, Artificial Sequence
  Description of Artificial Sequence: Synthetic oligonucleotide
uucucugccugccacaau

SEQ ID NO: 146187 - RNA, 18 nt, Artificial Sequence
  Description of Artificial Sequence: Synthetic oligonucleotide
gccccuucucugccugcc

SEQ ID NO: 146188 - RNA, 18 nt, Artificial Sequence
  Description of Artificial Sequence: Synthetic oligonucleotide
caccagccccuucucugc

SEQ ID NO: 146189 - RNA, 18 nt, Artificial Sequence
  Description of Artificial Sequence: Synthetic oligonucleotide
uuccacaccagccccuuc

SEQ ID NO: 146190 - RNA, 18 nt, Artificial Sequence
  Description of Artificial Sequence: Synthetic oligonucleotide
acugcuuccacaccagcc

SEQ ID NO: 146191 - RNA, 18 nt, Artificial Sequence
  Description of Artificial Sequence: Synthetic oligonucleotide
caccaacugcuuccacac

SEQ ID NO: 146192 - RNA, 18 nt, Artificial Sequence
  Description of Artificial Sequence: Synthetic oligonucleotide
ccauucaccaacugcuuc

SEQ ID NO: 146193 - RNA, 18 nt, Artificial Sequence
  Description of Artificial Sequence: Synthetic oligonucleotide
gcaggccauucaccaacu

SEQ ID NO: 146194 - RNA, 18 nt, Artificial Sequence
  Description of Artificial Sequence: Synthetic oligonucleotide
gggaggcaggccauucac

SEQ ID NO: 146195 - RNA, 18 nt, Artificial Sequence
  Description of Artificial Sequence: Synthetic oligonucleotide
uuguagggaggcaggcca

SEQ ID NO: 146196 - RNA, 18 nt, Artificial Sequence
  Description of Artificial Sequence: Synthetic oligonucleotide
ucuccuuguagggaggca

SEQ ID NO: 146197 - RNA, 18 nt, Artificial Sequence
  Description of Artificial Sequence: Synthetic oligonucleotide
gcugaucuccuuguaggg

SEQ ID NO: 146198 - RNA, 18 nt, Artificial Sequence
  Description of Artificial Sequence: Synthetic oligonucleotide
ugcacgcugaucuccuug

SEQ ID NO: 146199 - RNA, 18 nt, Artificial Sequence
  Description of Artificial Sequence: Synthetic oligonucleotide
agacgugcacgcugaucu

SEQ ID NO: 146200 - RNA, 18 nt, Artificial Sequence
  Description of Artificial Sequence: Synthetic oligonucleotide
guagaagacgugcacgcu

SEQ ID NO: 146201 - RNA, 18 nt, Artificial Sequence
  Description of Artificial Sequence: Synthetic oligonucleotide
cagcgguagaagacgugc

SEQ ID NO: 146202 - RNA, 18 nt, Artificial Sequence
  Description of Artificial Sequence: Synthetic oligonucleotide
acuggcagcgguagaaga

SEQ ID NO: 146203 - RNA, 18 nt, Artificial Sequence
  Description of Artificial Sequence: Synthetic oligonucleotide
ggugcacuggcagcggua

SEQ ID NO: 146204 - RNA, 18 nt, Artificial Sequence
  Description of Artificial Sequence: Synthetic oligonucleotide
acuguggugcacuggcag

SEQ ID NO: 146205 - RNA, 18 nt, Artificial Sequence
  Description of Artificial Sequence: Synthetic oligonucleotide
ucuccacuguggugcacu

SEQ ID NO: 146206 - RNA, 18 nt, Artificial Sequence
  Description of Artificial Sequence: Synthetic oligonucleotide
cacggucuccacuguggu

SEQ ID NO: 146207 - RNA, 18 nt, Artificial Sequence
  Description of Artificial Sequence: Synthetic oligonucleotide
ucccgcacggucuccacu

SEQ ID NO: 146208 - RNA, 18 nt, Artificial Sequence
  Description of Artificial Sequence: Synthetic oligonucleotide
ugagcucccgcacggucu

SEQ ID NO: 146209 - RNA, 18 nt, Artificial Sequence
  Description of Artificial Sequence: Synthetic oligonucleotide
cucagugagcucccgcac

SEQ ID NO: 146210 - RNA, 18 nt, Artificial Sequence
  Description of Artificial Sequence: Synthetic oligonucleotide
gcgaacucagugagcucc

SEQ ID NO: 146211 - RNA, 18 nt, Artificial Sequence
  Description of Artificial Sequence: Synthetic oligonucleotide
ucuuggcgaacucaguga

SEQ ID NO: 146212 - RNA, 18 nt, Artificial Sequence
  Description of Artificial Sequence: Synthetic oligonucleotide
gaugcucuuggcgaacuc

SEQ ID NO: 146213 - RNA, 18 nt, Artificial Sequence
  Description of Artificial Sequence: Synthetic oligonucleotide
gggaugcucuuggcgaac

SEQ ID NO: 146214 - RNA, 18 nt, Artificial Sequence
  Description of Artificial Sequence: Synthetic oligonucleotide
gaggcugcugaagcuggg

SEQ ID NO: 146215 - RNA, 18 nt, Artificial Sequence
  Description of Artificial Sequence: Synthetic oligonucleotide
aggaagaggcugcugaag

SEQ ID NO: 146216 - RNA, 18 nt, Artificial Sequence
  Description of Artificial Sequence: Synthetic oligonucleotide
cguugaggaagaggcugc

SEQ ID NO: 146217 - RNA, 18 nt, Artificial Sequence
  Description of Artificial Sequence: Synthetic oligonucleotide
cuggucguugaggaagag

SEQ ID NO: 146218 - RNA, 18 nt, Artificial Sequence
  Description of Artificial Sequence: Synthetic oligonucleotide
guaaccuggucguugagg

SEQ ID NO: 146219 - RNA, 18 nt, Artificial Sequence
  Description of Artificial Sequence: Synthetic oligonucleotide
gaaggguaaccuggucgu

SEQ ID NO: 146220 - RNA, 18 nt, Artificial Sequence
  Description of Artificial Sequence: Synthetic oligonucleotide
cuugagaaggguaaccug

SEQ ID NO: 146221 - RNA, 18 nt, Artificial Sequence
  Description of Artificial Sequence: Synthetic oligonucleotide
ccauacuugagaagggua

SEQ ID NO: 146222 - RNA, 18 nt, Artificial Sequence
  Description of Artificial Sequence: Synthetic oligonucleotide
gcacgccauacuugagaa

SEQ ID NO: 146223 - RNA, 18 nt, Artificial Sequence
  Description of Artificial Sequence: Synthetic oligonucleotide
cucgugcacgccauacuu

SEQ ID NO: 146224 - RNA, 18 nt, Artificial Sequence
  Description of Artificial Sequence: Synthetic oligonucleotide
auggccucgugcacgcca

SEQ ID NO: 146225 - RNA, 18 nt, Artificial Sequence
  Description of Artificial Sequence: Synthetic oligonucleotide
cgaagauggccucgugca

SEQ ID NO: 146226 - RNA, 18 nt, Artificial Sequence
  Description of Artificial Sequence: Synthetic oligonucleotide
cauggcgaagauggccuc

SEQ ID NO: 146227 - RNA, 18 nt, Artificial Sequence
  Description of Artificial Sequence: Synthetic oligonucleotide
gccagcauggcgaagaug

SEQ ID NO: 146228 - RNA, 18 nt, Artificial Sequence
  Description of Artificial Sequence: Synthetic oligonucleotide
uagaggccagcauggcga

SEQ ID NO: 146229 - RNA, 18 nt, Artificial Sequence
  Description of Artificial Sequence: Synthetic oligonucleotide
gacgauagaggccagcau

SEQ ID NO: 146230 - RNA, 18 nt, Artificial Sequence
  Description of Artificial Sequence: Synthetic oligonucleotide
uuguugacgauagaggcc

SEQ ID NO: 146231 - RNA, 18 nt, Artificial Sequence
  Description of Artificial Sequence: Synthetic oligonucleotide
cguccuuguugacgauag

SEQ ID NO: 146232 - RNA, 18 nt, Artificial Sequence
  Description of Artificial Sequence: Synthetic oligonucleotide
cagcccguccuuguugac

SEQ ID NO: 146233 - RNA, 18 nt, Artificial Sequence
  Description of Artificial Sequence: Synthetic oligonucleotide
accagcagcccguccuug

SEQ ID NO: 146234 - RNA, 18 nt, Artificial Sequence
  Description of Artificial Sequence: Synthetic oligonucleotide
uggcuaccagcagcccgu

SEQ ID NO: 146235 - RNA, 18 nt, Artificial Sequence
  Description of Artificial Sequence: Synthetic oligonucleotide
gccguuggcuaccagcag

SEQ ID NO: 146236 - RNA, 18 nt, Artificial Sequence
  Description of Artificial Sequence: Synthetic oligonucleotide
ccacugccguuggcuacc

SEQ ID NO: 146237 - RNA, 18 nt, Artificial Sequence
  Description of Artificial Sequence: Synthetic oligonucleotide
caaagccacugccguugg

SEQ ID NO: 146238 - RNA, 18 nt, Artificial Sequence
  Description of Artificial Sequence: Synthetic oligonucleotide
ggugacaaagccacugcc

SEQ ID NO: 146239 - RNA, 18 nt, Artificial Sequence
  Description of Artificial Sequence: Synthetic oligonucleotide
ucacgggugacaaagcca

SEQ ID NO: 146240 - RNA, 18 nt, Artificial Sequence
  Description of Artificial Sequence: Synthetic oligonucleotide
ggaacucacgggugacaa

SEQ ID NO: 146241 - RNA, 18 nt, Artificial Sequence
  Description of Artificial Sequence: Synthetic oligonucleotide
gcgcaggaacucacgggu

SEQ ID NO: 146242 - RNA, 18 nt, Artificial Sequence
  Description of Artificial Sequence: Synthetic oligonucleotide
aggcugcgcaggaacuca

SEQ ID NO: 146243 - RNA, 18 nt, Artificial Sequence
  Description of Artificial Sequence: Synthetic oligonucleotide
ugcggaggcugcgcagga

SEQ ID NO: 146244 - RNA, 18 nt, Artificial Sequence
  Description of Artificial Sequence: Synthetic oligonucleotide
ggguuugcggaggcugcg

SEQ ID NO: 146245 - RNA, 18 nt, Artificial Sequence
  Description of Artificial Sequence: Synthetic oligonucleotide
cugaaggguuugcggagg

SEQ ID NO: 146246 - RNA, 18 nt, Artificial Sequence
  Description of Artificial Sequence: Synthetic oligonucleotide
uaucacugaaggguuugc

SEQ ID NO: 146247 - RNA, 18 nt, Artificial Sequence
  Description of Artificial Sequence: Synthetic oligonucleotide
aaugauaucacugaaggg

SEQ ID NO: 146248 - RNA, 18 nt, Artificial Sequence
  Description of Artificial Sequence: Synthetic oligonucleotide
ggcucaaugauaucacug

SEQ ID NO: 146249 - RNA, 18 nt, Artificial Sequence
  Description of Artificial Sequence: Synthetic oligonucleotide
acuuaggcucaaugauau

SEQ ID NO: 146250 - RNA, 18 nt, Artificial Sequence
  Description of Artificial Sequence: Synthetic oligonucleotide
uucaaacuuaggcucaau

SEQ ID NO: 146251 - RNA, 18 nt, Artificial Sequence
  Description of Artificial Sequence: Synthetic oligonucleotide
gcaaauucaaacuuaggc

SEQ ID NO: 146252 - RNA, 18 nt, Artificial Sequence
  Description of Artificial Sequence: Synthetic oligonucleotide
ugacagcaaauucaaacu

SEQ ID NO: 146253 - RNA, 18 nt, Artificial Sequence
  Description of Artificial Sequence: Synthetic oligonucleotide
gaacuugacagcaaauuc

SEQ ID NO: 146254 - RNA, 18 nt, Artificial Sequence
  Description of Artificial Sequence: Synthetic oligonucleotide
gcguugaacuugacagca

SEQ ID NO: 146255 - RNA, 18 nt, Artificial Sequence
  Description of Artificial Sequence: Synthetic oligonucleotide
ccagggcguugaacuuga

SEQ ID NO: 146256 - RNA, 18 nt, Artificial Sequence
  Description of Artificial Sequence: Synthetic oligonucleotide
aaguuccagggcguugaa

SEQ ID NO: 146257 - RNA, 18 nt, Artificial Sequence
  Description of Artificial Sequence: Synthetic oligonucleotide
ucaucaaguuccagggcg

SEQ ID NO: 146258 - RNA, 18 nt, Artificial Sequence
  Description of Artificial Sequence: Synthetic oligonucleotide
cacugucaucaaguucca

SEQ ID NO: 146259 - RNA, 18 nt, Artificial Sequence
  Description of Artificial Sequence: Synthetic oligonucleotide
caggucacugucaucaag

SEQ ID NO: 146260 - RNA, 18 nt, Artificial Sequence
  Description of Artificial Sequence: Synthetic oligonucleotide
agggccaggucacuguca

SEQ ID NO: 146261 - RNA, 18 nt, Artificial Sequence
  Description of Artificial Sequence: Synthetic oligonucleotide
ugaauagggccaggucac

SEQ ID NO: 146262 - RNA, 18 nt, Artificial Sequence
  Description of Artificial Sequence: Synthetic oligonucleotide
cgcaaugaauagggccag

SEQ ID NO: 146263 - RNA, 18 nt, Artificial Sequence
  Description of Artificial Sequence: Synthetic oligonucleotide
auggccgcaaugaauagg

SEQ ID NO: 146264 - RNA, 18 nt, Artificial Sequence
  Description of Artificial Sequence: Synthetic oligonucleotide
gaaugauggccgcaauga

SEQ ID NO: 146265 - RNA, 18 nt, Artificial Sequence
  Description of Artificial Sequence: Synthetic oligonucleotide
acacagaaugauggccgc

SEQ ID NO: 146266 - RNA, 18 nt, Artificial Sequence
  Description of Artificial Sequence: Synthetic oligonucleotide
gaugucguggaucacaaa

SEQ ID NO: 146267 - RNA, 18 nt, Artificial Sequence
  Description of Artificial Sequence: Synthetic oligonucleotide
gucucgaugucguggauc

SEQ ID NO: 146268 - RNA, 18 nt, Artificial Sequence
  Description of Artificial Sequence: Synthetic oligonucleotide
acaaugucucgaugucgu

SEQ ID NO: 146269 - RNA, 18 nt, Artificial Sequence
  Description of Artificial Sequence: Synthetic oligonucleotide
cugccacaaugucucgau

SEQ ID NO: 146270 - RNA, 18 nt, Artificial Sequence
  Description of Artificial Sequence: Synthetic oligonucleotide
ucugccugccacaauguc

SEQ ID NO: 146271 - RNA, 18 nt, Artificial Sequence
  Description of Artificial Sequence: Synthetic oligonucleotide
ccuucucugccugccaca

SEQ ID NO: 146272 - RNA, 18 nt, Artificial Sequence
  Description of Artificial Sequence: Synthetic oligonucleotide
cagccccuucucugccug

SEQ ID NO: 146273 - RNA, 18 nt, Artificial Sequence
  Description of Artificial Sequence: Synthetic oligonucleotide
cacaccagccccuucucu

SEQ ID NO: 146274 - RNA, 18 nt, Artificial Sequence
  Description of Artificial Sequence: Synthetic oligonucleotide
gcuuccacaccagccccu

SEQ ID NO: 146275 - RNA, 18 nt, Artificial Sequence
  Description of Artificial Sequence: Synthetic oligonucleotide
caacugcuuccacaccag

SEQ ID NO: 146276 - RNA, 18 nt, Artificial Sequence
  Description of Artificial Sequence: Synthetic oligonucleotide
uucaccaacugcuuccac

SEQ ID NO: 146277 - RNA, 18 nt, Artificial Sequence
  Description of Artificial Sequence: Synthetic oligonucleotide
ggccauucaccaacugcu

SEQ ID NO: 146278 - RNA, 18 nt, Artificial Sequence
  Description of Artificial Sequence: Synthetic oligonucleotide
aggcaggccauucaccaa

SEQ ID NO: 146279 - RNA, 18 nt, Artificial Sequence
  Description of Artificial Sequence: Synthetic oligonucleotide
uagggaggcaggccauuc

SEQ ID NO: 146280 - RNA, 18 nt, Artificial Sequence
  Description of Artificial Sequence: Synthetic oligonucleotide
ccuuguagggaggcaggc

SEQ ID NO: 146281 - RNA, 18 nt, Artificial Sequence
  Description of Artificial Sequence: Synthetic oligonucleotide
gaucuccuuguagggagg

SEQ ID NO: 146282 - RNA, 18 nt, Artificial Sequence
  Description of Artificial Sequence: Synthetic oligonucleotide
acgcugaucuccuuguag

SEQ ID NO: 146283 - RNA, 18 nt, Artificial Sequence
  Description of Artificial Sequence: Synthetic oligonucleotide
cgugcacgcugaucuccu

SEQ ID NO: 146284 - RNA, 18 nt, Artificial Sequence
  Description of Artificial Sequence: Synthetic oligonucleotide
gaagacgugcacgcugau

SEQ ID NO: 146285 - RNA, 18 nt, Artificial Sequence
  Description of Artificial Sequence: Synthetic oligonucleotide
cgguagaagacgugcacg

SEQ ID NO: 146286 - RNA, 18 nt, Artificial Sequence
  Description of Artificial Sequence: Synthetic oligonucleotide
ggcagcgguagaagacgu

SEQ ID NO: 146287 - RNA, 18 nt, Artificial Sequence
  Description of Artificial Sequence: Synthetic oligonucleotide
gcacuggcagcgguagaa

SEQ ID NO: 146288 - RNA, 18 nt, Artificial Sequence
  Description of Artificial Sequence: Synthetic oligonucleotide
guggugcacuggcagcgg

SEQ ID NO: 146289 - RNA, 18 nt, Artificial Sequence
  Description of Artificial Sequence: Synthetic oligonucleotide
ccacuguggugcacuggc

SEQ ID NO: 146290 - RNA, 18 nt, Artificial Sequence
  Description of Artificial Sequence: Synthetic oligonucleotide
ggucuccacuguggugca

SEQ ID NO: 146291 - RNA, 18 nt, Artificial Sequence
  Description of Artificial Sequence: Synthetic oligonucleotide
cgcacggucuccacugug

SEQ ID NO: 146292 - RNA, 18 nt, Artificial Sequence
  Description of Artificial Sequence: Synthetic oligonucleotide
gcucccgcacggucucca

SEQ ID NO: 146293 - RNA, 18 nt, Artificial Sequence
  Description of Artificial Sequence: Synthetic oligonucleotide
agugagcucccgcacggu

SEQ ID NO: 146294 - RNA, 18 nt, Artificial Sequence
  Description of Artificial Sequence: Synthetic oligonucleotide
aacucagugagcucccgc

SEQ ID NO: 146295 - RNA, 18 nt, Artificial Sequence
  Description of Artificial Sequence: Synthetic oligonucleotide
uggcgaacucagugagcu

SEQ ID NO: 146296 - RNA, 18 nt, Artificial Sequence
  Description of Artificial Sequence: Synthetic oligonucleotide
gcucuuggcgaacucagu

SEQ ID NO: 146297 - RNA, 18 nt, Artificial Sequence
  Description of Artificial Sequence: Synthetic oligonucleotide
gggaugcucuuggcgaac

SEQ ID NO: 146298 - RNA, 18 nt, Artificial Sequence
  Description of Artificial Sequence: Synthetic oligonucleotide
gaggcugcugaagcuggg

SEQ ID NO: 146299 - RNA, 18 nt, Artificial Sequence
  Description of Artificial Sequence: Synthetic oligonucleotide
agaggcugcugaagcugg

SEQ ID NO: 146300 - RNA, 18 nt, Artificial Sequence
  Description of Artificial Sequence: Synthetic oligonucleotide
gaggaagaggcugcugaa

SEQ ID NO: 146301 - RNA, 18 nt, Artificial Sequence
  Description of Artificial Sequence: Synthetic oligonucleotide
ucguugaggaagaggcug

SEQ ID NO: 146302 - RNA, 18 nt, Artificial Sequence
  Description of Artificial Sequence: Synthetic oligonucleotide
ccuggucguugaggaaga

SEQ ID NO: 146303 - RNA, 18 nt, Artificial Sequence
  Description of Artificial Sequence: Synthetic oligonucleotide
gguaaccuggucguugag

SEQ ID NO: 146304 - RNA, 18 nt, Artificial Sequence
  Description of Artificial Sequence: Synthetic oligonucleotide
agaaggguaaccuggucg

SEQ ID NO: 146305 - RNA, 18 nt, Artificial Sequence
  Description of Artificial Sequence: Synthetic oligonucleotide
acuugagaaggguaaccu

SEQ ID NO: 146306 - RNA, 18 nt, Artificial Sequence
  Description of Artificial Sequence: Synthetic oligonucleotide
gccauacuugagaagggu

SEQ ID NO: 146307 - RNA, 18 nt, Artificial Sequence
  Description of Artificial Sequence: Synthetic oligonucleotide
ugcacgccauacuugaga

SEQ ID NO: 146308 - RNA, 18 nt, Artificial Sequence
  Description of Artificial Sequence: Synthetic oligonucleotide
ccucgugcacgccauacu

SEQ ID NO: 146309 - RNA, 18 nt, Artificial Sequence
  Description of Artificial Sequence: Synthetic oligonucleotide
gauggccucgugcacgcc

SEQ ID NO: 146310 - RNA, 18 nt, Artificial Sequence
  Description of Artificial Sequence: Synthetic oligonucleotide
gcgaagauggccucgugc

SEQ ID NO: 146311 - RNA, 18 nt, Artificial Sequence
  Description of Artificial Sequence: Synthetic oligonucleotide
gcauggcgaagauggccu

SEQ ID NO: 146312 - RNA, 18 nt, Artificial Sequence
  Description of Artificial Sequence: Synthetic oligonucleotide
ggccagcauggcgaagau

SEQ ID NO: 146313 - RNA, 18 nt, Artificial Sequence
  Description of Artificial Sequence: Synthetic oligonucleotide
auagaggccagcauggcg

SEQ ID NO: 146314 - RNA, 18 nt, Artificial Sequence
  Description of Artificial Sequence: Synthetic oligonucleotide
ugacgauagaggccagca

SEQ ID NO: 146315 - RNA, 18 nt, Artificial Sequence
  Description of Artificial Sequence: Synthetic oligonucleotide
cuuguugacgauagaggc

SEQ ID NO: 146316 - RNA, 18 nt, Artificial Sequence
  Description of Artificial Sequence: Synthetic oligonucleotide
ccguccuuguugacgaua

SEQ ID NO: 146317 - RNA, 18 nt, Artificial Sequence
  Description of Artificial Sequence: Synthetic oligonucleotide
gcagcccguccuuguuga

SEQ ID NO: 146318 - RNA, 18 nt, Artificial Sequence
  Description of Artificial Sequence: Synthetic oligonucleotide
uaccagcagcccguccuu

SEQ ID NO: 146319 - RNA, 18 nt, Artificial Sequence
  Description of Artificial Sequence: Synthetic oligonucleotide
uuggcuaccagcagcccg

SEQ ID NO: 146320 - RNA, 18 nt, Artificial Sequence
  Description of Artificial Sequence: Synthetic oligonucleotide
ugccguuggcuaccagca

SEQ ID NO: 146321 - RNA, 18 nt, Artificial Sequence
  Description of Artificial Sequence: Synthetic oligonucleotide
gccacugccguuggcuac

SEQ ID NO: 146322 - RNA, 18 nt, Artificial Sequence
  Description of Artificial Sequence: Synthetic oligonucleotide
acaaagccacugccguug

SEQ ID NO: 146323 - RNA, 18 nt, Artificial Sequence
  Description of Artificial Sequence: Synthetic oligonucleotide
gggugacaaagccacugc

SEQ ID NO: 146324 - RNA, 18 nt, Artificial Sequence
  Description of Artificial Sequence: Synthetic oligonucleotide
cucacgggugacaaagcc

SEQ ID NO: 146325 - RNA, 18 nt, Artificial Sequence
  Description of Artificial Sequence: Synthetic oligonucleotide
aggaacucacgggugaca

SEQ ID NO: 146326 - RNA, 18 nt, Artificial Sequence
  Description of Artificial Sequence: Synthetic oligonucleotide
ugcgcaggaacucacggg

SEQ ID NO: 146327 - RNA, 18 nt, Artificial Sequence
  Description of Artificial Sequence: Synthetic oligonucleotide
gaggcugcgcaggaacuc

SEQ ID NO: 146328 - RNA, 18 nt, Artificial Sequence
  Description of Artificial Sequence: Synthetic oligonucleotide
uugcggaggcugcgcagg

SEQ ID NO: 146329 - RNA, 18 nt, Artificial Sequence
  Description of Artificial Sequence: Synthetic oligonucleotide
aggguuugcggaggcugc

SEQ ID NO: 146330 - RNA, 18 nt, Artificial Sequence
  Description of Artificial Sequence: Synthetic oligonucleotide
acugaaggguuugcggag

SEQ ID NO: 146331 - RNA, 18 nt, Artificial Sequence
  Description of Artificial Sequence: Synthetic oligonucleotide
auaucacugaaggguuug

SEQ ID NO: 146332 - RNA, 18 nt, Artificial Sequence
  Description of Artificial Sequence: Synthetic oligonucleotide
caaugauaucacugaagg

SEQ ID NO: 146333 - RNA, 18 nt, Artificial Sequence
  Description of Artificial Sequence: Synthetic oligonucleotide
aggcucaaugauaucacu

SEQ ID NO: 146334 - RNA, 18 nt, Artificial Sequence
  Description of Artificial Sequence: Synthetic oligonucleotide
aacuuaggcucaaugaua

SEQ ID NO: 146335 - RNA, 18 nt, Artificial Sequence
  Description of Artificial Sequence: Synthetic oligonucleotide
auucaaacuuaggcucaa

SEQ ID NO: 146336 - RNA, 18 nt, Artificial Sequence
  Description of Artificial Sequence: Synthetic oligonucleotide
agcaaauucaaacuuagg

SEQ ID NO: 146337 - RNA, 18 nt, Artificial Sequence
  Description of Artificial Sequence: Synthetic oligonucleotide
uugacagcaaauucaaac

SEQ ID NO: 146338 - RNA, 18 nt, Artificial Sequence
  Description of Artificial Sequence: Synthetic oligonucleotide
ugaacuugacagcaaauu

SEQ ID NO: 146339 - RNA, 18 nt, Artificial Sequence
  Description of Artificial Sequence: Synthetic oligonucleotide
ggcguugaacuugacagc

SEQ ID NO: 146340 - RNA, 18 nt, Artificial Sequence
  Description of Artificial Sequence: Synthetic oligonucleotide
uccagggcguugaacuug

SEQ ID NO: 146341 - RNA, 18 nt, Artificial Sequence
  Description of Artificial Sequence: Synthetic oligonucleotide
caaguuccagggcguuga

SEQ ID NO: 146342 - RNA, 18 nt, Artificial Sequence
  Description of Artificial Sequence: Synthetic oligonucleotide
gucaucaaguuccagggc

SEQ ID NO: 146343 - RNA, 18 nt, Artificial Sequence
  Description of Artificial Sequence: Synthetic oligonucleotide
ucacugucaucaaguucc

SEQ ID NO: 146344 - RNA, 18 nt, Artificial Sequence
  Description of Artificial Sequence: Synthetic oligonucleotide
ccaggucacugucaucaa

SEQ ID NO: 146345 - RNA, 18 nt, Artificial Sequence
  Description of Artificial Sequence: Synthetic oligonucleotide
uagggccaggucacuguc

SEQ ID NO: 146346 - RNA, 18 nt, Artificial Sequence
  Description of Artificial Sequence: Synthetic oligonucleotide
augaauagggccagguca

SEQ ID NO: 146347 - RNA, 18 nt, Artificial Sequence
  Description of Artificial Sequence: Synthetic oligonucleotide
ccgcaaugaauagggcca

SEQ ID NO: 146348 - RNA, 18 nt, Artificial Sequence
  Description of Artificial Sequence: Synthetic oligonucleotide
gauggccgcaaugaauag

SEQ ID NO: 146349 - RNA, 18 nt, Artificial Sequence
  Description of Artificial Sequence: Synthetic oligonucleotide
agaaugauggccgcaaug

SEQ ID NO: 146350 - RNA, 18 nt, Artificial Sequence
  Description of Artificial Sequence: Synthetic oligonucleotide
cacacagaaugauggccg

SEQ ID NO: 146351 - RNA, 18 nt, Artificial Sequence
  Description of Artificial Sequence: Synthetic oligonucleotide
ccaccugccccacucuca

SEQ ID NO: 146352 - RNA, 18 nt, Artificial Sequence
  Description of Artificial Sequence: Synthetic oligonucleotide
ccagcccaccugccccac

SEQ ID NO: 146353 - RNA, 18 nt, Artificial Sequence
  Description of Artificial Sequence: Synthetic oligonucleotide
ccaggccagcccaccugc

SEQ ID NO: 146354 - RNA, 18 nt, Artificial Sequence
  Description of Artificial Sequence: Synthetic oligonucleotide
gugugccaggccagccca

SEQ ID NO: 146355 - RNA, 18 nt, Artificial Sequence
  Description of Artificial Sequence: Synthetic oligonucleotide
acugggugugccaggcca

SEQ ID NO: 146356 - RNA, 18 nt, Artificial Sequence
  Description of Artificial Sequence: Synthetic oligonucleotide
ggacgacugggugugcca

SEQ ID NO: 146357 - RNA, 18 nt, Artificial Sequence
  Description of Artificial Sequence: Synthetic oligonucleotide
ccccaggacgacugggug

SEQ ID NO: 146358 - RNA, 18 nt, Artificial Sequence
  Description of Artificial Sequence: Synthetic oligonucleotide
ccaacccccaggacgacu

SEQ ID NO: 146359 - RNA, 18 nt, Artificial Sequence
  Description of Artificial Sequence: Synthetic oligonucleotide
gagggccaacccccagga

SEQ ID NO: 146360 - RNA, 18 nt, Artificial Sequence
  Description of Artificial Sequence: Synthetic oligonucleotide
gcagugagggccaacccc

SEQ ID NO: 146361 - RNA, 18 nt, Artificial Sequence
  Description of Artificial Sequence: Synthetic oligonucleotide
gcccugcagugagggcca

SEQ ID NO: 146362 - RNA, 18 nt, Artificial Sequence
  Description of Artificial Sequence: Synthetic oligonucleotide
acagugcccugcagugag

SEQ ID NO: 146363 - RNA, 18 nt, Artificial Sequence
  Description of Artificial Sequence: Synthetic oligonucleotide
caggcacagugcccugca

SEQ ID NO: 146364 - RNA, 18 nt, Artificial Sequence
  Description of Artificial Sequence: Synthetic oligonucleotide
gagcucaggcacagugcc

SEQ ID NO: 146365 - RNA, 18 nt, Artificial Sequence
  Description of Artificial Sequence: Synthetic oligonucleotide
ugucagagcucaggcaca

SEQ ID NO: 146366 - RNA, 18 nt, Artificial Sequence
  Description of Artificial Sequence: Synthetic oligonucleotide
cacacugucagagcucag

SEQ ID NO: 146367 - RNA, 18 nt, Artificial Sequence
  Description of Artificial Sequence: Synthetic oligonucleotide
uuccccacacugucagag

SEQ ID NO: 146368 - RNA, 18 nt, Artificial Sequence
  Description of Artificial Sequence: Synthetic oligonucleotide
gacacuuccccacacugu

SEQ ID NO: 146369 - RNA, 18 nt, Artificial Sequence
  Description of Artificial Sequence: Synthetic oligonucleotide
acagggacacuuccccac

SEQ ID NO: 146370 - RNA, 18 nt, Artificial Sequence
  Description of Artificial Sequence: Synthetic oligonucleotide
agaucacagggacacuuc

SEQ ID NO: 146371 - RNA, 18 nt, Artificial Sequence
  Description of Artificial Sequence: Synthetic oligonucleotide
ugccaagaucacagggac

SEQ ID NO: 146372 - RNA, 18 nt, Artificial Sequence
  Description of Artificial Sequence: Synthetic oligonucleotide
uccacugccaagaucaca

SEQ ID NO: 146373 - RNA, 18 nt, Artificial Sequence
  Description of Artificial Sequence: Synthetic oligonucleotide
cauguuccacugccaaga

SEQ ID NO: 146374 - RNA, 18 nt, Artificial Sequence
  Description of Artificial Sequence: Synthetic oligonucleotide
ccuugcauguuccacugc

SEQ ID NO: 146375 - RNA, 18 nt, Artificial Sequence
  Description of Artificial Sequence: Synthetic oligonucleotide
cagugccuugcauguucc

SEQ ID NO: 146376 - RNA, 18 nt, Artificial Sequence
  Description of Artificial Sequence: Synthetic oligonucleotide
ucagucagugccuugcau

SEQ ID NO: 146377 - RNA, 18 nt, Artificial Sequence
  Description of Artificial Sequence: Synthetic oligonucleotide
caugcucagucagugccu

SEQ ID NO: 146378 - RNA, 18 nt, Artificial Sequence
  Description of Artificial Sequence: Synthetic oligonucleotide
uccugcaugcucagucag

SEQ ID NO: 146379 - RNA, 18 nt, Artificial Sequence
  Description of Artificial Sequence: Synthetic oligonucleotide
gcugauccugcaugcuca

SEQ ID NO: 146380 - RNA, 18 nt, Artificial Sequence
  Description of Artificial Sequence: Synthetic oligonucleotide
auggagcugauccugcau

SEQ ID NO: 146381 - RNA, 18 nt, Artificial Sequence
  Description of Artificial Sequence: Synthetic oligonucleotide
augagauggagcugaucc

SEQ ID NO: 146382 - RNA, 18 nt, Artificial Sequence
  Description of Artificial Sequence: Synthetic oligonucleotide
acauaaugagauggagcu

SEQ ID NO: 146383 - RNA, 18 nt, Artificial Sequence
  Description of Artificial Sequence: Synthetic oligonucleotide
uacguacauaaugagaug

SEQ ID NO: 146384 - RNA, 18 nt, Artificial Sequence
  Description of Artificial Sequence: Synthetic oligonucleotide
cuaucuacguacauaaug

SEQ ID NO: 146385 - RNA, 18 nt, Artificial Sequence
  Description of Artificial Sequence: Synthetic oligonucleotide
caccucuaucuacguaca

SEQ ID NO: 146386 - RNA, 18 nt, Artificial Sequence
  Description of Artificial Sequence: Synthetic oligonucleotide
gucuccaccucuaucuac

SEQ ID NO: 146387 - RNA, 18 nt, Artificial Sequence
  Description of Artificial Sequence: Synthetic oligonucleotide
uuccugucuccaccucua

SEQ ID NO: 146388 - RNA, 18 nt, Artificial Sequence
  Description of Artificial Sequence: Synthetic oligonucleotide
ucuuuuuccugucuccac

SEQ ID NO: 146389 - RNA, 18 nt, Artificial Sequence
  Description of Artificial Sequence: Synthetic oligonucleotide
cuuagucuuuuuccuguc

SEQ ID NO: 146390 - RNA, 18 nt, Artificial Sequence
  Description of Artificial Sequence: Synthetic oligonucleotide
ucuggcuuagucuuuuuc

SEQ ID NO: 146391 - RNA, 18 nt, Artificial Sequence
  Description of Artificial Sequence: Synthetic oligonucleotide
ccacgucuggcuuagucu

SEQ ID NO: 146392 - RNA, 18 nt, Artificial Sequence
  Description of Artificial Sequence: Synthetic oligonucleotide
agccaccacgucuggcuu

SEQ ID NO: 146393 - RNA, 18 nt, Artificial Sequence
  Description of Artificial Sequence: Synthetic oligonucleotide
gugugagccaccacgucu

SEQ ID NO: 146394 - RNA, 18 nt, Artificial Sequence
  Description of Artificial Sequence: Synthetic oligonucleotide
uacaggugugagccacca

SEQ ID NO: 146395 - RNA, 18 nt, Artificial Sequence
  Description of Artificial Sequence: Synthetic oligonucleotide
gggauuacaggugugagc

SEQ ID NO: 146396 - RNA, 18 nt, Artificial Sequence
  Description of Artificial Sequence: Synthetic oligonucleotide
gugcugggauuacaggug

SEQ ID NO: 146397 - RNA, 18 nt, Artificial Sequence
  Description of Artificial Sequence: Synthetic oligonucleotide
ccaaagugcugggauuac

SEQ ID NO: 146398 - RNA, 18 nt, Artificial Sequence
  Description of Artificial Sequence: Synthetic oligonucleotide
gccugccaaagugcuggg

SEQ ID NO: 146399 - RNA, 18 nt, Artificial Sequence
  Description of Artificial Sequence: Synthetic oligonucleotide
ccucggccugccaaagug

SEQ ID NO: 146400 - RNA, 18 nt, Artificial Sequence
  Description of Artificial Sequence: Synthetic oligonucleotide
acccgccucggccugcca

SEQ ID NO: 146401 - RNA, 18 nt, Artificial Sequence
  Description of Artificial Sequence: Synthetic oligonucleotide
gauccacccgccucggcc

SEQ ID NO: 146402 - RNA, 18 nt, Artificial Sequence
  Description of Artificial Sequence: Synthetic oligonucleotide
caagugauccacccgccu

SEQ ID NO: 146403 - RNA, 18 nt, Artificial Sequence
  Description of Artificial Sequence: Synthetic oligonucleotide
gaccucaagugauccacc

SEQ ID NO: 146404 - RNA, 18 nt, Artificial Sequence
  Description of Artificial Sequence: Synthetic oligonucleotide
cuccugaccucaagugau

SEQ ID NO: 146405 - RNA, 18 nt, Artificial Sequence
  Description of Artificial Sequence: Synthetic oligonucleotide
ucgaacuccugaccucaa

SEQ ID NO: 146406 - RNA, 18 nt, Artificial Sequence
  Description of Artificial Sequence: Synthetic oligonucleotide
ugguuucgaacuccugac

SEQ ID NO: 146407 - RNA, 18 nt, Artificial Sequence
  Description of Artificial Sequence: Synthetic oligonucleotide
caggcugguuucgaacuc

SEQ ID NO: 146408 - RNA, 18 nt, Artificial Sequence
  Description of Artificial Sequence: Synthetic oligonucleotide
uuggccaggcugguuucg

SEQ ID NO: 146409 - RNA, 18 nt, Artificial Sequence
  Description of Artificial Sequence: Synthetic oligonucleotide
ccauguuggccaggcugg

SEQ ID NO: 146410 - RNA, 18 nt, Artificial Sequence
  Description of Artificial Sequence: Synthetic oligonucleotide
uuucaccauguuggccag

SEQ ID NO: 146411 - RNA, 18 nt, Artificial Sequence
  Description of Artificial Sequence: Synthetic oligonucleotide
ggguuucaccauguuggc

SEQ ID NO: 146412 - RNA, 18 nt, Artificial Sequence
  Description of Artificial Sequence: Synthetic oligonucleotide
auuuuuaguagagacggg

SEQ ID NO: 146413 - RNA, 18 nt, Artificial Sequence
  Description of Artificial Sequence: Synthetic oligonucleotide
uuuguauuuuuaguagag

SEQ ID NO: 146414 - RNA, 18 nt, Artificial Sequence
  Description of Artificial Sequence: Synthetic oligonucleotide
aauuuuuuguauuuuuag

SEQ ID NO: 146415 - RNA, 18 nt, Artificial Sequence
  Description of Artificial Sequence: Synthetic oligonucleotide
uggcuaauuuuuuguauu

SEQ ID NO: 146416 - RNA, 18 nt, Artificial Sequence
  Description of Artificial Sequence: Synthetic oligonucleotide
acaucuggcuaauuuuuu

SEQ ID NO: 146417 - RNA, 18 nt, Artificial Sequence
  Description of Artificial Sequence: Synthetic oligonucleotide
ccaccacaucuggcuaau

SEQ ID NO: 146418 - RNA, 18 nt, Artificial Sequence
  Description of Artificial Sequence: Synthetic oligonucleotide
gcgugccaccacaucugg

SEQ ID NO: 146419 - RNA, 18 nt, Artificial Sequence
  Description of Artificial Sequence: Synthetic oligonucleotide
caggcgcgugccaccaca

SEQ ID NO: 146420 - RNA, 18 nt, Artificial Sequence
  Description of Artificial Sequence: Synthetic oligonucleotide
gauuacaggcgcgugcca

SEQ ID NO: 146421 - RNA, 18 nt, Artificial Sequence
  Description of Artificial Sequence: Synthetic oligonucleotide
gcugggauuacaggcgcg

SEQ ID NO: 146422 - RNA, 18 nt, Artificial Sequence
  Description of Artificial Sequence: Synthetic oligonucleotide
aaguagcugggauuacag

SEQ ID NO: 146423 - RNA, 18 nt, Artificial Sequence
  Description of Artificial Sequence: Synthetic oligonucleotide
cucccaaguagcugggau

SEQ ID NO: 146424 - RNA, 18 nt, Artificial Sequence
  Description of Artificial Sequence: Synthetic oligonucleotide
ucagccucccaaguagcu

SEQ ID NO: 146425 - RNA, 18 nt, Artificial Sequence
  Description of Artificial Sequence: Synthetic oligonucleotide
cuggcucagccucccaag

SEQ ID NO: 146426 - RNA, 18 nt, Artificial Sequence
  Description of Artificial Sequence: Synthetic oligonucleotide
uucuccuggcucagccuc

SEQ ID NO: 146427 - RNA, 18 nt, Artificial Sequence
  Description of Artificial Sequence: Synthetic oligonucleotide
agcgauucuccuggcuca

SEQ ID NO: 146428 - RNA, 18 nt, Artificial Sequence
  Description of Artificial Sequence: Synthetic oligonucleotide
guucaagcgauucuccug

SEQ ID NO: 146429 - RNA, 18 nt, Artificial Sequence
  Description of Artificial Sequence: Synthetic oligonucleotide
cucggguucaagcgauuc

SEQ ID NO: 146430 - RNA, 18 nt, Artificial Sequence
  Description of Artificial Sequence: Synthetic oligonucleotide
caccucucggguucaagc

SEQ ID NO: 146431 - RNA, 18 nt, Artificial Sequence
  Description of Artificial Sequence: Synthetic oligonucleotide
accuccaccucucggguu

SEQ ID NO: 146432 - RNA, 18 nt, Artificial Sequence
  Description of Artificial Sequence: Synthetic oligonucleotide
cugcaaccuccaccucuc

SEQ ID NO: 146433 - RNA, 18 nt, Artificial Sequence
  Description of Artificial Sequence: Synthetic oligonucleotide
gcucacugcaaccuccac

SEQ ID NO: 146434 - RNA, 18 nt, Artificial Sequence
  Description of Artificial Sequence: Synthetic oligonucleotide
uuuuggcucacugcaacc

SEQ ID NO: 146435 - RNA, 18 nt, Artificial Sequence
  Description of Artificial Sequence: Synthetic oligonucleotide
ugggauuuuggcucacug

SEQ ID NO: 146436 - RNA, 18 nt, Artificial Sequence
  Description of Artificial Sequence: Synthetic oligonucleotide
aguggugggauuuuggcu

SEQ ID NO: 146437 - RNA, 18 nt, Artificial Sequence
  Description of Artificial Sequence: Synthetic oligonucleotide
agugcaguggugggauuu

SEQ ID NO: 146438 - RNA, 18 nt, Artificial Sequence
  Description of Artificial Sequence: Synthetic oligonucleotide
gcuggagugcaguggugg

SEQ ID NO: 146439 - RNA, 18 nt, Artificial Sequence
  Description of Artificial Sequence: Synthetic oligonucleotide
cccaggcuggagugcagu

SEQ ID NO: 146440 - RNA, 18 nt, Artificial Sequence
  Description of Artificial Sequence: Synthetic oligonucleotide
ugucacccaggcuggagu

SEQ ID NO: 146441 - RNA, 18 nt, Artificial Sequence
  Description of Artificial Sequence: Synthetic oligonucleotide
cacucugucacccaggcu

SEQ ID NO: 146442 - RNA, 18 nt, Artificial Sequence
  Description of Artificial Sequence: Synthetic oligonucleotide
ggucucacucugucaccc

SEQ ID NO: 146443 - RNA, 18 nt, Artificial Sequence
  Description of Artificial Sequence: Synthetic oligonucleotide
gacagggucucacucugu

SEQ ID NO: 146444 - RNA, 18 nt, Artificial Sequence
  Description of Artificial Sequence: Synthetic oligonucleotide
uuugagacagggucucac

SEQ ID NO: 146445 - RNA, 18 nt, Artificial Sequence
  Description of Artificial Sequence: Synthetic oligonucleotide
uuuuuuuugagacagggu

SEQ ID NO: 146446 - RNA, 18 nt, Artificial Sequence
  Description of Artificial Sequence: Synthetic oligonucleotide
uuuccuuuuuuuugagac

SEQ ID NO: 146447 - RNA, 18 nt, Artificial Sequence
  Description of Artificial Sequence: Synthetic oligonucleotide
guccuuuuccuuuuuuuu

SEQ ID NO: 146448 - RNA, 18 nt, Artificial Sequence
  Description of Artificial Sequence: Synthetic oligonucleotide
uguuaguccuuuuccuuu

SEQ ID NO: 146449 - RNA, 18 nt, Artificial Sequence
  Description of Artificial Sequence: Synthetic oligonucleotide
auuuuuccaccccacauu

SEQ ID NO: 146450 - RNA, 18 nt, Artificial Sequence
  Description of Artificial Sequence: Synthetic oligonucleotide
agacaauuuuuccacccc

SEQ ID NO: 146451 - RNA, 18 nt, Artificial Sequence
  Description of Artificial Sequence: Synthetic oligonucleotide
aaugcagacaauuuuucc

SEQ ID NO: 146452 - RNA, 18 nt, Artificial Sequence
  Description of Artificial Sequence: Synthetic oligonucleotide
gaaaaaaugcagacaauu

SEQ ID NO: 146453 - RNA, 18 nt, Artificial Sequence
  Description of Artificial Sequence: Synthetic oligonucleotide
augcagaaaaaaugcaga

SEQ ID NO: 146454 - RNA, 18 nt, Artificial Sequence
  Description of Artificial Sequence: Synthetic oligonucleotide
uaaaaaugcagaaaaaau

SEQ ID NO: 146455 - RNA, 18 nt, Artificial Sequence
  Description of Artificial Sequence: Synthetic oligonucleotide
aauuuuaaaaaugcagaa

SEQ ID NO: 146456 - RNA, 18 nt, Artificial Sequence
  Description of Artificial Sequence: Synthetic oligonucleotide
guuggaauuuuaaaaaug

SEQ ID NO: 146457 - RNA, 18 nt, Artificial Sequence
  Description of Artificial Sequence: Synthetic oligonucleotide
auuguguuggaauuuuaa

SEQ ID NO: 146458 - RNA, 18 nt, Artificial Sequence
  Description of Artificial Sequence: Synthetic oligonucleotide
uauuuauuguguuggaau

SEQ ID NO: 146459 - RNA, 18 nt, Artificial Sequence
  Description of Artificial Sequence: Synthetic oligonucleotide
uauuguauuuauuguguu

SEQ ID NO: 146460 - RNA, 18 nt, Artificial Sequence
  Description of Artificial Sequence: Synthetic oligonucleotide
guuauuauuguauuuauu

SEQ ID NO: 146461 - RNA, 18 nt, Artificial Sequence
  Description of Artificial Sequence: Synthetic oligonucleotide
gcauaguuauuauuguau

SEQ ID NO: 146462 - RNA, 18 nt, Artificial Sequence
  Description of Artificial Sequence: Synthetic oligonucleotide
aguuagcauaguuauuau

SEQ ID NO: 146463 - RNA, 18 nt, Artificial Sequence
  Description of Artificial Sequence: Synthetic oligonucleotide
cuguuaguuagcauaguu

SEQ ID NO: 146464 - RNA, 18 nt, Artificial Sequence
  Description of Artificial Sequence: Synthetic oligonucleotide
gaccacuguuaguuagca

SEQ ID NO: 146465 - RNA, 18 nt, Artificial Sequence
  Description of Artificial Sequence: Synthetic oligonucleotide
cucuagaccacuguuagu

SEQ ID NO: 146466 - RNA, 18 nt, Artificial Sequence
  Description of Artificial Sequence: Synthetic oligonucleotide
guaagcucuagaccacug

SEQ ID NO: 146467 - RNA, 18 nt, Artificial Sequence
  Description of Artificial Sequence: Synthetic oligonucleotide
augaaguaagcucuagac

SEQ ID NO: 146468 - RNA, 18 nt, Artificial Sequence
  Description of Artificial Sequence: Synthetic oligonucleotide
cuggcaugaaguaagcuc

SEQ ID NO: 146469 - RNA, 18 nt, Artificial Sequence
  Description of Artificial Sequence: Synthetic oligonucleotide
agugccuggcaugaagua

SEQ ID NO: 146470 - RNA, 18 nt, Artificial Sequence
  Description of Artificial Sequence: Synthetic oligonucleotide
agaacagugccuggcaug

SEQ ID NO: 146471 - RNA, 18 nt, Artificial Sequence
  Description of Artificial Sequence: Synthetic oligonucleotide
ugaaaagaacagugccug

SEQ ID NO: 146472 - RNA, 18 nt, Artificial Sequence
  Description of Artificial Sequence: Synthetic oligonucleotide
aucgaugaaaagaacagu

SEQ ID NO: 146473 - RNA, 18 nt, Artificial Sequence
  Description of Artificial Sequence: Synthetic oligonucleotide
ucaucaucgaugaaaaga

SEQ ID NO: 146474 - RNA, 18 nt, Artificial Sequence
  Description of Artificial Sequence: Synthetic oligonucleotide
gugagucaucaucgauga

SEQ ID NO: 146475 - RNA, 18 nt, Artificial Sequence
  Description of Artificial Sequence: Synthetic oligonucleotide
aucaagugagucaucauc

SEQ ID NO: 146476 - RNA, 18 nt, Artificial Sequence
  Description of Artificial Sequence: Synthetic oligonucleotide
ugaggaucaagugaguca

SEQ ID NO: 146477 - RNA, 18 nt, Artificial Sequence
  Description of Artificial Sequence: Synthetic oligonucleotide
uguugugaggaucaagug

SEQ ID NO: 146478 - RNA, 18 nt, Artificial Sequence
  Description of Artificial Sequence: Synthetic oligonucleotide
aggguuguugugaggauc

SEQ ID NO: 146479 - RNA, 18 nt, Artificial Sequence
  Description of Artificial Sequence: Synthetic oligonucleotide
ugcacaggguuguuguga

SEQ ID NO: 146480 - RNA, 18 nt, Artificial Sequence
  Description of Artificial Sequence: Synthetic oligonucleotide
cuuccugcacaggguugu

SEQ ID NO: 146481 - RNA, 18 nt, Artificial Sequence
  Description of Artificial Sequence: Synthetic oligonucleotide
acauucuuccugcacagg

SEQ ID NO: 146482 - RNA, 18 nt, Artificial Sequence
  Description of Artificial Sequence: Synthetic oligonucleotide
acaaaacauucuuccugc

SEQ ID NO: 146483 - RNA, 18 nt, Artificial Sequence
  Description of Artificial Sequence: Synthetic oligonucleotide
gagacacaaaacauucuu

SEQ ID NO: 146484 - RNA, 18 nt, Artificial Sequence
  Description of Artificial Sequence: Synthetic oligonucleotide
aaauggagacacaaaaca

SEQ ID NO: 146485 - RNA, 18 nt, Artificial Sequence
  Description of Artificial Sequence: Synthetic oligonucleotide
guguaaaauggagacaca

SEQ ID NO: 146486 - RNA, 18 nt, Artificial Sequence
  Description of Artificial Sequence: Synthetic oligonucleotide
cugauguguaaaauggag

SEQ ID NO: 146487 - RNA, 18 nt, Artificial Sequence
  Description of Artificial Sequence: Synthetic oligonucleotide
ccucucugauguguaaaa

SEQ ID NO: 146488 - RNA, 18 nt, Artificial Sequence
  Description of Artificial Sequence: Synthetic oligonucleotide
uucagccucucugaugug

SEQ ID NO: 146489 - RNA, 18 nt, Artificial Sequence
  Description of Artificial Sequence: Synthetic oligonucleotide
ggucauucagccucucug

SEQ ID NO: 146490 - RNA, 18 nt, Artificial Sequence
  Description of Artificial Sequence: Synthetic oligonucleotide
aggcaggucauucagccu

SEQ ID NO: 146491 - RNA, 18 nt, Artificial Sequence
  Description of Artificial Sequence: Synthetic oligonucleotide
gcuauaggcaggucauuc

SEQ ID NO: 146492 - RNA, 18 nt, Artificial Sequence
  Description of Artificial Sequence: Synthetic oligonucleotide
gugaggcuauaggcaggu

SEQ ID NO: 146493 - RNA, 18 nt, Artificial Sequence
  Description of Artificial Sequence: Synthetic oligonucleotide
ugccugugaggcuauagg

SEQ ID NO: 146494 - RNA, 18 nt, Artificial Sequence
  Description of Artificial Sequence: Synthetic oligonucleotide
gugucugccugugaggcu

SEQ ID NO: 146495 - RNA, 18 nt, Artificial Sequence
  Description of Artificial Sequence: Synthetic oligonucleotide
auccugugucugccugug

SEQ ID NO: 146496 - RNA, 18 nt, Artificial Sequence
  Description of Artificial Sequence: Synthetic oligonucleotide
uucaaauccugugucugc

SEQ ID NO: 146497 - RNA, 18 nt, Artificial Sequence
  Description of Artificial Sequence: Synthetic oligonucleotide
cuuaauucaaauccugug

SEQ ID NO: 146498 - RNA, 18 nt, Artificial Sequence
  Description of Artificial Sequence: Synthetic oligonucleotide
caaugcuuaauucaaauc

SEQ ID NO: 146499 - RNA, 18 nt, Artificial Sequence
  Description of Artificial Sequence: Synthetic oligonucleotide
agacucaaugcuuaauuc

SEQ ID NO: 146500 - RNA, 18 nt, Artificial Sequence
  Description of Artificial Sequence: Synthetic oligonucleotide
uuaagagacucaaugcuu

SEQ ID NO: 146501 - RNA, 18 nt, Artificial Sequence
  Description of Artificial Sequence: Synthetic oligonucleotide
ugugguuaagagacucaa

SEQ ID NO: 146502 - RNA, 18 nt, Artificial Sequence
  Description of Artificial Sequence: Synthetic oligonucleotide
aguauugugguuaagaga

SEQ ID NO: 146503 - RNA, 18 nt, Artificial Sequence
  Description of Artificial Sequence: Synthetic oligonucleotide
aacguaguauugugguua

SEQ ID NO: 146504 - RNA, 18 nt, Artificial Sequence
  Description of Artificial Sequence: Synthetic oligonucleotide
uaggcaacguaguauugu

SEQ ID NO: 146505 - RNA, 18 nt, Artificial Sequence
  Description of Artificial Sequence: Synthetic oligonucleotide
ccgauuaggcaacguagu

SEQ ID NO: 146506 - RNA, 18 nt, Artificial Sequence
  Description of Artificial Sequence: Synthetic oligonucleotide
cccccccgauuaggcaac

SEQ ID NO: 146507 - RNA, 18 nt, Artificial Sequence
  Description of Artificial Sequence: Synthetic oligonucleotide
caccucccccccgauuag

SEQ ID NO: 146508 - RNA, 18 nt, Artificial Sequence
  Description of Artificial Sequence: Synthetic oligonucleotide
guccccaccucccccccg

SEQ ID NO: 146509 - RNA, 18 nt, Artificial Sequence
  Description of Artificial Sequence: Synthetic oligonucleotide
aauuuguccccaccuccc

SEQ ID NO: 146510 - RNA, 18 nt, Artificial Sequence
  Description of Artificial Sequence: Synthetic oligonucleotide
uugccaauuuguccccac

SEQ ID NO: 146511 - RNA, 18 nt, Artificial Sequence
  Description of Artificial Sequence: Synthetic oligonucleotide
guuuuuugccaauuuguc

SEQ ID NO: 146512 - RNA, 18 nt, Artificial Sequence
  Description of Artificial Sequence: Synthetic oligonucleotide
cuuuuguuuuuugccaau

SEQ ID NO: 146513 - RNA, 18 nt, Artificial Sequence
  Description of Artificial Sequence: Synthetic oligonucleotide
cacuucuuuuguuuuuug

SEQ ID NO: 146514 - RNA, 18 nt, Artificial Sequence
  Description of Artificial Sequence: Synthetic oligonucleotide
uaauccacuucuuuuguu

SEQ ID NO: 146515 - RNA, 18 nt, Artificial Sequence
  Description of Artificial Sequence: Synthetic oligonucleotide
ggucuuaauccacuucuu

SEQ ID NO: 146516 - RNA, 18 nt, Artificial Sequence
  Description of Artificial Sequence: Synthetic oligonucleotide
ccccuggucuuaauccac

SEQ ID NO: 146517 - RNA, 18 nt, Artificial Sequence
  Description of Artificial Sequence: Synthetic oligonucleotide
cccuaccccuggucuuaa

SEQ ID NO: 146518 - RNA, 18 nt, Artificial Sequence
  Description of Artificial Sequence: Synthetic oligonucleotide
aaucucccuaccccuggu

SEQ ID NO: 146519 - RNA, 18 nt, Artificial Sequence
  Description of Artificial Sequence: Synthetic oligonucleotide
guucuaaucucccuaccc

SEQ ID NO: 146520 - RNA, 18 nt, Artificial Sequence
  Description of Artificial Sequence: Synthetic oligonucleotide
uggguguucuaaucuccc

SEQ ID NO: 146521 - RNA, 18 nt, Artificial Sequence
  Description of Artificial Sequence: Synthetic oligonucleotide
uccacuggguguucuaau

SEQ ID NO: 146522 - RNA, 18 nt, Artificial Sequence
  Description of Artificial Sequence: Synthetic oligonucleotide
aaugcuccacuggguguu

SEQ ID NO: 146523 - RNA, 18 nt, Artificial Sequence
  Description of Artificial Sequence: Synthetic oligonucleotide
ucagcaaugcuccacugg

SEQ ID NO: 146524 - RNA, 18 nt, Artificial Sequence
  Description of Artificial Sequence: Synthetic oligonucleotide
ucccaucagcaaugcucc

SEQ ID NO: 146525 - RNA, 18 nt, Artificial Sequence
  Description of Artificial Sequence: Synthetic oligonucleotide
cccugucccaucagcaau

SEQ ID NO: 146526 - RNA, 18 nt, Artificial Sequence
  Description of Artificial Sequence: Synthetic oligonucleotide
ccaagcccugucccauca

SEQ ID NO: 146527 - RNA, 18 nt, Artificial Sequence
  Description of Artificial Sequence: Synthetic oligonucleotide
acagaccaagcccugucc

SEQ ID NO: 146528 - RNA, 18 nt, Artificial Sequence
  Description of Artificial Sequence: Synthetic oligonucleotide
ccgugacagaccaagccc

SEQ ID NO: 146529 - RNA, 18 nt, Artificial Sequence
  Description of Artificial Sequence: Synthetic oligonucleotide
cuuggccgugacagacca

SEQ ID NO: 146530 - RNA, 18 nt, Artificial Sequence
  Description of Artificial Sequence: Synthetic oligonucleotide
gccuccuuggccgugaca

SEQ ID NO: 146531 - RNA, 18 nt, Artificial Sequence
  Description of Artificial Sequence: Synthetic oligonucleotide
ggcaggccuccuuggccg

SEQ ID NO: 146532 - RNA, 18 nt, Artificial Sequence
  Description of Artificial Sequence: Synthetic oligonucleotide
gggacggcaggccuccuu

SEQ ID NO: 146533 - RNA, 18 nt, Artificial Sequence
  Description of Artificial Sequence: Synthetic oligonucleotide
aggugacuuggcccaggg

SEQ ID NO: 146534 - RNA, 18 nt, Artificial Sequence
  Description of Artificial Sequence: Synthetic oligonucleotide
agaggugacuuggcccag

SEQ ID NO: 146535 - RNA, 18 nt, Artificial Sequence
  Description of Artificial Sequence: Synthetic oligonucleotide
ccccaagaggugacuugg

SEQ ID NO: 146536 - RNA, 18 nt, Artificial Sequence
  Description of Artificial Sequence: Synthetic oligonucleotide
uuccaccccaagagguga

SEQ ID NO: 146537 - RNA, 18 nt, Artificial Sequence
  Description of Artificial Sequence: Synthetic oligonucleotide
ccuacuuccaccccaaga

SEQ ID NO: 146538 - RNA, 18 nt, Artificial Sequence
  Description of Artificial Sequence: Synthetic oligonucleotide
gcuccccuacuuccaccc

SEQ ID NO: 146539 - RNA, 18 nt, Artificial Sequence
  Description of Artificial Sequence: Synthetic oligonucleotide
guggagcuccccuacuuc

SEQ ID NO: 146540 - RNA, 18 nt, Artificial Sequence
  Description of Artificial Sequence: Synthetic oligonucleotide
aggcaguggagcuccccu

SEQ ID NO: 146541 - RNA, 18 nt, Artificial Sequence
  Description of Artificial Sequence: Synthetic oligonucleotide
cagaaaggcaguggagcu

SEQ ID NO: 146542 - RNA, 18 nt, Artificial Sequence
  Description of Artificial Sequence: Synthetic oligonucleotide
gagcucagaaaggcagug

SEQ ID NO: 146543 - RNA, 18 nt, Artificial Sequence
  Description of Artificial Sequence: Synthetic oligonucleotide
ccagggagcucagaaagg

SEQ ID NO: 146544 - RNA, 18 nt, Artificial Sequence
  Description of Artificial Sequence: Synthetic oligonucleotide
gcacgccagggagcucag

SEQ ID NO: 146545 - RNA, 18 nt, Artificial Sequence
  Description of Artificial Sequence: Synthetic oligonucleotide
uucaugaggccuggccgg

SEQ ID NO: 146546 - RNA, 18 nt, Artificial Sequence
  Description of Artificial Sequence: Synthetic oligonucleotide
gaacguucaugaggccug

SEQ ID NO: 146547 - RNA, 18 nt, Artificial Sequence
  Description of Artificial Sequence: Synthetic oligonucleotide
ccguggaacguucaugag

SEQ ID NO: 146548 - RNA, 18 nt, Artificial Sequence
  Description of Artificial Sequence: Synthetic oligonucleotide
uccacccguggaacguuc

SEQ ID NO: 146549 - RNA, 18 nt, Artificial Sequence
  Description of Artificial Sequence: Synthetic oligonucleotide
uagccuccacccguggaa

SEQ ID NO: 146550 - RNA, 18 nt, Artificial Sequence
  Description of Artificial Sequence: Synthetic oligonucleotide
cuggauagccuccacccg

SEQ ID NO: 146551 - RNA, 18 nt, Artificial Sequence
  Description of Artificial Sequence: Synthetic oligonucleotide
guguccuggauagccucc

SEQ ID NO: 146552 - RNA, 18 nt, Artificial Sequence
  Description of Artificial Sequence: Synthetic oligonucleotide
ggaugguguccuggauag

SEQ ID NO: 146553 - RNA, 18 nt, Artificial Sequence
  Description of Artificial Sequence: Synthetic oligonucleotide
acgcaggaugguguccug

SEQ ID NO: 146554 - RNA, 18 nt, Artificial Sequence
  Description of Artificial Sequence: Synthetic oligonucleotide
agggcacgcaggauggug

SEQ ID NO: 146555 - RNA, 18 nt, Artificial Sequence
  Description of Artificial Sequence: Synthetic oligonucleotide
auucgagggcacgcagga

SEQ ID NO: 146556 - RNA, 18 nt, Artificial Sequence
  Description of Artificial Sequence: Synthetic oligonucleotide
guggaauucgagggcacg

SEQ ID NO: 146557 - RNA, 18 nt, Artificial Sequence
  Description of Artificial Sequence: Synthetic oligonucleotide
ugcagguggaauucgagg

SEQ ID NO: 146558 - RNA, 18 nt, Artificial Sequence
  Description of Artificial Sequence: Synthetic oligonucleotide
uggccugcagguggaauu

SEQ ID NO: 146559 - RNA, 18 nt, Artificial Sequence
  Description of Artificial Sequence: Synthetic oligonucleotide
gugguuggccugcaggug

SEQ ID NO: 146560 - RNA, 18 nt, Artificial Sequence
  Description of Artificial Sequence: Synthetic oligonucleotide
ucagggugguuggccugc

SEQ ID NO: 146561 - RNA, 18 nt, Artificial Sequence
  Description of Artificial Sequence: Synthetic oligonucleotide
gggcaucagggugguugg

SEQ ID NO: 146562 - RNA, 18 nt, Artificial Sequence
  Description of Artificial Sequence: Synthetic oligonucleotide
guacugggcaucagggug

SEQ ID NO: 146563 - RNA, 18 nt, Artificial Sequence
  Description of Artificial Sequence: Synthetic oligonucleotide
aagagguacugggcauca

SEQ ID NO: 146564 - RNA, 18 nt, Artificial Sequence
  Description of Artificial Sequence: Synthetic oligonucleotide
gggaagagguacugggca

SEQ ID NO: 146565 - RNA, 18 nt, Artificial Sequence
  Description of Artificial Sequence: Synthetic oligonucleotide
cuucugcagcagcuuggg

SEQ ID NO: 146566 - RNA, 18 nt, Artificial Sequence
  Description of Artificial Sequence: Synthetic oligonucleotide
gccaucuucugcagcagc

SEQ ID NO: 146567 - RNA, 18 nt, Artificial Sequence
  Description of Artificial Sequence: Synthetic oligonucleotide
ggucagccaucuucugca

SEQ ID NO: 146568 - RNA, 18 nt, Artificial Sequence
  Description of Artificial Sequence: Synthetic oligonucleotide
ccgcaggucagccaucuu

SEQ ID NO: 146569 - RNA, 18 nt, Artificial Sequence
  Description of Artificial Sequence: Synthetic oligonucleotide
aguugccgcaggucagcc

SEQ ID NO: 146570 - RNA, 18 nt, Artificial Sequence
  Description of Artificial Sequence: Synthetic oligonucleotide
ugaccaguugccgcaggu

SEQ ID NO: 146571 - RNA, 18 nt, Artificial Sequence
  Description of Artificial Sequence: Synthetic oligonucleotide
cucggugaccaguugccg

SEQ ID NO: 146572 - RNA, 18 nt, Artificial Sequence
  Description of Artificial Sequence: Synthetic oligonucleotide
gcgugcucggugaccagu

SEQ ID NO: 146573 - RNA, 18 nt, Artificial Sequence
  Description of Artificial Sequence: Synthetic oligonucleotide
ucugggcgugcucgguga

SEQ ID NO: 146574 - RNA, 18 nt, Artificial Sequence
  Description of Artificial Sequence: Synthetic oligonucleotide
caucaucugggcgugcuc

SEQ ID NO: 146575 - RNA, 18 nt, Artificial Sequence
  Description of Artificial Sequence: Synthetic oligonucleotide
cgcugcaucaucugggcg

SEQ ID NO: 146576 - RNA, 18 nt, Artificial Sequence
  Description of Artificial Sequence: Synthetic oligonucleotide
ugauccgcugcaucaucu

SEQ ID NO: 146577 - RNA, 18 nt, Artificial Sequence
  Description of Artificial Sequence: Synthetic oligonucleotide
cuucuugauccgcugcau

SEQ ID NO: 146578 - RNA, 18 nt, Artificial Sequence
  Description of Artificial Sequence: Synthetic oligonucleotide
ucggucuucuugauccgc

SEQ ID NO: 146579 - RNA, 18 nt, Artificial Sequence
  Description of Artificial Sequence: Synthetic oligonucleotide
cgguuucggucuucuuga

SEQ ID NO: 146580 - RNA, 18 nt, Artificial Sequence
  Description of Artificial Sequence: Synthetic oligonucleotide
ggucucgguuucggucuu

SEQ ID NO: 146581 - RNA, 18 nt, Artificial Sequence
  Description of Artificial Sequence: Synthetic oligonucleotide
agcgaggucucgguuucg

SEQ ID NO: 146582 - RNA, 18 nt, Artificial Sequence
  Description of Artificial Sequence: Synthetic oligonucleotide
ggugcagcgaggucucgg

SEQ ID NO: 146583 - RNA, 18 nt, Artificial Sequence
  Description of Artificial Sequence: Synthetic oligonucleotide
cagagggugcagcgaggu

SEQ ID NO: 146584 - RNA, 18 nt, Artificial Sequence
  Description of Artificial Sequence: Synthetic oligonucleotide
uggagcagagggugcagc

SEQ ID NO: 146585 - RNA, 18 nt, Artificial Sequence
  Description of Artificial Sequence: Synthetic oligonucleotide
ucuccuggagcagagggu

SEQ ID NO: 146586 - RNA, 18 nt, Artificial Sequence
  Description of Artificial Sequence: Synthetic oligonucleotide
guagaucuccuggagcag

SEQ ID NO: 146587 - RNA, 18 nt, Artificial Sequence
  Description of Artificial Sequence: Synthetic oligonucleotide
uccuuguagaucuccugg

SEQ ID NO: 146588 - RNA, 18 nt, Artificial Sequence
  Description of Artificial Sequence: Synthetic oligonucleotide
acauguccuuguagaucu

SEQ ID NO: 146589 - RNA, 18 nt, Artificial Sequence
  Description of Artificial Sequence: Synthetic oligonucleotide
uuaguacauguccuugua

SEQ ID NO: 146590 - RNA, 18 nt, Artificial Sequence
  Description of Artificial Sequence: Synthetic oligonucleotide
cgccguuaguacaugucc

SEQ ID NO: 146591 - RNA, 18 nt, Artificial Sequence
  Description of Artificial Sequence: Synthetic oligonucleotide
ggugccgccguuaguaca

SEQ ID NO: 146592 - RNA, 18 nt, Artificial Sequence
  Description of Artificial Sequence: Synthetic oligonucleotide
gccugggugccgccguua

SEQ ID NO: 146593 - RNA, 18 nt, Artificial Sequence
  Description of Artificial Sequence: Synthetic oligonucleotide
gggaggccugggugccgc

SEQ ID NO: 146594 - RNA, 18 nt, Artificial Sequence
  Description of Artificial Sequence: Synthetic oligonucleotide
cugcagggaggccugggu

SEQ ID NO: 146595 - RNA, 18 nt, Artificial Sequence
  Description of Artificial Sequence: Synthetic oligonucleotide
ggagucugcagggaggcc

SEQ ID NO: 146596 - RNA, 18 nt, Artificial Sequence
  Description of Artificial Sequence: Synthetic oligonucleotide
ccauuggagucugcaggg

SEQ ID NO: 146597 - RNA, 18 nt, Artificial Sequence
  Description of Artificial Sequence: Synthetic oligonucleotide
uggccccauuggagucug

SEQ ID NO: 146598 - RNA, 18 nt, Artificial Sequence
  Description of Artificial Sequence: Synthetic oligonucleotide
agugcuggccccauugga

SEQ ID NO: 146599 - RNA, 18 nt, Artificial Sequence
  Description of Artificial Sequence: Synthetic oligonucleotide
ccuccagugcuggcccca

SEQ ID NO: 146600 - RNA, 18 nt, Artificial Sequence
  Description of Artificial Sequence: Synthetic oligonucleotide
gggccccuccagugcugg

SEQ ID NO: 146601 - RNA, 18 nt, Artificial Sequence
  Description of Artificial Sequence: Synthetic oligonucleotide
ugggugggccccuccagu

SEQ ID NO: 146602 - RNA, 18 nt, Artificial Sequence
  Description of Artificial Sequence: Synthetic oligonucleotide
ucaugugggugggccccu

SEQ ID NO: 146603 - RNA, 18 nt, Artificial Sequence
  Description of Artificial Sequence: Synthetic oligonucleotide
aaaagucauguggguggg

SEQ ID NO: 146604 - RNA, 18 nt, Artificial Sequence
  Description of Artificial Sequence: Synthetic oligonucleotide
aauggaaaagucaugugg

SEQ ID NO: 146605 - RNA, 18 nt, Artificial Sequence
  Description of Artificial Sequence: Synthetic oligonucleotide
uggucaauggaaaaguca

SEQ ID NO: 146606 - RNA, 18 nt, Artificial Sequence
  Description of Artificial Sequence: Synthetic oligonucleotide
agggcuggucaauggaaa

SEQ ID NO: 146607 - RNA, 18 nt, Artificial Sequence
  Description of Artificial Sequence: Synthetic oligonucleotide
gcucaagggcuggucaau

SEQ ID NO: 146608 - RNA, 18 nt, Artificial Sequence
  Description of Artificial Sequence: Synthetic oligonucleotide
cgggugcucaagggcugg

SEQ ID NO: 146609 - RNA, 18 nt, Artificial Sequence
  Description of Artificial Sequence: Synthetic oligonucleotide
caggccgggugcucaagg

SEQ ID NO: 146610 - RNA, 18 nt, Artificial Sequence
  Description of Artificial Sequence: Synthetic oligonucleotide
ugcuccaggccgggugcu

SEQ ID NO: 146611 - RNA, 18 nt, Artificial Sequence
  Description of Artificial Sequence: Synthetic oligonucleotide
ucugcugcuccaggccgg

SEQ ID NO: 146612 - RNA, 18 nt, Artificial Sequence
  Description of Artificial Sequence: Synthetic oligonucleotide
gggacucugcugcuccag

SEQ ID NO: 146613 - RNA, 18 nt, Artificial Sequence
  Description of Artificial Sequence: Synthetic oligonucleotide
aucgugggacucugcugc

SEQ ID NO: 146614 - RNA, 18 nt, Artificial Sequence
  Description of Artificial Sequence: Synthetic oligonucleotide
gggcgaucgugggacucu

SEQ ID NO: 146615 - RNA, 18 nt, Artificial Sequence
  Description of Artificial Sequence: Synthetic oligonucleotide
ucugagggcgaucguggg

SEQ ID NO: 146616 - RNA, 18 nt, Artificial Sequence
  Description of Artificial Sequence: Synthetic oligonucleotide
augugucugagggcgauc

SEQ ID NO: 146617 - RNA, 18 nt, Artificial Sequence
  Description of Artificial Sequence: Synthetic oligonucleotide
gugucaugugucugaggg

SEQ ID NO: 146618 - RNA, 18 nt, Artificial Sequence
  Description of Artificial Sequence: Synthetic oligonucleotide
cgugggugucaugugucu

SEQ ID NO: 146619 - RNA, 18 nt, Artificial Sequence
  Description of Artificial Sequence: Synthetic oligonucleotide
gaggccgugggugucaug

SEQ ID NO: 146620 - RNA, 18 nt, Artificial Sequence
  Description of Artificial Sequence: Synthetic oligonucleotide
agccagaggccgugggug

SEQ ID NO: 146621 - RNA, 18 nt, Artificial Sequence
  Description of Artificial Sequence: Synthetic oligonucleotide
cagggagccagaggccgu

SEQ ID NO: 146622 - RNA, 18 nt, Artificial Sequence
  Description of Artificial Sequence: Synthetic oligonucleotide
gggcacagggagccagag

SEQ ID NO: 146623 - RNA, 18 nt, Artificial Sequence
  Description of Artificial Sequence: Synthetic oligonucleotide
agagagggcacagggagc

SEQ ID NO: 146624 - RNA, 18 nt, Artificial Sequence
  Description of Artificial Sequence: Synthetic oligonucleotide
gcgggagagagggcacag

SEQ ID NO: 146625 - RNA, 18 nt, Artificial Sequence
  Description of Artificial Sequence: Synthetic oligonucleotide
aggaagcgggagagaggg

SEQ ID NO: 146626 - RNA, 18 nt, Artificial Sequence
  Description of Artificial Sequence: Synthetic oligonucleotide
gcuggaggaagcgggaga

SEQ ID NO: 146627 - RNA, 18 nt, Artificial Sequence
  Description of Artificial Sequence: Synthetic oligonucleotide
agcuggcuggaggaagcg

SEQ ID NO: 146628 - RNA, 18 nt, Artificial Sequence
  Description of Artificial Sequence: Synthetic oligonucleotide
aagagagcuggcuggagg

SEQ ID NO: 146629 - RNA, 18 nt, Artificial Sequence
  Description of Artificial Sequence: Synthetic oligonucleotide
acaggaagagagcuggcu

SEQ ID NO: 146630 - RNA, 18 nt, Artificial Sequence
  Description of Artificial Sequence: Synthetic oligonucleotide
caaagacaggaagagagc

SEQ ID NO: 146631 - RNA, 18 nt, Artificial Sequence
  Description of Artificial Sequence: Synthetic oligonucleotide
gacaacaaagacaggaag

SEQ ID NO: 146632 - RNA, 18 nt, Artificial Sequence
  Description of Artificial Sequence: Synthetic oligonucleotide
agggagacaacaaagaca

SEQ ID NO: 146633 - RNA, 18 nt, Artificial Sequence
  Description of Artificial Sequence: Synthetic oligonucleotide
gaaagagggagacaacaa

SEQ ID NO: 146634 - RNA, 18 nt, Artificial Sequence
  Description of Artificial Sequence: Synthetic oligonucleotide
acugagaaagagggagac

SEQ ID NO: 146635 - RNA, 18 nt, Artificial Sequence
  Description of Artificial Sequence: Synthetic oligonucleotide
gaggaacugagaaagagg

SEQ ID NO: 146636 - RNA, 18 nt, Artificial Sequence
  Description of Artificial Sequence: Synthetic oligonucleotide
agaaagaggaacugagaa

SEQ ID NO: 146637 - RNA, 18 nt, Artificial Sequence
  Description of Artificial Sequence: Synthetic oligonucleotide
agaaaagaaagaggaacu

SEQ ID NO: 146638 - RNA, 18 nt, Artificial Sequence
  Description of Artificial Sequence: Synthetic oligonucleotide
gaauuagaaaagaaagag

SEQ ID NO: 146639 - RNA, 18 nt, Artificial Sequence
  Description of Artificial Sequence: Synthetic oligonucleotide
aacaggaauuagaaaaga

SEQ ID NO: 146640 - RNA, 18 nt, Artificial Sequence
  Description of Artificial Sequence: Synthetic oligonucleotide
agagcaacaggaauuaga

SEQ ID NO: 146641 - RNA, 18 nt, Artificial Sequence
  Description of Artificial Sequence: Synthetic oligonucleotide
gaaacagagcaacaggaa

SEQ ID NO: 146642 - RNA, 18 nt, Artificial Sequence
  Description of Artificial Sequence: Synthetic oligonucleotide
aggaagaaacagagcaac

SEQ ID NO: 146643 - RNA, 18 nt, Artificial Sequence
  Description of Artificial Sequence: Synthetic oligonucleotide
cagaaaggaagaaacaga

SEQ ID NO: 146644 - RNA, 18 nt, Artificial Sequence
  Description of Artificial Sequence: Synthetic oligonucleotide
accuacagaaaggaagaa

SEQ ID NO: 146645 - RNA, 18 nt, Artificial Sequence
  Description of Artificial Sequence: Synthetic oligonucleotide
gagaaaccuacagaaagg

SEQ ID NO: 146646 - RNA, 18 nt, Artificial Sequence
  Description of Artificial Sequence: Synthetic oligonucleotide
gaagagagaaaccuacag

SEQ ID NO: 146647 - RNA, 18 nt, Artificial Sequence
  Description of Artificial Sequence: Synthetic oligonucleotide
gaagggaagagagaaacc

SEQ ID NO: 146648 - RNA, 18 nt, Artificial Sequence
  Description of Artificial Sequence: Synthetic oligonucleotide
agggagaagggaagagag

SEQ ID NO: 146649 - RNA, 18 nt, Artificial Sequence
  Description of Artificial Sequence: Synthetic oligonucleotide
gggcaagggagaagggaa

SEQ ID NO: 146650 - RNA, 18 nt, Artificial Sequence
  Description of Artificial Sequence: Synthetic oligonucleotide
agggagggcaagggagaa

SEQ ID NO: 146651 - RNA, 18 nt, Artificial Sequence
  Description of Artificial Sequence: Synthetic oligonucleotide
gagaaagggagggcaagg

SEQ ID NO: 146652 - RNA, 18 nt, Artificial Sequence
  Description of Artificial Sequence: Synthetic oligonucleotide
ggagagagaaagggaggg

SEQ ID NO: 146653 - RNA, 18 nt, Artificial Sequence
  Description of Artificial Sequence: Synthetic oligonucleotide
ggguggagagagaaaggg

SEQ ID NO: 146654 - RNA, 18 nt, Artificial Sequence
  Description of Artificial Sequence: Synthetic oligonucleotide
aaggaggacagacguggg

SEQ ID NO: 146655 - RNA, 18 nt, Artificial Sequence
  Description of Artificial Sequence: Synthetic oligonucleotide
uaagaaaggaggacagac

SEQ ID NO: 146656 - RNA, 18 nt, Artificial Sequence
  Description of Artificial Sequence: Synthetic oligonucleotide
cagaauaagaaaggagga

SEQ ID NO: 146657 - RNA, 18 nt, Artificial Sequence
  Description of Artificial Sequence: Synthetic oligonucleotide
ucucacagaauaagaaag

SEQ ID NO: 146658 - RNA, 18 nt, Artificial Sequence
  Description of Artificial Sequence: Synthetic oligonucleotide
aaacaucucacagaauaa

SEQ ID NO: 146659 - RNA, 18 nt, Artificial Sequence
  Description of Artificial Sequence: Synthetic oligonucleotide
auacaaaacaucucacag

SEQ ID NO: 146660 - RNA, 18 nt, Artificial Sequence
  Description of Artificial Sequence: Synthetic oligonucleotide
aaauaauacaaaacaucu

SEQ ID NO: 146661 - RNA, 18 nt, Artificial Sequence
  Description of Artificial Sequence: Synthetic oligonucleotide
uggugaaauaauacaaaa

SEQ ID NO: 146662 - RNA, 18 nt, Artificial Sequence
  Description of Artificial Sequence: Synthetic oligonucleotide
gcugcuggugaaauaaua

SEQ ID NO: 146663 - RNA, 18 nt, Artificial Sequence
  Description of Artificial Sequence: Synthetic oligonucleotide
ucuaugcugcuggugaaa

SEQ ID NO: 146664 - RNA, 18 nt, Artificial Sequence
  Description of Artificial Sequence: Synthetic oligonucleotide
ccuguucuaugcugcugg

SEQ ID NO: 146665 - RNA, 18 nt, Artificial Sequence
  Description of Artificial Sequence: Synthetic oligonucleotide
gagguccuguucuaugcu

SEQ ID NO: 146666 - RNA, 18 nt, Artificial Sequence
  Description of Artificial Sequence: Synthetic oligonucleotide
aagcagagguccuguucu

SEQ ID NO: 146667 - RNA, 18 nt, Artificial Sequence
  Description of Artificial Sequence: Synthetic oligonucleotide
ugcaaaagcagagguccu

SEQ ID NO: 146668 - RNA, 18 nt, Artificial Sequence
  Description of Artificial Sequence: Synthetic oligonucleotide
aggugugcaaaagcagag

SEQ ID NO: 146669 - RNA, 18 nt, Artificial Sequence
  Description of Artificial Sequence: Synthetic oligonucleotide
ggaaaaggugugcaaaag

SEQ ID NO: 146670 - RNA, 18 nt, Artificial Sequence
  Description of Artificial Sequence: Synthetic oligonucleotide
gggaaaaggugugcaaaa

SEQ ID NO: 146671 - RNA, 18 nt, Artificial Sequence
  Description of Artificial Sequence: Synthetic oligonucleotide
cucucuucugcuccuggg

SEQ ID NO: 146672 - RNA, 18 nt, Artificial Sequence
  Description of Artificial Sequence: Synthetic oligonucleotide
ccccacucucuucugcuc

SEQ ID NO: 146673 - RNA, 18 nt, Artificial Sequence
  Description of Artificial Sequence: Synthetic oligonucleotide
gcaggccccacucucuuc

SEQ ID NO: 146674 - RNA, 18 nt, Artificial Sequence
  Description of Artificial Sequence: Synthetic oligonucleotide
agagggcaggccccacuc

SEQ ID NO: 146675 - RNA, 18 nt, Artificial Sequence
  Description of Artificial Sequence: Synthetic oligonucleotide
gggcagagggcaggcccc

SEQ ID NO: 146676 - RNA, 18 nt, Artificial Sequence
  Description of Artificial Sequence: Synthetic oligonucleotide
ugcaggugcaaugauggg

SEQ ID NO: 146677 - RNA, 18 nt, Artificial Sequence
  Description of Artificial Sequence: Synthetic oligonucleotide
aagccugcaggugcaaug

SEQ ID NO: 146678 - RNA, 18 nt, Artificial Sequence
  Description of Artificial Sequence: Synthetic oligonucleotide
gaccuaagccugcaggug

SEQ ID NO: 146679 - RNA, 18 nt, Artificial Sequence
  Description of Artificial Sequence: Synthetic oligonucleotide
gugaggaccuaagccugc

SEQ ID NO: 146680 - RNA, 18 nt, Artificial Sequence
  Description of Artificial Sequence: Synthetic oligonucleotide
cagaagugaggaccuaag

SEQ ID NO: 146681 - RNA, 18 nt, Artificial Sequence
  Description of Artificial Sequence: Synthetic oligonucleotide
ggagacagaagugaggac

SEQ ID NO: 146682 - RNA, 18 nt, Artificial Sequence
  Description of Artificial Sequence: Synthetic oligonucleotide
agacaggagacagaagug

SEQ ID NO: 146683 - RNA, 18 nt, Artificial Sequence
  Description of Artificial Sequence: Synthetic oligonucleotide
ucugaagacaggagacag

SEQ ID NO: 146684 - RNA, 18 nt, Artificial Sequence
  Description of Artificial Sequence: Synthetic oligonucleotide
uuugcucugaagacagga

SEQ ID NO: 146685 - RNA, 18 nt, Artificial Sequence
  Description of Artificial Sequence: Synthetic oligonucleotide
agucuuuugcucugaaga

SEQ ID NO: 146686 - RNA, 18 nt, Artificial Sequence
  Description of Artificial Sequence: Synthetic oligonucleotide
gcucaagucuuuugcucu

SEQ ID NO: 146687 - RNA, 18 nt, Artificial Sequence
  Description of Artificial Sequence: Synthetic oligonucleotide
ggauggcucaagucuuuu

SEQ ID NO: 146688 - RNA, 18 nt, Artificial Sequence
  Description of Artificial Sequence: Synthetic oligonucleotide
ucuuuggauggcucaagu

SEQ ID NO: 146689 - RNA, 18 nt, Artificial Sequence
  Description of Artificial Sequence: Synthetic oligonucleotide
guguuucuuuggauggcu

SEQ ID NO: 146690 - RNA, 18 nt, Artificial Sequence
  Description of Artificial Sequence: Synthetic oligonucleotide
gcuuaguguuucuuugga

SEQ ID NO: 146691 - RNA, 18 nt, Artificial Sequence
  Description of Artificial Sequence: Synthetic oligonucleotide
agagagcuuaguguuucu

SEQ ID NO: 146692 - RNA, 18 nt, Artificial Sequence
  Description of Artificial Sequence: Synthetic oligonucleotide
ggcccagagagcuuagug

SEQ ID NO: 146693 - RNA, 18 nt, Artificial Sequence
  Description of Artificial Sequence: Synthetic oligonucleotide
acccaggcccagagagcu

SEQ ID NO: 146694 - RNA, 18 nt, Artificial Sequence
  Description of Artificial Sequence: Synthetic oligonucleotide
cuggaacccaggcccaga

SEQ ID NO: 146695 - RNA, 18 nt, Artificial Sequence
  Description of Artificial Sequence: Synthetic oligonucleotide
cuucccuggaacccaggc

SEQ ID NO: 146696 - RNA, 18 nt, Artificial Sequence
  Description of Artificial Sequence: Synthetic oligonucleotide
uuagccuucccuggaacc

SEQ ID NO: 146697 - RNA, 18 nt, Artificial Sequence
  Description of Artificial Sequence: Synthetic oligonucleotide
caugcuuagccuucccug

SEQ ID NO: 146698 - RNA, 18 nt, Artificial Sequence
  Description of Artificial Sequence: Synthetic oligonucleotide
caggccaugcuuagccuu

SEQ ID NO: 146699 - RNA, 18 nt, Artificial Sequence
  Description of Artificial Sequence: Synthetic oligonucleotide
caguccaggccaugcuua

SEQ ID NO: 146700 - RNA, 18 nt, Artificial Sequence
  Description of Artificial Sequence: Synthetic oligonucleotide
gcagucaguccaggccau

SEQ ID NO: 146701 - RNA, 18 nt, Artificial Sequence
  Description of Artificial Sequence: Synthetic oligonucleotide
gggcugcagucaguccag

SEQ ID NO: 146702 - RNA, 18 nt, Artificial Sequence
  Description of Artificial Sequence: Synthetic oligonucleotide
agggaccccaugacuaua

SEQ ID NO: 146703 - RNA, 18 nt, Artificial Sequence
  Description of Artificial Sequence: Synthetic oligonucleotide
gcagcagggaccccauga

SEQ ID NO: 146704 - RNA, 18 nt, Artificial Sequence
  Description of Artificial Sequence: Synthetic oligonucleotide
ccuuugcagcagggaccc

SEQ ID NO: 146705 - RNA, 18 nt, Artificial Sequence
  Description of Artificial Sequence: Synthetic oligonucleotide
acuguccuuugcagcagg

SEQ ID NO: 146706 - RNA, 18 nt, Artificial Sequence
  Description of Artificial Sequence: Synthetic oligonucleotide
ugcccacuguccuuugca

SEQ ID NO: 146707 - RNA, 18 nt, Artificial Sequence
  Description of Artificial Sequence: Synthetic oligonucleotide
ccuccugcccacuguccu

SEQ ID NO: 146708 - RNA, 18 nt, Artificial Sequence
  Description of Artificial Sequence: Synthetic oligonucleotide
gggccuccugcccacugu

SEQ ID NO: 146709 - RNA, 18 nt, Artificial Sequence
  Description of Artificial Sequence: Synthetic oligonucleotide
ucuggcucucagccuggg

SEQ ID NO: 146710 - RNA, 18 nt, Artificial Sequence
  Description of Artificial Sequence: Synthetic oligonucleotide
aggcaucuggcucucagc

SEQ ID NO: 146711 - RNA, 18 nt, Artificial Sequence
  Description of Artificial Sequence: Synthetic oligonucleotide
gggaggcaucuggcucuc

SEQ ID NO: 146712 - RNA, 18 nt, Artificial Sequence
  Description of Artificial Sequence: Synthetic oligonucleotide
ggcaaugacagucuuggg

SEQ ID NO: 146713 - RNA, 18 nt, Artificial Sequence
  Description of Artificial Sequence: Synthetic oligonucleotide
gggcaaugacagucuugg

SEQ ID NO: 146714 - RNA, 18 nt, Artificial Sequence
  Description of Artificial Sequence: Synthetic oligonucleotide
ggccucagcaucggaggg

SEQ ID NO: 146715 - RNA, 18 nt, Artificial Sequence
  Description of Artificial Sequence: Synthetic oligonucleotide
uggguggccucagcaucg

SEQ ID NO: 146716 - RNA, 18 nt, Artificial Sequence
  Description of Artificial Sequence: Synthetic oligonucleotide
gucaguggguggccucag

SEQ ID NO: 146717 - RNA, 18 nt, Artificial Sequence
  Description of Artificial Sequence: Synthetic oligonucleotide
guugggucaguggguggc

SEQ ID NO: 146718 - RNA, 18 nt, Artificial Sequence
  Description of Artificial Sequence: Synthetic oligonucleotide
gaucaguugggucagugg

SEQ ID NO: 146719 - RNA, 18 nt, Artificial Sequence
  Description of Artificial Sequence: Synthetic oligonucleotide
agcaggaucaguuggguc

SEQ ID NO: 146720 - RNA, 18 nt, Artificial Sequence
  Description of Artificial Sequence: Synthetic oligonucleotide
gcuggagcaggaucaguu

SEQ ID NO: 146721 - RNA, 18 nt, Artificial Sequence
  Description of Artificial Sequence: Synthetic oligonucleotide
gugcugcuggagcaggau

SEQ ID NO: 146722 - RNA, 18 nt, Artificial Sequence
  Description of Artificial Sequence: Synthetic oligonucleotide
gaggugugcugcuggagc

SEQ ID NO: 146723 - RNA, 18 nt, Artificial Sequence
  Description of Artificial Sequence: Synthetic oligonucleotide
gggcugaggugugcugcu

SEQ ID NO: 146724 - RNA, 18 nt, Artificial Sequence
  Description of Artificial Sequence: Synthetic oligonucleotide
aaggacacugggugucag

SEQ ID NO: 146725 - RNA, 18 nt, Artificial Sequence
  Description of Artificial Sequence: Synthetic oligonucleotide
gauggaaggacacugggu

SEQ ID NO: 146726 - RNA, 18 nt, Artificial Sequence
  Description of Artificial Sequence: Synthetic oligonucleotide
gugaagauggaaggacac

SEQ ID NO: 146727 - RNA, 18 nt, Artificial Sequence
  Description of Artificial Sequence: Synthetic oligonucleotide
ccagugugaagauggaag

SEQ ID NO: 146728 - RNA, 18 nt, Artificial Sequence
  Description of Artificial Sequence: Synthetic oligonucleotide
gcaaaccagugugaagau

SEQ ID NO: 146729 - RNA, 18 nt, Artificial Sequence
  Description of Artificial Sequence: Synthetic oligonucleotide
gccuggcaaaccagugug

SEQ ID NO: 146730 - RNA, 18 nt, Artificial Sequence
  Description of Artificial Sequence: Synthetic oligonucleotide
cauuggccuggcaaacca

SEQ ID NO: 146731 - RNA, 18 nt, Artificial Sequence
  Description of Artificial Sequence: Synthetic oligonucleotide
agcaacauuggccuggca

SEQ ID NO: 146732 - RNA, 18 nt, Artificial Sequence
  Description of Artificial Sequence: Synthetic oligonucleotide
ccaucagcaacauuggcc

SEQ ID NO: 146733 - RNA, 18 nt, Artificial Sequence
  Description of Artificial Sequence: Synthetic oligonucleotide
gggccaucagcaacauug

SEQ ID NO: 146734 - RNA, 18 nt, Artificial Sequence
  Description of Artificial Sequence: Synthetic oligonucleotide
ccagcggccagugcaggg

SEQ ID NO: 146735 - RNA, 18 nt, Artificial Sequence
  Description of Artificial Sequence: Synthetic oligonucleotide
gccguccagcggccagug

SEQ ID NO: 146736 - RNA, 18 nt, Artificial Sequence
  Description of Artificial Sequence: Synthetic oligonucleotide
agagugccguccagcggc

SEQ ID NO: 146737 - RNA, 18 nt, Artificial Sequence
  Description of Artificial Sequence: Synthetic oligonucleotide
cugggagagugccgucca

SEQ ID NO: 146738 - RNA, 18 nt, Artificial Sequence
  Description of Artificial Sequence: Synthetic oligonucleotide
ccaagcugggagagugcc

SEQ ID NO: 146739 - RNA, 18 nt, Artificial Sequence
  Description of Artificial Sequence: Synthetic oligonucleotide
uacuuccaagcugggaga

SEQ ID NO: 146740 - RNA, 18 nt, Artificial Sequence
  Description of Artificial Sequence: Synthetic oligonucleotide
cugccuacuuccaagcug

SEQ ID NO: 146741 - RNA, 18 nt, Artificial Sequence
  Description of Artificial Sequence: Synthetic oligonucleotide
gaacccugccuacuucca

SEQ ID NO: 146742 - RNA, 18 nt, Artificial Sequence
  Description of Artificial Sequence: Synthetic oligonucleotide
ggagggaacccugccuac

SEQ ID NO: 146743 - RNA, 18 nt, Artificial Sequence
  Description of Artificial Sequence: Synthetic oligonucleotide
caccuggagggaacccug

SEQ ID NO: 146744 - RNA, 18 nt, Artificial Sequence
  Description of Artificial Sequence: Synthetic oligonucleotide
gggcccaccuggagggaa

SEQ ID NO: 146745 - RNA, 18 nt, Artificial Sequence
  Description of Artificial Sequence: Synthetic oligonucleotide
gcuccucuucagugaggu

SEQ ID NO: 146746 - RNA, 18 nt, Artificial Sequence
  Description of Artificial Sequence: Synthetic oligonucleotide
gacuugcuccucuucagu

SEQ ID NO: 146747 - RNA, 18 nt, Artificial Sequence
  Description of Artificial Sequence: Synthetic oligonucleotide
cuugagacuugcuccucu

SEQ ID NO: 146748 - RNA, 18 nt, Artificial Sequence
  Description of Artificial Sequence: Synthetic oligonucleotide
cuucucuugagacuugcu

SEQ ID NO: 146749 - RNA, 18 nt, Artificial Sequence
  Description of Artificial Sequence: Synthetic oligonucleotide
cccuccuucucuugagac

SEQ ID NO: 146750 - RNA, 18 nt, Artificial Sequence
  Description of Artificial Sequence: Synthetic oligonucleotide
auccccccuccuucucuu

SEQ ID NO: 146751 - RNA, 18 nt, Artificial Sequence
  Description of Artificial Sequence: Synthetic oligonucleotide
caccaauccccccuccuu

SEQ ID NO: 146752 - RNA, 18 nt, Artificial Sequence
  Description of Artificial Sequence: Synthetic oligonucleotide
ccaaccaccaaucccccc

SEQ ID NO: 146753 - RNA, 18 nt, Artificial Sequence
  Description of Artificial Sequence: Synthetic oligonucleotide
uuccuccaaccaccaauc

SEQ ID NO: 146754 - RNA, 18 nt, Artificial Sequence
  Description of Artificial Sequence: Synthetic oligonucleotide
gcugcuuccuccaaccac

SEQ ID NO: 146755 - RNA, 18 nt, Artificial Sequence
  Description of Artificial Sequence: Synthetic oligonucleotide
ggugugcugcuuccucca

SEQ ID NO: 146756 - RNA, 18 nt, Artificial Sequence
  Description of Artificial Sequence: Synthetic oligonucleotide
aauugggugugcugcuuc

SEQ ID NO: 146757 - RNA, 18 nt, Artificial Sequence
  Description of Artificial Sequence: Synthetic oligonucleotide
ggcagaauugggugugcu

SEQ ID NO: 146758 - RNA, 18 nt, Artificial Sequence
  Description of Artificial Sequence: Synthetic oligonucleotide
gggcagaauugggugugc

SEQ ID NO: 146759 - RNA, 18 nt, Artificial Sequence
  Description of Artificial Sequence: Synthetic oligonucleotide
agaccccgaguccuaggg

SEQ ID NO: 146760 - RNA, 18 nt, Artificial Sequence
  Description of Artificial Sequence: Synthetic oligonucleotide
gacucagaccccgagucc

SEQ ID NO: 146761 - RNA, 18 nt, Artificial Sequence
  Description of Artificial Sequence: Synthetic oligonucleotide
cccaggacucagaccccg

SEQ ID NO: 146762 - RNA, 18 nt, Artificial Sequence
  Description of Artificial Sequence: Synthetic oligonucleotide
cugaccccaggacucaga

SEQ ID NO: 146763 - RNA, 18 nt, Artificial Sequence
  Description of Artificial Sequence: Synthetic oligonucleotide
cuggccugaccccaggac

SEQ ID NO: 146764 - RNA, 18 nt, Artificial Sequence
  Description of Artificial Sequence: Synthetic oligonucleotide
ucucccuggccugacccc

SEQ ID NO: 146765 - RNA, 18 nt, Artificial Sequence
  Description of Artificial Sequence: Synthetic oligonucleotide
cgagcucucccuggccug

SEQ ID NO: 146766 - RNA, 18 nt, Artificial Sequence
  Description of Artificial Sequence: Synthetic oligonucleotide
ugccccgagcucucccug

SEQ ID NO: 146767 - RNA, 18 nt, Artificial Sequence
  Description of Artificial Sequence: Synthetic oligonucleotide
aggccugccccgagcucu

SEQ ID NO: 146768 - RNA, 18 nt, Artificial Sequence
  Description of Artificial Sequence: Synthetic oligonucleotide
gcggaaggccugccccga

SEQ ID NO: 146769 - RNA, 18 nt, Artificial Sequence
  Description of Artificial Sequence: Synthetic oligonucleotide
ugcuggcggaaggccugc

SEQ ID NO: 146770 - RNA, 18 nt, Artificial Sequence
  Description of Artificial Sequence: Synthetic oligonucleotide
gggagugcuggcggaagg

SEQ ID NO: 146771 - RNA, 18 nt, Artificial Sequence
  Description of Artificial Sequence: Synthetic oligonucleotide
gcagugggagugcuggcg

SEQ ID NO: 146772 - RNA, 18 nt, Artificial Sequence
  Description of Artificial Sequence: Synthetic oligonucleotide
gggcagugggagugcugg

SEQ ID NO: 146773 - RNA, 18 nt, Artificial Sequence
  Description of Artificial Sequence: Synthetic oligonucleotide
ggcugcuacugggcaggg

SEQ ID NO: 146774 - RNA, 18 nt, Artificial Sequence
  Description of Artificial Sequence: Synthetic oligonucleotide
ugggcggcugcuacuggg

SEQ ID NO: 146775 - RNA, 18 nt, Artificial Sequence
  Description of Artificial Sequence: Synthetic oligonucleotide
caaugugggcggcugcua

SEQ ID NO: 146776 - RNA, 18 nt, Artificial Sequence
  Description of Artificial Sequence: Synthetic oligonucleotide
ugacacaaugugggcggc

SEQ ID NO: 146777 - RNA, 18 nt, Artificial Sequence
  Description of Artificial Sequence: Synthetic oligonucleotide
gaugcugacacaaugugg

SEQ ID NO: 146778 - RNA, 18 nt, Artificial Sequence
  Description of Artificial Sequence: Synthetic oligonucleotide
cccuggaugcugacacaa

SEQ ID NO: 146779 - RNA, 18 nt, Artificial Sequence
  Description of Artificial Sequence: Synthetic oligonucleotide
ccuggcccuggaugcuga

SEQ ID NO: 146780 - RNA, 18 nt, Artificial Sequence
  Description of Artificial Sequence: Synthetic oligonucleotide
caggcccuggcccuggau

SEQ ID NO: 146781 - RNA, 18 nt, Artificial Sequence
  Description of Artificial Sequence: Synthetic oligonucleotide
gaggccaggcccuggccc

SEQ ID NO: 146782 - RNA, 18 nt, Artificial Sequence
  Description of Artificial Sequence: Synthetic oligonucleotide
gaugugaggccaggcccu

SEQ ID NO: 146783 - RNA, 18 nt, Artificial Sequence
  Description of Artificial Sequence: Synthetic oligonucleotide
gggaugugaggccaggcc

SEQ ID NO: 146784 - RNA, 18 nt, Artificial Sequence
  Description of Artificial Sequence: Synthetic oligonucleotide
cuagagaaaggagcaggg

SEQ ID NO: 146785 - RNA, 18 nt, Artificial Sequence
  Description of Artificial Sequence: Synthetic oligonucleotide
gccagcuagagaaaggag

SEQ ID NO: 146786 - RNA, 18 nt, Artificial Sequence
  Description of Artificial Sequence: Synthetic oligonucleotide
guggagccagcuagagaa

SEQ ID NO: 146787 - RNA, 18 nt, Artificial Sequence
  Description of Artificial Sequence: Synthetic oligonucleotide
cucccguggagccagcua

SEQ ID NO: 146788 - RNA, 18 nt, Artificial Sequence
  Description of Artificial Sequence: Synthetic oligonucleotide
cugaacucccguggagcc

SEQ ID NO: 146789 - RNA, 18 nt, Artificial Sequence
  Description of Artificial Sequence: Synthetic oligonucleotide
gggccugaacucccgugg

SEQ ID NO: 146790 - RNA, 18 nt, Artificial Sequence
  Description of Artificial Sequence: Synthetic oligonucleotide
ugugugugugcuggaggg

SEQ ID NO: 146791 - RNA, 18 nt, Artificial Sequence
  Description of Artificial Sequence: Synthetic oligonucleotide
gcuuaugugugugugcug

SEQ ID NO: 146792 - RNA, 18 nt, Artificial Sequence
  Description of Artificial Sequence: Synthetic oligonucleotide
ucagugcuuaugugugug

SEQ ID NO: 146793 - RNA, 18 nt, Artificial Sequence
  Description of Artificial Sequence: Synthetic oligonucleotide
ugauuucagugcuuaugu

SEQ ID NO: 146794 - RNA, 18 nt, Artificial Sequence
  Description of Artificial Sequence: Synthetic oligonucleotide
uaaagugauuucagugcu

SEQ ID NO: 146795 - RNA, 18 nt, Artificial Sequence
  Description of Artificial Sequence: Synthetic oligonucleotide
gcagguaaagugauuuca

SEQ ID NO: 146796 - RNA, 18 nt, Artificial Sequence
  Description of Artificial Sequence: Synthetic oligonucleotide
agccugcagguaaaguga

SEQ ID NO: 146797 - RNA, 18 nt, Artificial Sequence
  Description of Artificial Sequence: Synthetic oligonucleotide
cauggagccugcagguaa

SEQ ID NO: 146798 - RNA, 18 nt, Artificial Sequence
  Description of Artificial Sequence: Synthetic oligonucleotide
aggugcauggagccugca

SEQ ID NO: 146799 - RNA, 18 nt, Artificial Sequence
  Description of Artificial Sequence: Synthetic oligonucleotide
aagggaggugcauggagc

SEQ ID NO: 146800 - RNA, 18 nt, Artificial Sequence
  Description of Artificial Sequence: Synthetic oligonucleotide
gagggaagggaggugcau

SEQ ID NO: 146801 - RNA, 18 nt, Artificial Sequence
  Description of Artificial Sequence: Synthetic oligonucleotide
ucagggagggaagggagg

SEQ ID NO: 146802 - RNA, 18 nt, Artificial Sequence
  Description of Artificial Sequence: Synthetic oligonucleotide
cugccucagggagggaag

SEQ ID NO: 146803 - RNA, 18 nt, Artificial Sequence
  Description of Artificial Sequence: Synthetic oligonucleotide
cucaccugccucagggag

SEQ ID NO: 146804 - RNA, 18 nt, Artificial Sequence
  Description of Artificial Sequence: Synthetic oligonucleotide
ggguucucaccugccuca

SEQ ID NO: 146805 - RNA, 18 nt, Artificial Sequence
  Description of Artificial Sequence: Synthetic oligonucleotide
ucucuggguucucaccug

SEQ ID NO: 146806 - RNA, 18 nt, Artificial Sequence
  Description of Artificial Sequence: Synthetic oligonucleotide
cccucucucuggguucuc

SEQ ID NO: 146807 - RNA, 18 nt, Artificial Sequence
  Description of Artificial Sequence: Synthetic oligonucleotide
caggccccucucucuggg

SEQ ID NO: 146808 - RNA, 18 nt, Artificial Sequence
  Description of Artificial Sequence: Synthetic oligonucleotide
accugcaggccccucucu

SEQ ID NO: 146809 - RNA, 18 nt, Artificial Sequence
  Description of Artificial Sequence: Synthetic oligonucleotide
ugcucaccugcaggcccc

SEQ ID NO: 146810 - RNA, 18 nt, Artificial Sequence
  Description of Artificial Sequence: Synthetic oligonucleotide
cugccugcucaccugcag

SEQ ID NO: 146811 - RNA, 18 nt, Artificial Sequence
  Description of Artificial Sequence: Synthetic oligonucleotide
cagcccugccugcucacc

SEQ ID NO: 146812 - RNA, 18 nt, Artificial Sequence
  Description of Artificial Sequence: Synthetic oligonucleotide
uggcccagcccugccugc

SEQ ID NO: 146813 - RNA, 18 nt, Artificial Sequence
  Description of Artificial Sequence: Synthetic oligonucleotide
agaccuggcccagcccug

SEQ ID NO: 146814 - RNA, 18 nt, Artificial Sequence
  Description of Artificial Sequence: Synthetic oligonucleotide
cccggagaccuggcccag

SEQ ID NO: 146815 - RNA, 18 nt, Artificial Sequence
  Description of Artificial Sequence: Synthetic oligonucleotide
gccuccccggagaccugg

SEQ ID NO: 146816 - RNA, 18 nt, Artificial Sequence
  Description of Artificial Sequence: Synthetic oligonucleotide
ccccugccuccccggaga

SEQ ID NO: 146817 - RNA, 18 nt, Artificial Sequence
  Description of Artificial Sequence: Synthetic oligonucleotide
caggaccccugccucccc

SEQ ID NO: 146818 - RNA, 18 nt, Artificial Sequence
  Description of Artificial Sequence: Synthetic oligonucleotide
accugcaggaccccugcc

SEQ ID NO: 146819 - RNA, 18 nt, Artificial Sequence
  Description of Artificial Sequence: Synthetic oligonucleotide
ccaggaccugcaggaccc

SEQ ID NO: 146820 - RNA, 18 nt, Artificial Sequence
  Description of Artificial Sequence: Synthetic oligonucleotide
acccaccaggaccugcag

SEQ ID NO: 146821 - RNA, 18 nt, Artificial Sequence
  Description of Artificial Sequence: Synthetic oligonucleotide
ggcugacccaccaggacc

SEQ ID NO: 146822 - RNA, 18 nt, Artificial Sequence
  Description of Artificial Sequence: Synthetic oligonucleotide
ugcugggcugacccacca

SEQ ID NO: 146823 - RNA, 18 nt, Artificial Sequence
  Description of Artificial Sequence: Synthetic oligonucleotide
gcaggugcugggcugacc

SEQ ID NO: 146824 - RNA, 18 nt, Artificial Sequence
  Description of Artificial Sequence: Synthetic oligonucleotide
ugggagcaggugcugggc

SEQ ID NO: 146825 - RNA, 18 nt, Artificial Sequence
  Description of Artificial Sequence: Synthetic oligonucleotide
cccacugggagcaggugc

SEQ ID NO: 146826 - RNA, 18 nt, Artificial Sequence
  Description of Artificial Sequence: Synthetic oligonucleotide
aagcucccacugggagca

SEQ ID NO: 146827 - RNA, 18 nt, Artificial Sequence
  Description of Artificial Sequence: Synthetic oligonucleotide
ccgggaagcucccacugg

SEQ ID NO: 146828 - RNA, 18 nt, Artificial Sequence
  Description of Artificial Sequence: Synthetic oligonucleotide
uuaucccgggaagcuccc

SEQ ID NO: 146829 - RNA, 18 nt, Artificial Sequence
  Description of Artificial Sequence: Synthetic oligonucleotide
ucaguuuaucccgggaag

SEQ ID NO: 146830 - RNA, 18 nt, Artificial Sequence
  Description of Artificial Sequence: Synthetic oligonucleotide
caggcucaguuuaucccg

SEQ ID NO: 146831 - RNA, 18 nt, Artificial Sequence
  Description of Artificial Sequence: Synthetic oligonucleotide
augaacaggcucaguuua

SEQ ID NO: 146832 - RNA, 18 nt, Artificial Sequence
  Description of Artificial Sequence: Synthetic oligonucleotide
ucagaaugaacaggcuca

SEQ ID NO: 146833 - RNA, 18 nt, Artificial Sequence
  Description of Artificial Sequence: Synthetic oligonucleotide
ggacaucagaaugaacag

SEQ ID NO: 146834 - RNA, 18 nt, Artificial Sequence
  Description of Artificial Sequence: Synthetic oligonucleotide
caaauggacaucagaaug

SEQ ID NO: 146835 - RNA, 18 nt, Artificial Sequence
  Description of Artificial Sequence: Synthetic oligonucleotide
ugggacaaauggacauca

SEQ ID NO: 146836 - RNA, 18 nt, Artificial Sequence
  Description of Artificial Sequence: Synthetic oligonucleotide
gcuauugggacaaaugga

SEQ ID NO: 146837 - RNA, 18 nt, Artificial Sequence
  Description of Artificial Sequence: Synthetic oligonucleotide
guagagcuauugggacaa

SEQ ID NO: 146838 - RNA, 18 nt, Artificial Sequence
  Description of Artificial Sequence: Synthetic oligonucleotide
gggcaguagagcuauugg

SEQ ID NO: 146839 - RNA, 18 nt, Artificial Sequence
  Description of Artificial Sequence: Synthetic oligonucleotide
gggagggcaguagagcua

SEQ ID NO: 146840 - RNA, 18 nt, Artificial Sequence
  Description of Artificial Sequence: Synthetic oligonucleotide
gcugggcugaguaaaggg

SEQ ID NO: 146841 - RNA, 18 nt, Artificial Sequence
  Description of Artificial Sequence: Synthetic oligonucleotide
ggccagcugggcugagua

SEQ ID NO: 146842 - RNA, 18 nt, Artificial Sequence
  Description of Artificial Sequence: Synthetic oligonucleotide
uagguggccagcugggcu

SEQ ID NO: 146843 - RNA, 18 nt, Artificial Sequence
  Description of Artificial Sequence: Synthetic oligonucleotide
acuucuagguggccagcu

SEQ ID NO: 146844 - RNA, 18 nt, Artificial Sequence
  Description of Artificial Sequence: Synthetic oligonucleotide
gggagacuucuagguggc

SEQ ID NO: 146845 - RNA, 18 nt, Artificial Sequence
  Description of Artificial Sequence: Synthetic oligonucleotide
gugcagggagacuucuag

SEQ ID NO: 146846 - RNA, 18 nt, Artificial Sequence
  Description of Artificial Sequence: Synthetic oligonucleotide
aggcugugcagggagacu

SEQ ID NO: 146847 - RNA, 18 nt, Artificial Sequence
  Description of Artificial Sequence: Synthetic oligonucleotide
acuagaggcugugcaggg

SEQ ID NO: 146848 - RNA, 18 nt, Artificial Sequence
  Description of Artificial Sequence: Synthetic oligonucleotide
cggacacuagaggcugug

SEQ ID NO: 146849 - RNA, 18 nt, Artificial Sequence
  Description of Artificial Sequence: Synthetic oligonucleotide
guccccggacacuagagg

SEQ ID NO: 146850 - RNA, 18 nt, Artificial Sequence
  Description of Artificial Sequence: Synthetic oligonucleotide
acaagguccccggacacu

SEQ ID NO: 146851 - RNA, 18 nt, Artificial Sequence
  Description of Artificial Sequence: Synthetic oligonucleotide
gucccacaagguccccgg

SEQ ID NO: 146852 - RNA, 18 nt, Artificial Sequence
  Description of Artificial Sequence: Synthetic oligonucleotide
gacuggucccacaagguc

SEQ ID NO: 146853 - RNA, 18 nt, Artificial Sequence
  Description of Artificial Sequence: Synthetic oligonucleotide
ugugggacuggucccaca

SEQ ID NO: 146854 - RNA, 18 nt, Artificial Sequence
  Description of Artificial Sequence: Synthetic oligonucleotide
agcggugugggacugguc

SEQ ID NO: 146855 - RNA, 18 nt, Artificial Sequence
  Description of Artificial Sequence: Synthetic oligonucleotide
ggaccagcggugugggac

SEQ ID NO: 146856 - RNA, 18 nt, Artificial Sequence
  Description of Artificial Sequence: Synthetic oligonucleotide
ggcagggaccagcggugu

SEQ ID NO: 146857 - RNA, 18 nt, Artificial Sequence
  Description of Artificial Sequence: Synthetic oligonucleotide
gggagggcagggaccagc

SEQ ID NO: 146858 - RNA, 18 nt, Artificial Sequence
  Description of Artificial Sequence: Synthetic oligonucleotide
gcaccucaaccugggagc

SEQ ID NO: 146859 - RNA, 18 nt, Artificial Sequence
  Description of Artificial Sequence: Synthetic oligonucleotide
ugagcgcaccucaaccug

SEQ ID NO: 146860 - RNA, 18 nt, Artificial Sequence
  Description of Artificial Sequence: Synthetic oligonucleotide
ugaggugagcgcaccuca

SEQ ID NO: 146861 - RNA, 18 nt, Artificial Sequence
  Description of Artificial Sequence: Synthetic oligonucleotide
ugcucugaggugagcgca

SEQ ID NO: 146862 - RNA, 18 nt, Artificial Sequence
  Description of Artificial Sequence: Synthetic oligonucleotide
ggcccugcucugagguga

SEQ ID NO: 146863 - RNA, 18 nt, Artificial Sequence
  Description of Artificial Sequence: Synthetic oligonucleotide
gcuuuggcccugcucuga

SEQ ID NO: 146864 - RNA, 18 nt, Artificial Sequence
  Description of Artificial Sequence: Synthetic oligonucleotide
gcugugcuuuggcccugc

SEQ ID NO: 146865 - RNA, 18 nt, Artificial Sequence
  Description of Artificial Sequence: Synthetic oligonucleotide
gcccagcugugcuuuggc

SEQ ID NO: 146866 - RNA, 18 nt, Artificial Sequence
  Description of Artificial Sequence: Synthetic oligonucleotide
ggcaugcccagcugugcu

SEQ ID NO: 146867 - RNA, 18 nt, Artificial Sequence
  Description of Artificial Sequence: Synthetic oligonucleotide
gacauggcaugcccagcu

SEQ ID NO: 146868 - RNA, 18 nt, Artificial Sequence
  Description of Artificial Sequence: Synthetic oligonucleotide
gcucagacauggcaugcc

SEQ ID NO: 146869 - RNA, 18 nt, Artificial Sequence
  Description of Artificial Sequence: Synthetic oligonucleotide
gcgccgcucagacauggc

SEQ ID NO: 146870 - RNA, 18 nt, Artificial Sequence
  Description of Artificial Sequence: Synthetic oligonucleotide
gcucugcgccgcucagac

SEQ ID NO: 146871 - RNA, 18 nt, Artificial Sequence
  Description of Artificial Sequence: Synthetic oligonucleotide
ggagggcucugcgccgcu

SEQ ID NO: 146872 - RNA, 18 nt, Artificial Sequence
  Description of Artificial Sequence: Synthetic oligonucleotide
ggccuggagggcucugcg

SEQ ID NO: 146873 - RNA, 18 nt, Artificial Sequence
  Description of Artificial Sequence: Synthetic oligonucleotide
cugcaggccuggagggcu

SEQ ID NO: 146874 - RNA, 18 nt, Artificial Sequence
  Description of Artificial Sequence: Synthetic oligonucleotide
ugccccugcaggccugga

SEQ ID NO: 146875 - RNA, 18 nt, Artificial Sequence
  Description of Artificial Sequence: Synthetic oligonucleotide
ccccuugccccugcaggc

SEQ ID NO: 146876 - RNA, 18 nt, Artificial Sequence
  Description of Artificial Sequence: Synthetic oligonucleotide
gccagccccuugccccug

SEQ ID NO: 146877 - RNA, 18 nt, Artificial Sequence
  Description of Artificial Sequence: Synthetic oligonucleotide
cuccagccagccccuugc

SEQ ID NO: 146878 - RNA, 18 nt, Artificial Sequence
  Description of Artificial Sequence: Synthetic oligonucleotide
ugagacuccagccagccc

SEQ ID NO: 146879 - RNA, 18 nt, Artificial Sequence
  Description of Artificial Sequence: Synthetic oligonucleotide
ugcucugagacuccagcc

SEQ ID NO: 146880 - RNA, 18 nt, Artificial Sequence
  Description of Artificial Sequence: Synthetic oligonucleotide
cucugugcucugagacuc

SEQ ID NO: 146881 - RNA, 18 nt, Artificial Sequence
  Description of Artificial Sequence: Synthetic oligonucleotide
ccuaccucugugcucuga

SEQ ID NO: 146882 - RNA, 18 nt, Artificial Sequence
  Description of Artificial Sequence: Synthetic oligonucleotide
guucuccuaccucugugc

SEQ ID NO: 146883 - RNA, 18 nt, Artificial Sequence
  Description of Artificial Sequence: Synthetic oligonucleotide
ccccaguucuccuaccuc

SEQ ID NO: 146884 - RNA, 18 nt, Artificial Sequence
  Description of Artificial Sequence: Synthetic oligonucleotide
uugaaccccaguucuccu

SEQ ID NO: 146885 - RNA, 18 nt, Artificial Sequence
  Description of Artificial Sequence: Synthetic oligonucleotide
ugggcuugaaccccaguu

SEQ ID NO: 146886 - RNA, 18 nt, Artificial Sequence
  Description of Artificial Sequence: Synthetic oligonucleotide
aagccugggcuugaaccc

SEQ ID NO: 146887 - RNA, 18 nt, Artificial Sequence
  Description of Artificial Sequence: Synthetic oligonucleotide
ccaggaagccugggcuug

SEQ ID NO: 146888 - RNA, 18 nt, Artificial Sequence
  Description of Artificial Sequence: Synthetic oligonucleotide
aggacccaggaagccugg

SEQ ID NO: 146889 - RNA, 18 nt, Artificial Sequence
  Description of Artificial Sequence: Synthetic oligonucleotide
caggcaggacccaggaag

SEQ ID NO: 146890 - RNA, 18 nt, Artificial Sequence
  Description of Artificial Sequence: Synthetic oligonucleotide
aggaccaggcaggaccca

SEQ ID NO: 146891 - RNA, 18 nt, Artificial Sequence
  Description of Artificial Sequence: Synthetic oligonucleotide
gagggaggaccaggcagg

SEQ ID NO: 146892 - RNA, 18 nt, Artificial Sequence
  Description of Artificial Sequence: Synthetic oligonucleotide
cuugggagggaggaccag

SEQ ID NO: 146893 - RNA, 18 nt, Artificial Sequence
  Description of Artificial Sequence: Synthetic oligonucleotide
ggcuccuugggagggagg

SEQ ID NO: 146894 - RNA, 18 nt, Artificial Sequence
  Description of Artificial Sequence: Synthetic oligonucleotide
agaauggcuccuugggag

SEQ ID NO: 146895 - RNA, 18 nt, Artificial Sequence
  Description of Artificial Sequence: Synthetic oligonucleotide
cacacagaauggcuccuu

SEQ ID NO: 146896 - RNA, 18 nt, Artificial Sequence
  Description of Artificial Sequence: Synthetic oligonucleotide
agucacacacagaauggc

SEQ ID NO: 146897 - RNA, 18 nt, Artificial Sequence
  Description of Artificial Sequence: Synthetic oligonucleotide
cccagagucacacacaga

SEQ ID NO: 146898 - RNA, 18 nt, Artificial Sequence
  Description of Artificial Sequence: Synthetic oligonucleotide
uuccacccagagucacac

SEQ ID NO: 146899 - RNA, 18 nt, Artificial Sequence
  Description of Artificial Sequence: Synthetic oligonucleotide
ggcacuuccacccagagu

SEQ ID NO: 146900 - RNA, 18 nt, Artificial Sequence
  Description of Artificial Sequence: Synthetic oligonucleotide
ggcugggcacuuccaccc

SEQ ID NO: 146901 - RNA, 18 nt, Artificial Sequence
  Description of Artificial Sequence: Synthetic oligonucleotide
gggcugggcacuuccacc

SEQ ID NO: 146902 - RNA, 18 nt, Artificial Sequence
  Description of Artificial Sequence: Synthetic oligonucleotide
gcugcagcgcccguaggg

SEQ ID NO: 146903 - RNA, 18 nt, Artificial Sequence
  Description of Artificial Sequence: Synthetic oligonucleotide
gggaggcugcagcgcccg

SEQ ID NO: 146904 - RNA, 18 nt, Artificial Sequence
  Description of Artificial Sequence: Synthetic oligonucleotide
uggaagggaggcugcagc

SEQ ID NO: 146905 - RNA, 18 nt, Artificial Sequence
  Description of Artificial Sequence: Synthetic oligonucleotide
gggcauggaagggaggcu

SEQ ID NO: 146906 - RNA, 18 nt, Artificial Sequence
  Description of Artificial Sequence: Synthetic oligonucleotide
gccagcagagagugaucc

SEQ ID NO: 146907 - RNA, 18 nt, Artificial Sequence
  Description of Artificial Sequence: Synthetic oligonucleotide
auccugccagcagagagu

SEQ ID NO: 146908 - RNA, 18 nt, Artificial Sequence
  Description of Artificial Sequence: Synthetic oligonucleotide
gaagaauccugccagcag

SEQ ID NO: 146909 - RNA, 18 nt, Artificial Sequence
  Description of Artificial Sequence: Synthetic oligonucleotide
agcgggaagaauccugcc

SEQ ID NO: 146910 - RNA, 18 nt, Artificial Sequence
  Description of Artificial Sequence: Synthetic oligonucleotide
gggagcgggaagaauccu

SEQ ID NO: 146911 - RNA, 18 nt, Artificial Sequence
  Description of Artificial Sequence: Synthetic oligonucleotide
aucagcuggguagguggg

SEQ ID NO: 146912 - RNA, 18 nt, Artificial Sequence
  Description of Artificial Sequence: Synthetic oligonucleotide
cccccaucagcuggguag

SEQ ID NO: 146913 - RNA, 18 nt, Artificial Sequence
  Description of Artificial Sequence: Synthetic oligonucleotide
cccaacccccaucagcug

SEQ ID NO: 146914 - RNA, 18 nt, Artificial Sequence
  Description of Artificial Sequence: Synthetic oligonucleotide
agcaccccaacccccauc

SEQ ID NO: 146915 - RNA, 18 nt, Artificial Sequence
  Description of Artificial Sequence: Synthetic oligonucleotide
aaggaagcaccccaaccc

SEQ ID NO: 146916 - RNA, 18 nt, Artificial Sequence
  Description of Artificial Sequence: Synthetic oligonucleotide
ccugaaaggaagcacccc

SEQ ID NO: 146917 - RNA, 18 nt, Artificial Sequence
  Description of Artificial Sequence: Synthetic oligonucleotide
cuuggccugaaaggaagc

SEQ ID NO: 146918 - RNA, 18 nt, Artificial Sequence
  Description of Artificial Sequence: Synthetic oligonucleotide
auagccuuggccugaaag

SEQ ID NO: 146919 - RNA, 18 nt, Artificial Sequence
  Description of Artificial Sequence: Synthetic oligonucleotide
ccuucauagccuuggccu

SEQ ID NO: 146920 - RNA, 18 nt, Artificial Sequence
  Description of Artificial Sequence: Synthetic oligonucleotide
cugucccuucauagccuu

SEQ ID NO: 146921 - RNA, 18 nt, Artificial Sequence
  Description of Artificial Sequence: Synthetic oligonucleotide
agcagcugucccuucaua

SEQ ID NO: 146922 - RNA, 18 nt, Artificial Sequence
  Description of Artificial Sequence: Synthetic oligonucleotide
gucccagcagcugucccu

SEQ ID NO: 146923 - RNA, 18 nt, Artificial Sequence
  Description of Artificial Sequence: Synthetic oligonucleotide
ggugggucccagcagcug

SEQ ID NO: 146924 - RNA, 18 nt, Artificial Sequence
  Description of Artificial Sequence: Synthetic oligonucleotide
gggaggugggucccagca

SEQ ID NO: 146925 - RNA, 18 nt, Artificial Sequence
  Description of Artificial Sequence: Synthetic oligonucleotide
acgcggcauguggccggg

SEQ ID NO: 146926 - RNA, 18 nt, Artificial Sequence
  Description of Artificial Sequence: Synthetic oligonucleotide
cagggacgcggcaugugg

SEQ ID NO: 146927 - RNA, 18 nt, Artificial Sequence
  Description of Artificial Sequence: Synthetic oligonucleotide
gggcagggacgcggcaug

SEQ ID NO: 146928 - RNA, 18 nt, Artificial Sequence
  Description of Artificial Sequence: Synthetic oligonucleotide
caccagacccgggucggg

SEQ ID NO: 146929 - RNA, 18 nt, Artificial Sequence
  Description of Artificial Sequence: Synthetic oligonucleotide
cucagcaccagacccggg

SEQ ID NO: 146930 - RNA, 18 nt, Artificial Sequence
  Description of Artificial Sequence: Synthetic oligonucleotide
guauccucagcaccagac

SEQ ID NO: 146931 - RNA, 18 nt, Artificial Sequence
  Description of Artificial Sequence: Synthetic oligonucleotide
gagcuguauccucagcac

SEQ ID NO: 146932 - RNA, 18 nt, Artificial Sequence
  Description of Artificial Sequence: Synthetic oligonucleotide
gagaagagcuguauccuc

SEQ ID NO: 146933 - RNA, 18 nt, Artificial Sequence
  Description of Artificial Sequence: Synthetic oligonucleotide
acacugagaagagcugua

SEQ ID NO: 146934 - RNA, 18 nt, Artificial Sequence
  Description of Artificial Sequence: Synthetic oligonucleotide
uucagacacugagaagag

SEQ ID NO: 146935 - RNA, 18 nt, Artificial Sequence
  Description of Artificial Sequence: Synthetic oligonucleotide
gauuguucagacacugag

SEQ ID NO: 146936 - RNA, 18 nt, Artificial Sequence
  Description of Artificial Sequence: Synthetic oligonucleotide
uuggagauuguucagaca

SEQ ID NO: 146937 - RNA, 18 nt, Artificial Sequence
  Description of Artificial Sequence: Synthetic oligonucleotide
caauuuuggagauuguuc

SEQ ID NO: 146938 - RNA, 18 nt, Artificial Sequence
  Description of Artificial Sequence: Synthetic oligonucleotide
cauuucaauuuuggagau

SEQ ID NO: 146939 - RNA, 18 nt, Artificial Sequence
  Description of Artificial Sequence: Synthetic oligonucleotide
auauacauuucaauuuug

SEQ ID NO: 146940 - RNA, 18 nt, Artificial Sequence
  Description of Artificial Sequence: Synthetic oligonucleotide
caaaaauauacauuucaa

SEQ ID NO: 146941 - RNA, 18 nt, Artificial Sequence
  Description of Artificial Sequence: Synthetic oligonucleotide
ccuagcaaaaauauacau

SEQ ID NO: 146942 - RNA, 18 nt, Artificial Sequence
  Description of Artificial Sequence: Synthetic oligonucleotide
gggcuccuagcaaaaaua

SEQ ID NO: 146943 - RNA, 18 nt, Artificial Sequence
  Description of Artificial Sequence: Synthetic oligonucleotide
auuaaaaacacaggaagc

SEQ ID NO: 146944 - RNA, 18 nt, Artificial Sequence
  Description of Artificial Sequence: Synthetic oligonucleotide
uuuauauuaaaaacacag

SEQ ID NO: 146945 - RNA, 18 nt, Artificial Sequence
  Description of Artificial Sequence: Synthetic oligonucleotide
cacuauuuauauuaaaaa

SEQ ID NO: 146946 - RNA, 18 nt, Artificial Sequence
  Description of Artificial Sequence: Synthetic oligonucleotide
guguacacuauuuauauu

SEQ ID NO: 146947 - RNA, 18 nt, Artificial Sequence
  Description of Artificial Sequence: Synthetic oligonucleotide
agucuguguacacuauuu

SEQ ID NO: 146948 - RNA, 18 nt, Artificial Sequence
  Description of Artificial Sequence: Synthetic oligonucleotide
ucgucagucuguguacac

SEQ ID NO: 146949 - RNA, 18 nt, Artificial Sequence
  Description of Artificial Sequence: Synthetic oligonucleotide
aaguuucgucagucugug

SEQ ID NO: 146950 - RNA, 18 nt, Artificial Sequence
  Description of Artificial Sequence: Synthetic oligonucleotide
auuuaaaguuucgucagu

SEQ ID NO: 146951 - RNA, 18 nt, Artificial Sequence
  Description of Artificial Sequence: Synthetic oligonucleotide
cauuuauuuaaaguuucg

SEQ ID NO: 146952 - RNA, 18 nt, Artificial Sequence
  Description of Artificial Sequence: Synthetic oligonucleotide
auucccauuuauuuaaag

SEQ ID NO: 146953 - RNA, 18 nt, Artificial Sequence
  Description of Artificial Sequence: Synthetic oligonucleotide
auuuaauucccauuuauu

SEQ ID NO: 146954 - RNA, 18 nt, Artificial Sequence
  Description of Artificial Sequence: Synthetic oligonucleotide
uaaauauuuaauucccau

SEQ ID NO: 146955 - RNA, 18 nt, Artificial Sequence
  Description of Artificial Sequence: Synthetic oligonucleotide
gcucuuaaauauuuaauu

SEQ ID NO: 146956 - RNA, 18 nt, Artificial Sequence
  Description of Artificial Sequence: Synthetic oligonucleotide
agucagcucuuaaauauu

SEQ ID NO: 146957 - RNA, 18 nt, Artificial Sequence
  Description of Artificial Sequence: Synthetic oligonucleotide
ccucucaaacucaacuuc

SEQ ID NO: 146958 - RNA, 18 nt, Artificial Sequence
  Description of Artificial Sequence: Synthetic oligonucleotide
ugucgccucucaaacuca

SEQ ID NO: 146959 - RNA, 18 nt, Artificial Sequence
  Description of Artificial Sequence: Synthetic oligonucleotide
cgccgugucgccucucaa

SEQ ID NO: 146960 - RNA, 18 nt, Artificial Sequence
  Description of Artificial Sequence: Synthetic oligonucleotide
gccgccgccgugucgccu

SEQ ID NO: 146961 - RNA, 18 nt, Artificial Sequence
  Description of Artificial Sequence: Synthetic oligonucleotide
cggccgccgccgccgugu

SEQ ID NO: 146962 - RNA, 18 nt, Artificial Sequence
  Description of Artificial Sequence: Synthetic oligonucleotide
cagcgcggccgccgccgc

SEQ ID NO: 146963 - RNA, 18 nt, Artificial Sequence
  Description of Artificial Sequence: Synthetic oligonucleotide
gggagcagcgcggccgcc

SEQ ID NO: 146964 - RNA, 18 nt, Artificial Sequence
  Description of Artificial Sequence: Synthetic oligonucleotide
ggagcgggagcagcgcgg

SEQ ID NO: 146965 - RNA, 18 nt, Artificial Sequence
  Description of Artificial Sequence: Synthetic oligonucleotide
gcagaggagcgggagcag

SEQ ID NO: 146966 - RNA, 18 nt, Artificial Sequence
  Description of Artificial Sequence: Synthetic oligonucleotide
gggaggcagaggagcggg

SEQ ID NO: 146967 - RNA, 18 nt, Artificial Sequence
  Description of Artificial Sequence: Synthetic oligonucleotide
gcagugcauauccauggg

SEQ ID NO: 146968 - RNA, 18 nt, Artificial Sequence
  Description of Artificial Sequence: Synthetic oligonucleotide
ugcagugcauauccaugg

SEQ ID NO: 146969 - RNA, 18 nt, Artificial Sequence
  Description of Artificial Sequence: Synthetic oligonucleotide
ugcuuugcagugcauauc

SEQ ID NO: 146970 - RNA, 18 nt, Artificial Sequence
  Description of Artificial Sequence: Synthetic oligonucleotide
gggucugcuuugcagugc

SEQ ID NO: 146971 - RNA, 18 nt, Artificial Sequence
  Description of Artificial Sequence: Synthetic oligonucleotide
gugcaucgcggagaaggg

SEQ ID NO: 146972 - RNA, 18 nt, Artificial Sequence
  Description of Artificial Sequence: Synthetic oligonucleotide
aggagccgggcgccggua

SEQ ID NO: 146973 - RNA, 18 nt, Artificial Sequence
  Description of Artificial Sequence: Synthetic oligonucleotide
gggacaggagccgggcgc

SEQ ID NO: 146974 - RNA, 18 nt, Artificial Sequence
  Description of Artificial Sequence: Synthetic oligonucleotide
gagccgggacaggagccg

SEQ ID NO: 146975 - RNA, 18 nt, Artificial Sequence
  Description of Artificial Sequence: Synthetic oligonucleotide
gccccgagccgggacagg

SEQ ID NO: 146976 - RNA, 18 nt, Artificial Sequence
  Description of Artificial Sequence: Synthetic oligonucleotide
ggagagccccgagccggg

SEQ ID NO: 146977 - RNA, 18 nt, Artificial Sequence
  Description of Artificial Sequence: Synthetic oligonucleotide
gggacggagagccccgag

SEQ ID NO: 146978 - RNA, 18 nt, Artificial Sequence
  Description of Artificial Sequence: Synthetic oligonucleotide
ggguugggacggagagcc

SEQ ID NO: 146979 - RNA, 18 nt, Artificial Sequence
  Description of Artificial Sequence: Synthetic oligonucleotide
ggacaggguugggacgga

SEQ ID NO: 146980 - RNA, 18 nt, Artificial Sequence
  Description of Artificial Sequence: Synthetic oligonucleotide
ggacuggacaggguuggg

SEQ ID NO: 146981 - RNA, 18 nt, Artificial Sequence
  Description of Artificial Sequence: Synthetic oligonucleotide
cgcugggacuggacaggg

SEQ ID NO: 146982 - RNA, 18 nt, Artificial Sequence
  Description of Artificial Sequence: Synthetic oligonucleotide
ggccacgcugggacugga

SEQ ID NO: 146983 - RNA, 18 nt, Artificial Sequence
  Description of Artificial Sequence: Synthetic oligonucleotide
gggccacgcugggacugg

SEQ ID NO: 146984 - RNA, 18 nt, Artificial Sequence
  Description of Artificial Sequence: Synthetic oligonucleotide
gggaccugagcgcgaggg

SEQ ID NO: 146985 - RNA, 18 nt, Artificial Sequence
  Description of Artificial Sequence: Synthetic oligonucleotide
aagaugggaccugagcgc

SEQ ID NO: 146986 - RNA, 18 nt, Artificial Sequence
  Description of Artificial Sequence: Synthetic oligonucleotide
ccuccaagaugggaccug

SEQ ID NO: 146987 - RNA, 18 nt, Artificial Sequence
  Description of Artificial Sequence: Synthetic oligonucleotide
ggaggccuccaagauggg

SEQ ID NO: 146988 - RNA, 18 nt, Artificial Sequence
  Description of Artificial Sequence: Synthetic oligonucleotide
gccagggaggccuccaag

SEQ ID NO: 146989 - RNA, 18 nt, Artificial Sequence
  Description of Artificial Sequence: Synthetic oligonucleotide
cagaagccagggaggccu

SEQ ID NO: 146990 - RNA, 18 nt, Artificial Sequence
  Description of Artificial Sequence: Synthetic oligonucleotide
gggaccagaagccaggga

SEQ ID NO: 146991 - RNA, 18 nt, Artificial Sequence
  Description of Artificial Sequence: Synthetic oligonucleotide
aaagagggaccagaagcc

SEQ ID NO: 146992 - RNA, 18 nt, Artificial Sequence
  Description of Artificial Sequence: Synthetic oligonucleotide
aacgaaaagagggaccag

SEQ ID NO: 146993 - RNA, 18 nt, Artificial Sequence
  Description of Artificial Sequence: Synthetic oligonucleotide
gaaagaacgaaaagaggg

SEQ ID NO: 146994 - RNA, 18 nt, Artificial Sequence
  Description of Artificial Sequence: Synthetic oligonucleotide
ggagagaaagaacgaaaa

SEQ ID NO: 146995 - RNA, 18 nt, Artificial Sequence
  Description of Artificial Sequence: Synthetic oligonucleotide
gcgagggagagaaagaac

SEQ ID NO: 146996 - RNA, 18 nt, Artificial Sequence
  Description of Artificial Sequence: Synthetic oligonucleotide
accgggcgagggagagaa

SEQ ID NO: 146997 - RNA, 18 nt, Artificial Sequence
  Description of Artificial Sequence: Synthetic oligonucleotide
gaaacaccgggcgaggga

SEQ ID NO: 146998 - RNA, 18 nt, Artificial Sequence
  Description of Artificial Sequence: Synthetic oligonucleotide
cauuagaaacaccgggcg

SEQ ID NO: 146999 - RNA, 18 nt, Artificial Sequence
  Description of Artificial Sequence: Synthetic oligonucleotide
ggaggcauuagaaacacc

SEQ ID NO: 147000 - RNA, 18 nt, Artificial Sequence
  Description of Artificial Sequence: Synthetic oligonucleotide
aaacuggaggcauuagaa

SEQ ID NO: 147001 - RNA, 18 nt, Artificial Sequence
  Description of Artificial Sequence: Synthetic oligonucleotide
gagagaaacuggaggcau

SEQ ID NO: 147002 - RNA, 18 nt, Artificial Sequence
  Description of Artificial Sequence: Synthetic oligonucleotide
ggcaggagagaaacugga

SEQ ID NO: 147003 - RNA, 18 nt, Artificial Sequence
  Description of Artificial Sequence: Synthetic oligonucleotide
cagaaggcaggagagaaa

SEQ ID NO: 147004 - RNA, 18 nt, Artificial Sequence
  Description of Artificial Sequence: Synthetic oligonucleotide
ggugacagaaggcaggag

SEQ ID NO: 147005 - RNA, 18 nt, Artificial Sequence
  Description of Artificial Sequence: Synthetic oligonucleotide
gaaugggugacagaaggc

SEQ ID NO: 147006 - RNA, 18 nt, Artificial Sequence
  Description of Artificial Sequence: Synthetic oligonucleotide
gguaagaaugggugacag

SEQ ID NO: 147007 - RNA, 18 nt, Artificial Sequence
  Description of Artificial Sequence: Synthetic oligonucleotide
agagagguaagaaugggu

SEQ ID NO: 147008 - RNA, 18 nt, Artificial Sequence
  Description of Artificial Sequence: Synthetic oligonucleotide
cagacagagagguaagaa

SEQ ID NO: 147009 - RNA, 18 nt, Artificial Sequence
  Description of Artificial Sequence: Synthetic oligonucleotide
gcaggcagacagagaggu

SEQ ID NO: 147010 - RNA, 18 nt, Artificial Sequence
  Description of Artificial Sequence: Synthetic oligonucleotide
ggaaggcaggcagacaga

SEQ ID NO: 147011 - RNA, 18 nt, Artificial Sequence
  Description of Artificial Sequence: Synthetic oligonucleotide
agguaggaaggcaggcag

SEQ ID NO: 147012 - RNA, 18 nt, Artificial Sequence
  Description of Artificial Sequence: Synthetic oligonucleotide
agggaagguaggaaggca

SEQ ID NO: 147013 - RNA, 18 nt, Artificial Sequence
  Description of Artificial Sequence: Synthetic oligonucleotide
ggaucagggaagguagga

SEQ ID NO: 147014 - RNA, 18 nt, Artificial Sequence
  Description of Artificial Sequence: Synthetic oligonucleotide
gauagggaucagggaagg

SEQ ID NO: 147015 - RNA, 18 nt, Artificial Sequence
  Description of Artificial Sequence: Synthetic oligonucleotide
caggugauagggaucagg

SEQ ID NO: 147016 - RNA, 18 nt, Artificial Sequence
  Description of Artificial Sequence: Synthetic oligonucleotide
aaaggcaggugauaggga

SEQ ID NO: 147017 - RNA, 18 nt, Artificial Sequence
  Description of Artificial Sequence: Synthetic oligonucleotide
agagcaaaggcaggugau

SEQ ID NO: 147018 - RNA, 18 nt, Artificial Sequence
  Description of Artificial Sequence: Synthetic oligonucleotide
uagaaagagcaaaggcag

SEQ ID NO: 147019 - RNA, 18 nt, Artificial Sequence
  Description of Artificial Sequence: Synthetic oligonucleotide
gcggauagaaagagcaaa

SEQ ID NO: 147020 - RNA, 18 nt, Artificial Sequence
  Description of Artificial Sequence: Synthetic oligonucleotide
aaggagcggauagaaaga

SEQ ID NO: 147021 - RNA, 18 nt, Artificial Sequence
  Description of Artificial Sequence: Synthetic oligonucleotide
cuaagaaggagcggauag

SEQ ID NO: 147022 - RNA, 18 nt, Artificial Sequence
  Description of Artificial Sequence: Synthetic oligonucleotide
augaccuaagaaggagcg

SEQ ID NO: 147023 - RNA, 18 nt, Artificial Sequence
  Description of Artificial Sequence: Synthetic oligonucleotide
aucccaugaccuaagaag

SEQ ID NO: 147024 - RNA, 18 nt, Artificial Sequence
  Description of Artificial Sequence: Synthetic oligonucleotide
cguggaucccaugaccua

SEQ ID NO: 147025 - RNA, 18 nt, Artificial Sequence
  Description of Artificial Sequence: Synthetic oligonucleotide
gaggccguggaucccaug

SEQ ID NO: 147026 - RNA, 18 nt, Artificial Sequence
  Description of Artificial Sequence: Synthetic oligonucleotide
gcuccgaggccguggauc

SEQ ID NO: 147027 - RNA, 18 nt, Artificial Sequence
  Description of Artificial Sequence: Synthetic oligonucleotide
ccagggcuccgaggccgu

SEQ ID NO: 147028 - RNA, 18 nt, Artificial Sequence
  Description of Artificial Sequence: Synthetic oligonucleotide
uggaaccagggcuccgag

SEQ ID NO: 147029 - RNA, 18 nt, Artificial Sequence
  Description of Artificial Sequence: Synthetic oligonucleotide
guggcuggaaccagggcu

SEQ ID NO: 147030 - RNA, 18 nt, Artificial Sequence
  Description of Artificial Sequence: Synthetic oligonucleotide
agaggguggcuggaacca

SEQ ID NO: 147031 - RNA, 18 nt, Artificial Sequence
  Description of Artificial Sequence: Synthetic oligonucleotide
uagggagaggguggcugg

SEQ ID NO: 147032 - RNA, 18 nt, Artificial Sequence
  Description of Artificial Sequence: Synthetic oligonucleotide
cugacuagggagagggug

SEQ ID NO: 147033 - RNA, 18 nt, Artificial Sequence
  Description of Artificial Sequence: Synthetic oligonucleotide
agaggcugacuagggaga

SEQ ID NO: 147034 - RNA, 18 nt, Artificial Sequence
  Description of Artificial Sequence: Synthetic oligonucleotide
gggcaagaggcugacuag

SEQ ID NO: 147035 - RNA, 18 nt, Artificial Sequence
  Description of Artificial Sequence: Synthetic oligonucleotide
gcccagggcaagaggcug

SEQ ID NO: 147036 - RNA, 18 nt, Artificial Sequence
  Description of Artificial Sequence: Synthetic oligonucleotide
ccccagcccagggcaaga

SEQ ID NO: 147037 - RNA, 18 nt, Artificial Sequence
  Description of Artificial Sequence: Synthetic oligonucleotide
uugccccccagcccaggg

SEQ ID NO: 147038 - RNA, 18 nt, Artificial Sequence
  Description of Artificial Sequence: Synthetic oligonucleotide
cuaauuugccccccagcc

SEQ ID NO: 147039 - RNA, 18 nt, Artificial Sequence
  Description of Artificial Sequence: Synthetic oligonucleotide
gccugcuaauuugccccc

SEQ ID NO: 147040 - RNA, 18 nt, Artificial Sequence
  Description of Artificial Sequence: Synthetic oligonucleotide
aaacugccugcuaauuug

SEQ ID NO: 147041 - RNA, 18 nt, Artificial Sequence
  Description of Artificial Sequence: Synthetic oligonucleotide
ccugaaaacugccugcua

SEQ ID NO: 147042 - RNA, 18 nt, Artificial Sequence
  Description of Artificial Sequence: Synthetic oligonucleotide
aacacccugaaaacugcc

SEQ ID NO: 147043 - RNA, 18 nt, Artificial Sequence
  Description of Artificial Sequence: Synthetic oligonucleotide
aaaacaacacccugaaaa

SEQ ID NO: 147044 - RNA, 18 nt, Artificial Sequence
  Description of Artificial Sequence: Synthetic oligonucleotide
acaacaaaacaacacccu

SEQ ID NO: 147045 - RNA, 18 nt, Artificial Sequence
  Description of Artificial Sequence: Synthetic oligonucleotide
agaaaacaacaaaacaac

SEQ ID NO: 147046 - RNA, 18 nt, Artificial Sequence
  Description of Artificial Sequence: Synthetic oligonucleotide
gacagagaaaacaacaaa

SEQ ID NO: 147047 - RNA, 18 nt, Artificial Sequence
  Description of Artificial Sequence: Synthetic oligonucleotide
gaaaagacagagaaaaca

SEQ ID NO: 147048 - RNA, 18 nt, Artificial Sequence
  Description of Artificial Sequence: Synthetic oligonucleotide
agagagaaaagacagaga

SEQ ID NO: 147049 - RNA, 18 nt, Artificial Sequence
  Description of Artificial Sequence: Synthetic oligonucleotide
gagaaagagagaaaagac

SEQ ID NO: 147050 - RNA, 18 nt, Artificial Sequence
  Description of Artificial Sequence: Synthetic oligonucleotide
gaagagagaaagagagaa

SEQ ID NO: 147051 - RNA, 18 nt, Artificial Sequence
  Description of Artificial Sequence: Synthetic oligonucleotide
cagaggaagagagaaaga

SEQ ID NO: 147052 - RNA, 18 nt, Artificial Sequence
  Description of Artificial Sequence: Synthetic oligonucleotide
gcaaacagaggaagagag

SEQ ID NO: 147053 - RNA, 18 nt, Artificial Sequence
  Description of Artificial Sequence: Synthetic oligonucleotide
gggaggcaaacagaggaa

SEQ ID NO: 147054 - RNA, 18 nt, Artificial Sequence
  Description of Artificial Sequence: Synthetic oligonucleotide
ggagagggaggcaaacag

SEQ ID NO: 147055 - RNA, 18 nt, Artificial Sequence
  Description of Artificial Sequence: Synthetic oligonucleotide
agacaggagagggaggca

SEQ ID NO: 147056 - RNA, 18 nt, Artificial Sequence
  Description of Artificial Sequence: Synthetic oligonucleotide
gggagacaggagagggag

SEQ ID NO: 147057 - RNA, 18 nt, Artificial Sequence
  Description of Artificial Sequence: Synthetic oligonucleotide
gaaagauaaagauguggg

SEQ ID NO: 147058 - RNA, 18 nt, Artificial Sequence
  Description of Artificial Sequence: Synthetic oligonucleotide
uuugagaaagauaaagau

SEQ ID NO: 147059 - RNA, 18 nt, Artificial Sequence
  Description of Artificial Sequence: Synthetic oligonucleotide
uuaaguuugagaaagaua

SEQ ID NO: 147060 - RNA, 18 nt, Artificial Sequence
  Description of Artificial Sequence: Synthetic oligonucleotide
gacucuuaaguuugagaa

SEQ ID NO: 147061 - RNA, 18 nt, Artificial Sequence
  Description of Artificial Sequence: Synthetic oligonucleotide
cccacgacucuuaaguuu

SEQ ID NO: 147062 - RNA, 18 nt, Artificial Sequence
  Description of Artificial Sequence: Synthetic oligonucleotide
uggaccccacgacucuua

SEQ ID NO: 147063 - RNA, 18 nt, Artificial Sequence
  Description of Artificial Sequence: Synthetic oligonucleotide
ucuccuggaccccacgac

SEQ ID NO: 147064 - RNA, 18 nt, Artificial Sequence
  Description of Artificial Sequence: Synthetic oligonucleotide
uggagucuccuggacccc

SEQ ID NO: 147065 - RNA, 18 nt, Artificial Sequence
  Description of Artificial Sequence: Synthetic oligonucleotide
acucuuggagucuccugg

SEQ ID NO: 147066 - RNA, 18 nt, Artificial Sequence
  Description of Artificial Sequence: Synthetic oligonucleotide
ugaauacucuuggagucu

SEQ ID NO: 147067 - RNA, 18 nt, Artificial Sequence
  Description of Artificial Sequence: Synthetic oligonucleotide
cuccuagcacagacaggg

SEQ ID NO: 147068 - RNA, 18 nt, Artificial Sequence
  Description of Artificial Sequence: Synthetic oligonucleotide
gagcuccuagcacagaca

SEQ ID NO: 147069 - RNA, 18 nt, Artificial Sequence
  Description of Artificial Sequence: Synthetic oligonucleotide
uauccgagcuccuagcac

SEQ ID NO: 147070 - RNA, 18 nt, Artificial Sequence
  Description of Artificial Sequence: Synthetic oligonucleotide
cuguuuauccgagcuccu

SEQ ID NO: 147071 - RNA, 18 nt, Artificial Sequence
  Description of Artificial Sequence: Synthetic oligonucleotide
gcugacuguuuauccgag

SEQ ID NO: 147072 - RNA, 18 nt, Artificial Sequence
  Description of Artificial Sequence: Synthetic oligonucleotide
gcucggcugacuguuuau

SEQ ID NO: 147073 - RNA, 18 nt, Artificial Sequence
  Description of Artificial Sequence: Synthetic oligonucleotide
ucgaggcucggcugacug

SEQ ID NO: 147074 - RNA, 18 nt, Artificial Sequence
  Description of Artificial Sequence: Synthetic oligonucleotide
gggcgucgaggcucggcu

SEQ ID NO: 147075 - RNA, 18 nt, Artificial Sequence
  Description of Artificial Sequence: Synthetic oligonucleotide
ggaggcggacgauuuggg

SEQ ID NO: 147076 - RNA, 18 nt, Artificial Sequence
  Description of Artificial Sequence: Synthetic oligonucleotide
uuggaggcggacgauuug

SEQ ID NO: 147077 - RNA, 18 nt, Artificial Sequence
  Description of Artificial Sequence: Synthetic oligonucleotide
gcuguccgcgcgugcggg

SEQ ID NO: 147078 - RNA, 18 nt, Artificial Sequence
  Description of Artificial Sequence: Synthetic oligonucleotide
cgggagcuguccgcgcgu

SEQ ID NO: 147079 - RNA, 18 nt, Artificial Sequence
  Description of Artificial Sequence: Synthetic oligonucleotide
caacccgggagcuguccg

SEQ ID NO: 147080 - RNA, 18 nt, Artificial Sequence
  Description of Artificial Sequence: Synthetic oligonucleotide
gcaggcaacccgggagcu

SEQ ID NO: 147081 - RNA, 18 nt, Artificial Sequence
  Description of Artificial Sequence: Synthetic oligonucleotide
gcgccgcaggcaacccgg

SEQ ID NO: 147082 - RNA, 18 nt, Artificial Sequence
  Description of Artificial Sequence: Synthetic oligonucleotide
cgccugcgccgcaggcaa

SEQ ID NO: 147083 - RNA, 18 nt, Artificial Sequence
  Description of Artificial Sequence: Synthetic oligonucleotide
caucccgccugcgccgca

SEQ ID NO: 147084 - RNA, 18 nt, Artificial Sequence
  Description of Artificial Sequence: Synthetic oligonucleotide
agcagcaucccgccugcg

SEQ ID NO: 147085 - RNA, 18 nt, Artificial Sequence
  Description of Artificial Sequence: Synthetic oligonucleotide
ugcgaagcagcaucccgc

SEQ ID NO: 147086 - RNA, 18 nt, Artificial Sequence
  Description of Artificial Sequence: Synthetic oligonucleotide
acuagugcgaagcagcau

SEQ ID NO: 147087 - RNA, 18 nt, Artificial Sequence
  Description of Artificial Sequence: Synthetic oligonucleotide
acuggacuagugcgaagc

SEQ ID NO: 147088 - RNA, 18 nt, Artificial Sequence
  Description of Artificial Sequence: Synthetic oligonucleotide
agaggacuggacuagugc

SEQ ID NO: 147089 - RNA, 18 nt, Artificial Sequence
  Description of Artificial Sequence: Synthetic oligonucleotide
cuggcagaggacuggacu

SEQ ID NO: 147090 - RNA, 18 nt, Artificial Sequence
  Description of Artificial Sequence: Synthetic oligonucleotide
agggccuggcagaggacu

SEQ ID NO: 147091 - RNA, 18 nt, Artificial Sequence
  Description of Artificial Sequence: Synthetic oligonucleotide
gaggaagggccuggcaga

SEQ ID NO: 147092 - RNA, 18 nt, Artificial Sequence
  Description of Artificial Sequence: Synthetic oligonucleotide
gaggagaggaagggccug

SEQ ID NO: 147093 - RNA, 18 nt, Artificial Sequence
  Description of Artificial Sequence: Synthetic oligonucleotide
aaagcgaggagaggaagg

SEQ ID NO: 147094 - RNA, 18 nt, Artificial Sequence
  Description of Artificial Sequence: Synthetic oligonucleotide
guaagaaagcgaggagag

SEQ ID NO: 147095 - RNA, 18 nt, Artificial Sequence
  Description of Artificial Sequence: Synthetic oligonucleotide
agggcguaagaaagcgag

SEQ ID NO: 147096 - RNA, 18 nt, Artificial Sequence
  Description of Artificial Sequence: Synthetic oligonucleotide
cggaaagggcguaagaaa

SEQ ID NO: 147097 - RNA, 18 nt, Artificial Sequence
  Description of Artificial Sequence: Synthetic oligonucleotide
gccagcggaaagggcgua

SEQ ID NO: 147098 - RNA, 18 nt, Artificial Sequence
  Description of Artificial Sequence: Synthetic oligonucleotide
uucaugccagcggaaagg

SEQ ID NO: 147099 - RNA, 18 nt, Artificial Sequence
  Description of Artificial Sequence: Synthetic oligonucleotide
gggaauucaugccagcgg

SEQ ID NO: 147100 - RNA, 18 nt, Artificial Sequence
  Description of Artificial Sequence: Synthetic oligonucleotide
ggagaaaaugccaaaggg

SEQ ID NO: 147101 - RNA, 18 nt, Artificial Sequence
  Description of Artificial Sequence: Synthetic oligonucleotide
gggagaaaaugccaaagg

SEQ ID NO: 147102 - RNA, 18 nt, Artificial Sequence
  Description of Artificial Sequence: Synthetic oligonucleotide
agaugacagaaaagaggg

SEQ ID NO: 147103 - RNA, 18 nt, Artificial Sequence
  Description of Artificial Sequence: Synthetic oligonucleotide
ccagaugacagaaaagag

SEQ ID NO: 147104 - RNA, 18 nt, Artificial Sequence
  Description of Artificial Sequence: Synthetic oligonucleotide
agaaaccagaugacagaa

SEQ ID NO: 147105 - RNA, 18 nt, Artificial Sequence
  Description of Artificial Sequence: Synthetic oligonucleotide
uggagagaaaccagauga

SEQ ID NO: 147106 - RNA, 18 nt, Artificial Sequence
  Description of Artificial Sequence: Synthetic oligonucleotide
gggacuggagagaaacca

SEQ ID NO: 147107 - RNA, 18 nt, Artificial Sequence
  Description of Artificial Sequence: Synthetic oligonucleotide
aagguagaaagcaaaggg

SEQ ID NO: 147108 - RNA, 18 nt, Artificial Sequence
  Description of Artificial Sequence: Synthetic oligonucleotide
caagguagaaagcaaagg

SEQ ID NO: 147109 - RNA, 18 nt, Artificial Sequence
  Description of Artificial Sequence: Synthetic oligonucleotide
cgacgcaagguagaaagc

SEQ ID NO: 147110 - RNA, 18 nt, Artificial Sequence
  Description of Artificial Sequence: Synthetic oligonucleotide
ccuugcgacgcaagguag

SEQ ID NO: 147111 - RNA, 18 nt, Artificial Sequence
  Description of Artificial Sequence: Synthetic oligonucleotide
ucaggccuugcgacgcaa

SEQ ID NO: 147112 - RNA, 18 nt, Artificial Sequence
  Description of Artificial Sequence: Synthetic oligonucleotide
gcgacucaggccuugcga

SEQ ID NO: 147113 - RNA, 18 nt, Artificial Sequence
  Description of Artificial Sequence: Synthetic oligonucleotide
agagggcgacucaggccu

SEQ ID NO: 147114 - RNA, 18 nt, Artificial Sequence
  Description of Artificial Sequence: Synthetic oligonucleotide
gggcgagagggcgacuca

SEQ ID NO: 147115 - RNA, 18 nt, Artificial Sequence
  Description of Artificial Sequence: Synthetic oligonucleotide
gggcugggcgagagggcg

SEQ ID NO: 147116 - RNA, 18 nt, Artificial Sequence
  Description of Artificial Sequence: Synthetic oligonucleotide
gcugggcugaagacuggg

SEQ ID NO: 147117 - RNA, 18 nt, Artificial Sequence
  Description of Artificial Sequence: Synthetic oligonucleotide
gacgcugggcugaagacu

SEQ ID NO: 147118 - RNA, 18 nt, Artificial Sequence
  Description of Artificial Sequence: Synthetic oligonucleotide
gcacagacgcugggcuga

SEQ ID NO: 147119 - RNA, 18 nt, Artificial Sequence
  Description of Artificial Sequence: Synthetic oligonucleotide
uggaagcacagacgcugg

SEQ ID NO: 147120 - RNA, 18 nt, Artificial Sequence
  Description of Artificial Sequence: Synthetic oligonucleotide
gggacuggaagcacagac

SEQ ID NO: 147121 - RNA, 18 nt, Artificial Sequence
  Description of Artificial Sequence: Synthetic oligonucleotide
accacgcggaggaguggg

SEQ ID NO: 147122 - RNA, 18 nt, Artificial Sequence
  Description of Artificial Sequence: Synthetic oligonucleotide
cacgaccacgcggaggag

SEQ ID NO: 147123 - RNA, 18 nt, Artificial Sequence
  Description of Artificial Sequence: Synthetic oligonucleotide
accuccacgaccacgcgg

SEQ ID NO: 147124 - RNA, 18 nt, Artificial Sequence
  Description of Artificial Sequence: Synthetic oligonucleotide
gguggaccuccacgacca

SEQ ID NO: 147125 - RNA, 18 nt, Artificial Sequence
  Description of Artificial Sequence: Synthetic oligonucleotide
aaggugguggaccuccac

SEQ ID NO: 147126 - RNA, 18 nt, Artificial Sequence
  Description of Artificial Sequence: Synthetic oligonucleotide
gaagaaaggugguggacc

SEQ ID NO: 147127 - RNA, 18 nt, Artificial Sequence
  Description of Artificial Sequence: Synthetic oligonucleotide
cuugagaagaaagguggu

SEQ ID NO: 147128 - RNA, 18 nt, Artificial Sequence
  Description of Artificial Sequence: Synthetic oligonucleotide
ccgagcuugagaagaaag

SEQ ID NO: 147129 - RNA, 18 nt, Artificial Sequence
  Description of Artificial Sequence: Synthetic oligonucleotide
uguucccgagcuugagaa

SEQ ID NO: 147130 - RNA, 18 nt, Artificial Sequence
  Description of Artificial Sequence: Synthetic oligonucleotide
gggcauguucccgagcuu

SEQ ID NO: 147131 - RNA, 18 nt, Artificial Sequence
  Description of Artificial Sequence: Synthetic oligonucleotide
cggaagggcauguucccg

SEQ ID NO: 147132 - RNA, 18 nt, Artificial Sequence
  Description of Artificial Sequence: Synthetic oligonucleotide
cagggcggaagggcaugu

SEQ ID NO: 147133 - RNA, 18 nt, Artificial Sequence
  Description of Artificial Sequence: Synthetic oligonucleotide
gcaggcagggcggaaggg

SEQ ID NO: 147134 - RNA, 18 nt, Artificial Sequence
  Description of Artificial Sequence: Synthetic oligonucleotide
aggaagcaggcagggcgg

SEQ ID NO: 147135 - RNA, 18 nt, Artificial Sequence
  Description of Artificial Sequence: Synthetic oligonucleotide
ggcgaaggaagcaggcag

SEQ ID NO: 147136 - RNA, 18 nt, Artificial Sequence
  Description of Artificial Sequence: Synthetic oligonucleotide
ggacgggcgaaggaagca

SEQ ID NO: 147137 - RNA, 18 nt, Artificial Sequence
  Description of Artificial Sequence: Synthetic oligonucleotide
gcccgggacgggcgaagg

SEQ ID NO: 147138 - RNA, 18 nt, Artificial Sequence
  Description of Artificial Sequence: Synthetic oligonucleotide
ccgcggcccgggacgggc

SEQ ID NO: 147139 - RNA, 18 nt, Artificial Sequence
  Description of Artificial Sequence: Synthetic oligonucleotide
aggguccgcggcccggga

SEQ ID NO: 147140 - RNA, 18 nt, Artificial Sequence
  Description of Artificial Sequence: Synthetic oligonucleotide
uagucaggguccgcggcc

SEQ ID NO: 147141 - RNA, 18 nt, Artificial Sequence
  Description of Artificial Sequence: Synthetic oligonucleotide
gccauuagucaggguccg

SEQ ID NO: 147142 - RNA, 18 nt, Artificial Sequence
  Description of Artificial Sequence: Synthetic oligonucleotide
gaccggccauuagucagg

SEQ ID NO: 147143 - RNA, 18 nt, Artificial Sequence
  Description of Artificial Sequence: Synthetic oligonucleotide
gcagggaccggccauuag

SEQ ID NO: 147144 - RNA, 18 nt, Artificial Sequence
  Description of Artificial Sequence: Synthetic oligonucleotide
acacagcagggaccggcc

SEQ ID NO: 147145 - RNA, 18 nt, Artificial Sequence
  Description of Artificial Sequence: Synthetic oligonucleotide
cccacacacagcagggac

SEQ ID NO: 147146 - RNA, 18 nt, Artificial Sequence
  Description of Artificial Sequence: Synthetic oligonucleotide
aacaccccacacacagca

SEQ ID NO: 147147 - RNA, 18 nt, Artificial Sequence
  Description of Artificial Sequence: Synthetic oligonucleotide
aacacaacaccccacaca

SEQ ID NO: 147148 - RNA, 18 nt, Artificial Sequence
  Description of Artificial Sequence: Synthetic oligonucleotide
aaaaaaacacaacacccc

SEQ ID NO: 147149 - RNA, 18 nt, Artificial Sequence
  Description of Artificial Sequence: Synthetic oligonucleotide
uucacacccccgugcccu

SEQ ID NO: 147150 - RNA, 18 nt, Artificial Sequence
  Description of Artificial Sequence: Synthetic oligonucleotide
gcugguucacacccccgu

SEQ ID NO: 147151 - RNA, 18 nt, Artificial Sequence
  Description of Artificial Sequence: Synthetic oligonucleotide
cccgagcugguucacacc

SEQ ID NO: 147152 - RNA, 18 nt, Artificial Sequence
  Description of Artificial Sequence: Synthetic oligonucleotide
acccccccgagcugguuc

SEQ ID NO: 147153 - RNA, 18 nt, Artificial Sequence
  Description of Artificial Sequence: Synthetic oligonucleotide
caaacacccccccgagcu

SEQ ID NO: 147154 - RNA, 18 nt, Artificial Sequence
  Description of Artificial Sequence: Synthetic oligonucleotide
guucacaaacaccccccc

SEQ ID NO: 147155 - RNA, 18 nt, Artificial Sequence
  Description of Artificial Sequence: Synthetic oligonucleotide
cggccguucacaaacacc

SEQ ID NO: 147156 - RNA, 18 nt, Artificial Sequence
  Description of Artificial Sequence: Synthetic oligonucleotide
gggccggccguucacaaa

SEQ ID NO: 147157 - RNA, 18 nt, Artificial Sequence
  Description of Artificial Sequence: Synthetic oligonucleotide
ucaccacgucggguaggg

SEQ ID NO: 147158 - RNA, 18 nt, Artificial Sequence
  Description of Artificial Sequence: Synthetic oligonucleotide
cugccucaccacgucggg

SEQ ID NO: 147159 - RNA, 18 nt, Artificial Sequence
  Description of Artificial Sequence: Synthetic oligonucleotide
augcgcugccucaccacg

SEQ ID NO: 147160 - RNA, 18 nt, Artificial Sequence
  Description of Artificial Sequence: Synthetic oligonucleotide
ccacgaugcgcugccuca

SEQ ID NO: 147161 - RNA, 18 nt, Artificial Sequence
  Description of Artificial Sequence: Synthetic oligonucleotide
cagcuccacgaugcgcug

SEQ ID NO: 147162 - RNA, 18 nt, Artificial Sequence
  Description of Artificial Sequence: Synthetic oligonucleotide
ugggccagcuccacgaug

SEQ ID NO: 147163 - RNA, 18 nt, Artificial Sequence
  Description of Artificial Sequence: Synthetic oligonucleotide
ccuggugggccagcucca

SEQ ID NO: 147164 - RNA, 18 nt, Artificial Sequence
  Description of Artificial Sequence: Synthetic oligonucleotide
cacacccuggugggccag

SEQ ID NO: 147165 - RNA, 18 nt, Artificial Sequence
  Description of Artificial Sequence: Synthetic oligonucleotide
ggccgcacacccuggugg

SEQ ID NO: 147166 - RNA, 18 nt, Artificial Sequence
  Description of Artificial Sequence: Synthetic oligonucleotide
cacagggccgcacacccu

SEQ ID NO: 147167 - RNA, 18 nt, Artificial Sequence
  Description of Artificial Sequence: Synthetic oligonucleotide
gaugucacagggccgcac

SEQ ID NO: 147168 - RNA, 18 nt, Artificial Sequence
  Description of Artificial Sequence: Synthetic oligonucleotide
cgggagaugucacagggc

SEQ ID NO: 147169 - RNA, 18 nt, Artificial Sequence
  Description of Artificial Sequence: Synthetic oligonucleotide
gcugccgggagaugucac

SEQ ID NO: 147170 - RNA, 18 nt, Artificial Sequence
  Description of Artificial Sequence: Synthetic oligonucleotide
ccgcagcugccgggagau

SEQ ID NO: 147171 - RNA, 18 nt, Artificial Sequence
  Description of Artificial Sequence: Synthetic oligonucleotide
cugacccgcagcugccgg

SEQ ID NO: 147172 - RNA, 18 nt, Artificial Sequence
  Description of Artificial Sequence: Synthetic oligonucleotide
cguggcugacccgcagcu

SEQ ID NO: 147173 - RNA, 18 nt, Artificial Sequence
  Description of Artificial Sequence: Synthetic oligonucleotide
acagccguggcugacccg

SEQ ID NO: 147174 - RNA, 18 nt, Artificial Sequence
  Description of Artificial Sequence: Synthetic oligonucleotide
cugacacagccguggcug

SEQ ID NO: 147175 - RNA, 18 nt, Artificial Sequence
  Description of Artificial Sequence: Synthetic oligonucleotide
uuuugcugacacagccgu

SEQ ID NO: 147176 - RNA, 18 nt, Artificial Sequence
  Description of Artificial Sequence: Synthetic oligonucleotide
caggauuuugcugacaca

SEQ ID NO: 147177 - RNA, 18 nt, Artificial Sequence
  Description of Artificial Sequence: Synthetic oligonucleotide
cugcccaggauuuugcug

SEQ ID NO: 147178 - RNA, 18 nt, Artificial Sequence
  Description of Artificial Sequence: Synthetic oligonucleotide
cgcgcgggccaggccccc

SEQ ID NO: 147179 - RNA, 18 nt, Artificial Sequence
  Description of Artificial Sequence: Synthetic oligonucleotide
gggagcgcgcgggccagg

SEQ ID NO: 147180 - RNA, 18 nt, Artificial Sequence
  Description of Artificial Sequence: Synthetic oligonucleotide
guggcgccugcgggaggg

SEQ ID NO: 147181 - RNA, 18 nt, Artificial Sequence
  Description of Artificial Sequence: Synthetic oligonucleotide
agguggcgccugcgggag

SEQ ID NO: 147182 - RNA, 18 nt, Artificial Sequence
  Description of Artificial Sequence: Synthetic oligonucleotide
guccgagguggcgccugc

SEQ ID NO: 147183 - RNA, 18 nt, Artificial Sequence
  Description of Artificial Sequence: Synthetic oligonucleotide
gggauguccgagguggcg

SEQ ID NO: 147184 - RNA, 18 nt, Artificial Sequence
  Description of Artificial Sequence: Synthetic oligonucleotide
agaaguagcaaucccggg

SEQ ID NO: 147185 - RNA, 18 nt, Artificial Sequence
  Description of Artificial Sequence: Synthetic oligonucleotide
gagaaguagcaaucccgg

SEQ ID NO: 147186 - RNA, 18 nt, Artificial Sequence
  Description of Artificial Sequence: Synthetic oligonucleotide
uggcagagaaguagcaau

SEQ ID NO: 147187 - RNA, 18 nt, Artificial Sequence
  Description of Artificial Sequence: Synthetic oligonucleotide
gaaguuggcagagaagua

SEQ ID NO: 147188 - RNA, 18 nt, Artificial Sequence
  Description of Artificial Sequence: Synthetic oligonucleotide
uuggcgaaguuggcagag

SEQ ID NO: 147189 - RNA, 18 nt, Artificial Sequence
  Description of Artificial Sequence: Synthetic oligonucleotide
gcgaguuggcgaaguugg

SEQ ID NO: 147190 - RNA, 18 nt, Artificial Sequence
  Description of Artificial Sequence: Synthetic oligonucleotide
ugcuggcgaguuggcgaa

SEQ ID NO: 147191 - RNA, 18 nt, Artificial Sequence
  Description of Artificial Sequence: Synthetic oligonucleotide
ccaagugcuggcgaguug

SEQ ID NO: 147192 - RNA, 18 nt, Artificial Sequence
  Description of Artificial Sequence: Synthetic oligonucleotide
ccucuccaagugcuggcg

SEQ ID NO: 147193 - RNA, 18 nt, Artificial Sequence
  Description of Artificial Sequence: Synthetic oligonucleotide
ccgggccucuccaagugc

SEQ ID NO: 147194 - RNA, 18 nt, Artificial Sequence
  Description of Artificial Sequence: Synthetic oligonucleotide
gggagccgggccucucca

SEQ ID NO: 147195 - RNA, 18 nt, Artificial Sequence
  Description of Artificial Sequence: Synthetic oligonucleotide
cagagggcgccgggaggg

SEQ ID NO: 147196 - RNA, 18 nt, Artificial Sequence
  Description of Artificial Sequence: Synthetic oligonucleotide
cggucagagggcgccggg

SEQ ID NO: 147197 - RNA, 18 nt, Artificial Sequence
  Description of Artificial Sequence: Synthetic oligonucleotide
ggucggagagcgcgcggg

SEQ ID NO: 147198 - RNA, 18 nt, Artificial Sequence
  Description of Artificial Sequence: Synthetic oligonucleotide
gcgguggucggagagcgc

SEQ ID NO: 147199 - RNA, 18 nt, Artificial Sequence
  Description of Artificial Sequence: Synthetic oligonucleotide
gagaggcgguggucggag

SEQ ID NO: 147200 - RNA, 18 nt, Artificial Sequence
  Description of Artificial Sequence: Synthetic oligonucleotide
cauccgagaggcgguggu

SEQ ID NO: 147201 - RNA, 18 nt, Artificial Sequence
  Description of Artificial Sequence: Synthetic oligonucleotide
cuggucauccgagaggcg

SEQ ID NO: 147202 - RNA, 18 nt, Artificial Sequence
  Description of Artificial Sequence: Synthetic oligonucleotide
ggaaccuggucauccgag

SEQ ID NO: 147203 - RNA, 18 nt, Artificial Sequence
  Description of Artificial Sequence: Synthetic oligonucleotide
ccccuggaaccuggucau

SEQ ID NO: 147204 - RNA, 18 nt, Artificial Sequence
  Description of Artificial Sequence: Synthetic oligonucleotide
cagcuccccuggaaccug

SEQ ID NO: 147205 - RNA, 18 nt, Artificial Sequence
  Description of Artificial Sequence: Synthetic oligonucleotide
ucgcucagcuccccugga

SEQ ID NO: 147206 - RNA, 18 nt, Artificial Sequence
  Description of Artificial Sequence: Synthetic oligonucleotide
gcgacucgcucagcuccc

SEQ ID NO: 147207 - RNA, 18 nt, Artificial Sequence
  Description of Artificial Sequence: Synthetic oligonucleotide
gggaggcgacucgcucag

SEQ ID NO: 147208 - RNA, 18 nt, Artificial Sequence
  Description of Artificial Sequence: Synthetic oligonucleotide
gggcugaagcugggcggg

SEQ ID NO: 147209 - RNA, 18 nt, Artificial Sequence
  Description of Artificial Sequence: Synthetic oligonucleotide
agggcugaagcugggcgg

SEQ ID NO: 147210 - RNA, 18 nt, Artificial Sequence
  Description of Artificial Sequence: Synthetic oligonucleotide
cagccagggcugaagcug

SEQ ID NO: 147211 - RNA, 18 nt, Artificial Sequence
  Description of Artificial Sequence: Synthetic oligonucleotide
agcugcagccagggcuga

SEQ ID NO: 147212 - RNA, 18 nt, Artificial Sequence
  Description of Artificial Sequence: Synthetic oligonucleotide
gcugcagcugcagccagg

SEQ ID NO: 147213 - RNA, 18 nt, Artificial Sequence
  Description of Artificial Sequence: Synthetic oligonucleotide
cucgcgcugcagcugcag

SEQ ID NO: 147214 - RNA, 18 nt, Artificial Sequence
  Description of Artificial Sequence: Synthetic oligonucleotide
cauggcucgcgcugcagc

SEQ ID NO: 147215 - RNA, 18 nt, Artificial Sequence
  Description of Artificial Sequence: Synthetic oligonucleotide
gggcgcauggcucgcgcu

SEQ ID NO: 147216 - RNA, 18 nt, Artificial Sequence
  Description of Artificial Sequence: Synthetic oligonucleotide
gcggugggccgggccggg

SEQ ID NO: 147217 - RNA, 18 nt, Artificial Sequence
  Description of Artificial Sequence: Synthetic oligonucleotide
gggcggugggccgggccg

SEQ ID NO: 147218 - RNA, 18 nt, Artificial Sequence
  Description of Artificial Sequence: Synthetic oligonucleotide
cagcagaauggccccggg

SEQ ID NO: 147219 - RNA, 18 nt, Artificial Sequence
  Description of Artificial Sequence: Synthetic oligonucleotide
gucagcagaauggccccg

SEQ ID NO: 147220 - RNA, 18 nt, Artificial Sequence
  Description of Artificial Sequence: Synthetic oligonucleotide
gggcggucagcagaaugg

SEQ ID NO: 147221 - RNA, 18 nt, Artificial Sequence
  Description of Artificial Sequence: Synthetic oligonucleotide
gggcugggcggucagcag

SEQ ID NO: 147222 - RNA, 18 nt, Artificial Sequence
  Description of Artificial Sequence: Synthetic oligonucleotide
caacuugccacugucggg

SEQ ID NO: 147223 - RNA, 18 nt, Artificial Sequence
  Description of Artificial Sequence: Synthetic oligonucleotide
cgcaacuugccacugucg

SEQ ID NO: 147224 - RNA, 18 nt, Artificial Sequence
  Description of Artificial Sequence: Synthetic oligonucleotide
guagccgcaacuugccac

SEQ ID NO: 147225 - RNA, 18 nt, Artificial Sequence
  Description of Artificial Sequence: Synthetic oligonucleotide
cugcaguagccgcaacuu

SEQ ID NO: 147226 - RNA, 18 nt, Artificial Sequence
  Description of Artificial Sequence: Synthetic oligonucleotide
ugcaacugcaguagccgc

SEQ ID NO: 147227 - RNA, 18 nt, Artificial Sequence
  Description of Artificial Sequence: Synthetic oligonucleotide
gagcuugcaacugcagua

SEQ ID NO: 147228 - RNA, 18 nt, Artificial Sequence
  Description of Artificial Sequence: Synthetic oligonucleotide
ggccggagcuugcaacug

SEQ ID NO: 147229 - RNA, 18 nt, Artificial Sequence
  Description of Artificial Sequence: Synthetic oligonucleotide
ggguuggccggagcuugc

SEQ ID NO: 147230 - RNA, 18 nt, Artificial Sequence
  Description of Artificial Sequence: Synthetic oligonucleotide
ccuccggguuggccggag

SEQ ID NO: 147231 - RNA, 18 nt, Artificial Sequence
  Description of Artificial Sequence: Synthetic oligonucleotide
gggcuccuccggguuggc

SEQ ID NO: 147232 - RNA, 18 nt, Artificial Sequence
  Description of Artificial Sequence: Synthetic oligonucleotide
acugcgcuccccgcuggg

SEQ ID NO: 147233 - RNA, 18 nt, Artificial Sequence
  Description of Artificial Sequence: Synthetic oligonucleotide
cagcacugcgcuccccgc

SEQ ID NO: 147234 - RNA, 18 nt, Artificial Sequence
  Description of Artificial Sequence: Synthetic oligonucleotide
gggcgcagcacugcgcuc

SEQ ID NO: 147235 - RNA, 18 nt, Artificial Sequence
  Description of Artificial Sequence: Synthetic oligonucleotide
acgcccggcugcugcggg

SEQ ID NO: 147236 - RNA, 18 nt, Artificial Sequence
  Description of Artificial Sequence: Synthetic oligonucleotide
ugaacgcccggcugcugc

SEQ ID NO: 147237 - RNA, 18 nt, Artificial Sequence
  Description of Artificial Sequence: Synthetic oligonucleotide
augagugaacgcccggcu

SEQ ID NO: 147238 - RNA, 18 nt, Artificial Sequence
  Description of Artificial Sequence: Synthetic oligonucleotide
ggaggaugagugaacgcc

SEQ ID NO: 147239 - RNA, 18 nt, Artificial Sequence
  Description of Artificial Sequence: Synthetic oligonucleotide
gggagggaggaugaguga

SEQ ID NO: 147240 - RNA, 18 nt, Artificial Sequence
  Description of Artificial Sequence: Synthetic oligonucleotide
aaagggagggacgguggg

SEQ ID NO: 147241 - RNA, 18 nt, Artificial Sequence
  Description of Artificial Sequence: Synthetic oligonucleotide
gaaaagggagggacggug

SEQ ID NO: 147242 - RNA, 18 nt, Artificial Sequence
  Description of Artificial Sequence: Synthetic oligonucleotide
gaggagaaaagggaggga

SEQ ID NO: 147243 - RNA, 18 nt, Artificial Sequence
  Description of Artificial Sequence: Synthetic oligonucleotide
gacuugaggagaaaaggg

SEQ ID NO: 147244 - RNA, 18 nt, Artificial Sequence
  Description of Artificial Sequence: Synthetic oligonucleotide
uucaggacuugaggagaa

SEQ ID NO: 147245 - RNA, 18 nt, Artificial Sequence
  Description of Artificial Sequence: Synthetic oligonucleotide
ucaacuucaggacuugag

SEQ ID NO: 147246 - RNA, 18 nt, Artificial Sequence
  Description of Artificial Sequence: Synthetic oligonucleotide
caaacucaacuucaggac

SEQ ID NO: 147247 - RNA, 18 nt, Artificial Sequence
  Description of Artificial Sequence: Synthetic oligonucleotide
ccucucaaacucaacuuc

SEQ ID NO: 147248 - RNA, 18 nt, Artificial Sequence
  Description of Artificial Sequence: Synthetic oligonucleotide
ugucgccucucaaacuca

SEQ ID NO: 147249 - RNA, 18 nt, Artificial Sequence
  Description of Artificial Sequence: Synthetic oligonucleotide
cgccgugucgccucucaa

SEQ ID NO: 147250 - RNA, 18 nt, Artificial Sequence
  Description of Artificial Sequence: Synthetic oligonucleotide
gccgccgccgugucgccu

SEQ ID NO: 147251 - RNA, 18 nt, Artificial Sequence
  Description of Artificial Sequence: Synthetic oligonucleotide
cggccgccgccgccgugu

SEQ ID NO: 147252 - RNA, 18 nt, Artificial Sequence
  Description of Artificial Sequence: Synthetic oligonucleotide
cagcgcggccgccgccgc

SEQ ID NO: 147253 - RNA, 18 nt, Artificial Sequence
  Description of Artificial Sequence: Synthetic oligonucleotide
gggagcagcgcggccgcc

SEQ ID NO: 147254 - RNA, 18 nt, Artificial Sequence
  Description of Artificial Sequence: Synthetic oligonucleotide
ggagcgggagcagcgcgg

SEQ ID NO: 147255 - RNA, 18 nt, Artificial Sequence
  Description of Artificial Sequence: Synthetic oligonucleotide
gcagaggagcgggagcag

SEQ ID NO: 147256 - RNA, 18 nt, Artificial Sequence
  Description of Artificial Sequence: Synthetic oligonucleotide
gggaggcagaggagcggg

SEQ ID NO: 147257 - RNA, 18 nt, Artificial Sequence
  Description of Artificial Sequence: Synthetic oligonucleotide
gcagugcauauccauggg

SEQ ID NO: 147258 - RNA, 18 nt, Artificial Sequence
  Description of Artificial Sequence: Synthetic oligonucleotide
ugcagugcauauccaugg

SEQ ID NO: 147259 - RNA, 18 nt, Artificial Sequence
  Description of Artificial Sequence: Synthetic oligonucleotide
ugcuuugcagugcauauc

SEQ ID NO: 147260 - RNA, 18 nt, Artificial Sequence
  Description of Artificial Sequence: Synthetic oligonucleotide
gggucugcuuugcagugc

SEQ ID NO: 147261 - RNA, 18 nt, Artificial Sequence
  Description of Artificial Sequence: Synthetic oligonucleotide
gugcaucgcggagaaggg

SEQ ID NO: 147262 - RNA, 18 nt, Artificial Sequence
  Description of Artificial Sequence: Synthetic oligonucleotide
aggagccgggcgccggua

SEQ ID NO: 147263 - RNA, 18 nt, Artificial Sequence
  Description of Artificial Sequence: Synthetic oligonucleotide
gggacaggagccgggcgc

SEQ ID NO: 147264 - RNA, 18 nt, Artificial Sequence
  Description of Artificial Sequence: Synthetic oligonucleotide
gagccgggacaggagccg

SEQ ID NO: 147265 - RNA, 18 nt, Artificial Sequence
  Description of Artificial Sequence: Synthetic oligonucleotide
gccccgagccgggacagg

SEQ ID NO: 147266 - RNA, 18 nt, Artificial Sequence
  Description of Artificial Sequence: Synthetic oligonucleotide
ggagagccccgagccggg

SEQ ID NO: 147267 - RNA, 18 nt, Artificial Sequence
  Description of Artificial Sequence: Synthetic oligonucleotide
gggacggagagccccgag

SEQ ID NO: 147268 - RNA, 18 nt, Artificial Sequence
  Description of Artificial Sequence: Synthetic oligonucleotide
ggguugggacggagagcc

SEQ ID NO: 147269 - RNA, 18 nt, Artificial Sequence
  Description of Artificial Sequence: Synthetic oligonucleotide
ggacaggguugggacgga

SEQ ID NO: 147270 - RNA, 18 nt, Artificial Sequence
  Description of Artificial Sequence: Synthetic oligonucleotide
ggacuggacaggguuggg

SEQ ID NO: 147271 - RNA, 18 nt, Artificial Sequence
  Description of Artificial Sequence: Synthetic oligonucleotide
cgcugggacuggacaggg

SEQ ID NO: 147272 - RNA, 18 nt, Artificial Sequence
  Description of Artificial Sequence: Synthetic oligonucleotide
ggccacgcugggacugga

SEQ ID NO: 147273 - RNA, 18 nt, Artificial Sequence
  Description of Artificial Sequence: Synthetic oligonucleotide
gggccacgcugggacugg

SEQ ID NO: 147274 - RNA, 18 nt, Artificial Sequence
  Description of Artificial Sequence: Synthetic oligonucleotide
gggaccugagcgcgaggg

SEQ ID NO: 147275 - RNA, 18 nt, Artificial Sequence
  Description of Artificial Sequence: Synthetic oligonucleotide
aagaugggaccugagcgc

SEQ ID NO: 147276 - RNA, 18 nt, Artificial Sequence
  Description of Artificial Sequence: Synthetic oligonucleotide
ccuccaagaugggaccug

SEQ ID NO: 147277 - RNA, 18 nt, Artificial Sequence
  Description of Artificial Sequence: Synthetic oligonucleotide
ggaggccuccaagauggg

SEQ ID NO: 147278 - RNA, 18 nt, Artificial Sequence
  Description of Artificial Sequence: Synthetic oligonucleotide
gccagggaggccuccaag

SEQ ID NO: 147279 - RNA, 18 nt, Artificial Sequence
  Description of Artificial Sequence: Synthetic oligonucleotide
cagaagccagggaggccu

SEQ ID NO: 147280 - RNA, 18 nt, Artificial Sequence
  Description of Artificial Sequence: Synthetic oligonucleotide
gggaccagaagccaggga

SEQ ID NO: 147281 - RNA, 18 nt, Artificial Sequence
  Description of Artificial Sequence: Synthetic oligonucleotide
aaagagggaccagaagcc

SEQ ID NO: 147282 - RNA, 18 nt, Artificial Sequence
  Description of Artificial Sequence: Synthetic oligonucleotide
aacgaaaagagggaccag

SEQ ID NO: 147283 - RNA, 18 nt, Artificial Sequence
  Description of Artificial Sequence: Synthetic oligonucleotide
gaaagaacgaaaagaggg

SEQ ID NO: 147284 - RNA, 18 nt, Artificial Sequence
  Description of Artificial Sequence: Synthetic oligonucleotide
ggagagaaagaacgaaaa

SEQ ID NO: 147285 - RNA, 18 nt, Artificial Sequence
  Description of Artificial Sequence: Synthetic oligonucleotide
gcgagggagagaaagaac

SEQ ID NO: 147286 - RNA, 18 nt, Artificial Sequence
  Description of Artificial Sequence: Synthetic oligonucleotide
accgggcgagggagagaa

SEQ ID NO: 147287 - RNA, 18 nt, Artificial Sequence
  Description of Artificial Sequence: Synthetic oligonucleotide
gaaacaccgggcgaggga

SEQ ID NO: 147288 - RNA, 18 nt, Artificial Sequence
  Description of Artificial Sequence: Synthetic oligonucleotide
cauuagaaacaccgggcg

SEQ ID NO: 147289 - RNA, 18 nt, Artificial Sequence
  Description of Artificial Sequence: Synthetic oligonucleotide
ggaggcauuagaaacacc

SEQ ID NO: 147290 - RNA, 18 nt, Artificial Sequence
  Description of Artificial Sequence: Synthetic oligonucleotide
aaacuggaggcauuagaa

SEQ ID NO: 147291 - RNA, 18 nt, Artificial Sequence
  Description of Artificial Sequence: Synthetic oligonucleotide
gagagaaacuggaggcau

SEQ ID NO: 147292 - RNA, 18 nt, Artificial Sequence
  Description of Artificial Sequence: Synthetic oligonucleotide
ggcaggagagaaacugga

SEQ ID NO: 147293 - RNA, 18 nt, Artificial Sequence
  Description of Artificial Sequence: Synthetic oligonucleotide
cagaaggcaggagagaaa

SEQ ID NO: 147294 - RNA, 18 nt, Artificial Sequence
  Description of Artificial Sequence: Synthetic oligonucleotide
ggugacagaaggcaggag

SEQ ID NO: 147295 - RNA, 18 nt, Artificial Sequence
  Description of Artificial Sequence: Synthetic oligonucleotide
gaaugggugacagaaggc

SEQ ID NO: 147296 - RNA, 18 nt, Artificial Sequence
  Description of Artificial Sequence: Synthetic oligonucleotide
gguaagaaugggugacag

SEQ ID NO: 147297 - RNA, 18 nt, Artificial Sequence
  Description of Artificial Sequence: Synthetic oligonucleotide
agagagguaagaaugggu

SEQ ID NO: 147298 - RNA, 18 nt, Artificial Sequence
  Description of Artificial Sequence: Synthetic oligonucleotide
cagacagagagguaagaa

SEQ ID NO: 147299 - RNA, 18 nt, Artificial Sequence
  Description of Artificial Sequence: Synthetic oligonucleotide
gcaggcagacagagaggu

SEQ ID NO: 147300 - RNA, 18 nt, Artificial Sequence
  Description of Artificial Sequence: Synthetic oligonucleotide
ggaaggcaggcagacaga

SEQ ID NO: 147301 - RNA, 18 nt, Artificial Sequence
  Description of Artificial Sequence: Synthetic oligonucleotide
agguaggaaggcaggcag

SEQ ID NO: 147302 - RNA, 18 nt, Artificial Sequence
  Description of Artificial Sequence: Synthetic oligonucleotide
agggaagguaggaaggca

SEQ ID NO: 147303 - RNA, 18 nt, Artificial Sequence
  Description of Artificial Sequence: Synthetic oligonucleotide
ggaucagggaagguagga

SEQ ID NO: 147304 - RNA, 18 nt, Artificial Sequence
  Description of Artificial Sequence: Synthetic oligonucleotide
gauagggaucagggaagg

SEQ ID NO: 147305 - RNA, 18 nt, Artificial Sequence
  Description of Artificial Sequence: Synthetic oligonucleotide
caggugauagggaucagg

SEQ ID NO: 147306 - RNA, 18 nt, Artificial Sequence
  Description of Artificial Sequence: Synthetic oligonucleotide
aaaggcaggugauaggga

SEQ ID NO: 147307 - RNA, 18 nt, Artificial Sequence
  Description of Artificial Sequence: Synthetic oligonucleotide
agagcaaaggcaggugau

SEQ ID NO: 147308 - RNA, 18 nt, Artificial Sequence
  Description of Artificial Sequence: Synthetic oligonucleotide
uagaaagagcaaaggcag

SEQ ID NO: 147309 - RNA, 18 nt, Artificial Sequence
  Description of Artificial Sequence: Synthetic oligonucleotide
gcggauagaaagagcaaa

SEQ ID NO: 147310 - RNA, 18 nt, Artificial Sequence
  Description of Artificial Sequence: Synthetic oligonucleotide
aaggagcggauagaaaga

SEQ ID NO: 147311 - RNA, 18 nt, Artificial Sequence
  Description of Artificial Sequence: Synthetic oligonucleotide
cuaagaaggagcggauag

SEQ ID NO: 147312 - RNA, 18 nt, Artificial Sequence
  Description of Artificial Sequence: Synthetic oligonucleotide
augaccuaagaaggagcg

SEQ ID NO: 147313 - RNA, 18 nt, Artificial Sequence
  Description of Artificial Sequence: Synthetic oligonucleotide
aucccaugaccuaagaag

SEQ ID NO: 147314 - RNA, 18 nt, Artificial Sequence
  Description of Artificial Sequence: Synthetic oligonucleotide
cguggaucccaugaccua

SEQ ID NO: 147315 - RNA, 18 nt, Artificial Sequence
  Description of Artificial Sequence: Synthetic oligonucleotide
gaggccguggaucccaug

SEQ ID NO: 147316 - RNA, 18 nt, Artificial Sequence
  Description of Artificial Sequence: Synthetic oligonucleotide
gcuccgaggccguggauc

SEQ ID NO: 147317 - RNA, 18 nt, Artificial Sequence
  Description of Artificial Sequence: Synthetic oligonucleotide
ccagggcuccgaggccgu

SEQ ID NO: 147318 - RNA, 18 nt, Artificial Sequence
  Description of Artificial Sequence: Synthetic oligonucleotide
uggaaccagggcuccgag

SEQ ID NO: 147319 - RNA, 18 nt, Artificial Sequence
  Description of Artificial Sequence: Synthetic oligonucleotide
guggcuggaaccagggcu

SEQ ID NO: 147320 - RNA, 18 nt, Artificial Sequence
  Description of Artificial Sequence: Synthetic oligonucleotide
agaggguggcuggaacca

SEQ ID NO: 147321 - RNA, 18 nt, Artificial Sequence
  Description of Artificial Sequence: Synthetic oligonucleotide
uagggagaggguggcugg

SEQ ID NO: 147322 - RNA, 18 nt, Artificial Sequence
  Description of Artificial Sequence: Synthetic oligonucleotide
cugacuagggagagggug

SEQ ID NO: 147323 - RNA, 18 nt, Artificial Sequence
  Description of Artificial Sequence: Synthetic oligonucleotide
agaggcugacuagggaga

SEQ ID NO: 147324 - RNA, 18 nt, Artificial Sequence
  Description of Artificial Sequence: Synthetic oligonucleotide
gggcaagaggcugacuag

SEQ ID NO: 147325 - RNA, 18 nt, Artificial Sequence
  Description of Artificial Sequence: Synthetic oligonucleotide
gcccagggcaagaggcug

SEQ ID NO: 147326 - RNA, 18 nt, Artificial Sequence
  Description of Artificial Sequence: Synthetic oligonucleotide
ccccagcccagggcaaga

SEQ ID NO: 147327 - RNA, 18 nt, Artificial Sequence
  Description of Artificial Sequence: Synthetic oligonucleotide
uugccccccagcccaggg

SEQ ID NO: 147328 - RNA, 18 nt, Artificial Sequence
  Description of Artificial Sequence: Synthetic oligonucleotide
cuaauuugccccccagcc

SEQ ID NO: 147329 - RNA, 18 nt, Artificial Sequence
  Description of Artificial Sequence: Synthetic oligonucleotide
gccugcuaauuugccccc

SEQ ID NO: 147330 - RNA, 18 nt, Artificial Sequence
  Description of Artificial Sequence: Synthetic oligonucleotide
aaacugccugcuaauuug

SEQ ID NO: 147331 - RNA, 18 nt, Artificial Sequence
  Description of Artificial Sequence: Synthetic oligonucleotide
ccugaaaacugccugcua

SEQ ID NO: 147332 - RNA, 18 nt, Artificial Sequence
  Description of Artificial Sequence: Synthetic oligonucleotide
aacacccugaaaacugcc

SEQ ID NO: 147333 - RNA, 18 nt, Artificial Sequence
  Description of Artificial Sequence: Synthetic oligonucleotide
aaaacaacacccugaaaa

SEQ ID NO: 147334 - RNA, 18 nt, Artificial Sequence
  Description of Artificial Sequence: Synthetic oligonucleotide
acaacaaaacaacacccu

SEQ ID NO: 147335 - RNA, 18 nt, Artificial Sequence
  Description of Artificial Sequence: Synthetic oligonucleotide
agaaaacaacaaaacaac

SEQ ID NO: 147336 - RNA, 18 nt, Artificial Sequence
  Description of Artificial Sequence: Synthetic oligonucleotide
gacagagaaaacaacaaa

SEQ ID NO: 147337 - RNA, 18 nt, Artificial Sequence
  Description of Artificial Sequence: Synthetic oligonucleotide
gaaaagacagagaaaaca

SEQ ID NO: 147338 - RNA, 18 nt, Artificial Sequence
  Description of Artificial Sequence: Synthetic oligonucleotide
agagagaaaagacagaga

SEQ ID NO: 147339 - RNA, 18 nt, Artificial Sequence
  Description of Artificial Sequence: Synthetic oligonucleotide
gagaaagagagaaaagac

SEQ ID NO: 147340 - RNA, 18 nt, Artificial Sequence
  Description of Artificial Sequence: Synthetic oligonucleotide
gaagagagaaagagagaa

SEQ ID NO: 147341 - RNA, 18 nt, Artificial Sequence
  Description of Artificial Sequence: Synthetic oligonucleotide
cagaggaagagagaaaga

SEQ ID NO: 147342 - RNA, 18 nt, Artificial Sequence
  Description of Artificial Sequence: Synthetic oligonucleotide
gcaaacagaggaagagag

SEQ ID NO: 147343 - RNA, 18 nt, Artificial Sequence
  Description of Artificial Sequence: Synthetic oligonucleotide
gggaggcaaacagaggaa

SEQ ID NO: 147344 - RNA, 18 nt, Artificial Sequence
  Description of Artificial Sequence: Synthetic oligonucleotide
ggagagggaggcaaacag

SEQ ID NO: 147345 - RNA, 18 nt, Artificial Sequence
  Description of Artificial Sequence: Synthetic oligonucleotide
agacaggagagggaggca

SEQ ID NO: 147346 - RNA, 18 nt, Artificial Sequence
  Description of Artificial Sequence: Synthetic oligonucleotide
gggagacaggagagggag

SEQ ID NO: 147347 - RNA, 18 nt, Artificial Sequence
  Description of Artificial Sequence: Synthetic oligonucleotide
gaaagauaaagauguggg

SEQ ID NO: 147348 - RNA, 18 nt, Artificial Sequence
  Description of Artificial Sequence: Synthetic oligonucleotide
uuugagaaagauaaagau

SEQ ID NO: 147349 - RNA, 18 nt, Artificial Sequence
  Description of Artificial Sequence: Synthetic oligonucleotide
uuaaguuugagaaagaua

SEQ ID NO: 147350 - RNA, 18 nt, Artificial Sequence
  Description of Artificial Sequence: Synthetic oligonucleotide
gacucuuaaguuugagaa

SEQ ID NO: 147351 - RNA, 18 nt, Artificial Sequence
  Description of Artificial Sequence: Synthetic oligonucleotide
cccacgacucuuaaguuu

SEQ ID NO: 147352 - RNA, 18 nt, Artificial Sequence
  Description of Artificial Sequence: Synthetic oligonucleotide
uggaccccacgacucuua

SEQ ID NO: 147353 - RNA, 18 nt, Artificial Sequence
  Description of Artificial Sequence: Synthetic oligonucleotide
ucuccuggaccccacgac

SEQ ID NO: 147354 - RNA, 18 nt, Artificial Sequence
  Description of Artificial Sequence: Synthetic oligonucleotide
uggagucuccuggacccc

SEQ ID NO: 147355 - RNA, 18 nt, Artificial Sequence
  Description of Artificial Sequence: Synthetic oligonucleotide
acucuuggagucuccugg

SEQ ID NO: 147356 - RNA, 18 nt, Artificial Sequence
  Description of Artificial Sequence: Synthetic oligonucleotide
ugaauacucuuggagucu

SEQ ID NO: 147357 - RNA, 18 nt, Artificial Sequence
  Description of Artificial Sequence: Synthetic oligonucleotide
cuccuagcacagacaggg

SEQ ID NO: 147358 - RNA, 18 nt, Artificial Sequence
  Description of Artificial Sequence: Synthetic oligonucleotide
gagcuccuagcacagaca

SEQ ID NO: 147359 - RNA, 18 nt, Artificial Sequence
  Description of Artificial Sequence: Synthetic oligonucleotide
uauccgagcuccuagcac

SEQ ID NO: 147360 - RNA, 18 nt, Artificial Sequence
  Description of Artificial Sequence: Synthetic oligonucleotide
cuguuuauccgagcuccu

SEQ ID NO: 147361 - RNA, 18 nt, Artificial Sequence
  Description of Artificial Sequence: Synthetic oligonucleotide
gcugacuguuuauccgag

SEQ ID NO: 147362 - RNA, 18 nt, Artificial Sequence
  Description of Artificial Sequence: Synthetic oligonucleotide
gcucggcugacuguuuau

SEQ ID NO: 147363 - RNA, 18 nt, Artificial Sequence
  Description of Artificial Sequence: Synthetic oligonucleotide
ucgaggcucggcugacug

SEQ ID NO: 147364 - RNA, 18 nt, Artificial Sequence
  Description of Artificial Sequence: Synthetic oligonucleotide
gggcgucgaggcucggcu

SEQ ID NO: 147365 - RNA, 18 nt, Artificial Sequence
  Description of Artificial Sequence: Synthetic oligonucleotide
ggaggcggacgauuuggg

SEQ ID NO: 147366 - RNA, 18 nt, Artificial Sequence
  Description of Artificial Sequence: Synthetic oligonucleotide
uuggaggcggacgauuug

SEQ ID NO: 147367 - RNA, 18 nt, Artificial Sequence
  Description of Artificial Sequence: Synthetic oligonucleotide
gcuguccgcgcgugcggg

SEQ ID NO: 147368 - RNA, 18 nt, Artificial Sequence
  Description of Artificial Sequence: Synthetic oligonucleotide
cgggagcuguccgcgcgu

SEQ ID NO: 147369 - RNA, 18 nt, Artificial Sequence
  Description of Artificial Sequence: Synthetic oligonucleotide
caacccgggagcuguccg

SEQ ID NO: 147370 - RNA, 18 nt, Artificial Sequence
  Description of Artificial Sequence: Synthetic oligonucleotide
gcaggcaacccgggagcu

SEQ ID NO: 147371 - RNA, 18 nt, Artificial Sequence
  Description of Artificial Sequence: Synthetic oligonucleotide
gcgccgcaggcaacccgg

SEQ ID NO: 147372 - RNA, 18 nt, Artificial Sequence
  Description of Artificial Sequence: Synthetic oligonucleotide
cgccugcgccgcaggcaa

SEQ ID NO: 147373 - RNA, 18 nt, Artificial Sequence
  Description of Artificial Sequence: Synthetic oligonucleotide
caucccgccugcgccgca

SEQ ID NO: 147374 - RNA, 18 nt, Artificial Sequence
  Description of Artificial Sequence: Synthetic oligonucleotide
agcagcaucccgccugcg

SEQ ID NO: 147375 - RNA, 18 nt, Artificial Sequence
  Description of Artificial Sequence: Synthetic oligonucleotide
ugcgaagcagcaucccgc

SEQ ID NO: 147376 - RNA, 18 nt, Artificial Sequence
  Description of Artificial Sequence: Synthetic oligonucleotide
acuagugcgaagcagcau

SEQ ID NO: 147377 - RNA, 18 nt, Artificial Sequence
  Description of Artificial Sequence: Synthetic oligonucleotide
acuggacuagugcgaagc

SEQ ID NO: 147378 - RNA, 18 nt, Artificial Sequence
  Description of Artificial Sequence: Synthetic oligonucleotide
agaggacuggacuagugc

SEQ ID NO: 147379 - RNA, 18 nt, Artificial Sequence
  Description of Artificial Sequence: Synthetic oligonucleotide
cuggcagaggacuggacu

SEQ ID NO: 147380 - RNA, 18 nt, Artificial Sequence
  Description of Artificial Sequence: Synthetic oligonucleotide
agggccuggcagaggacu

SEQ ID NO: 147381 - RNA, 18 nt, Artificial Sequence
  Description of Artificial Sequence: Synthetic oligonucleotide
gaggaagggccuggcaga

SEQ ID NO: 147382 - RNA, 18 nt, Artificial Sequence
  Description of Artificial Sequence: Synthetic oligonucleotide
gaggagaggaagggccug

SEQ ID NO: 147383 - RNA, 18 nt, Artificial Sequence
  Description of Artificial Sequence: Synthetic oligonucleotide
aaagcgaggagaggaagg

SEQ ID NO: 147384 - RNA, 18 nt, Artificial Sequence
  Description of Artificial Sequence: Synthetic oligonucleotide
guaagaaagcgaggagag

SEQ ID NO: 147385 - RNA, 18 nt, Artificial Sequence
  Description of Artificial Sequence: Synthetic oligonucleotide
agggcguaagaaagcgag

SEQ ID NO: 147386 - RNA, 18 nt, Artificial Sequence
  Description of Artificial Sequence: Synthetic oligonucleotide
cggaaagggcguaagaaa

SEQ ID NO: 147387 - RNA, 18 nt, Artificial Sequence
  Description of Artificial Sequence: Synthetic oligonucleotide
gccagcggaaagggcgua

SEQ ID NO: 147388 - RNA, 18 nt, Artificial Sequence
  Description of Artificial Sequence: Synthetic oligonucleotide
uucaugccagcggaaagg

SEQ ID NO: 147389 - RNA, 18 nt, Artificial Sequence
  Description of Artificial Sequence: Synthetic oligonucleotide
gggaauucaugccagcgg

SEQ ID NO: 147390 - RNA, 18 nt, Artificial Sequence
  Description of Artificial Sequence: Synthetic oligonucleotide
ggagaaaaugccaaaggg

SEQ ID NO: 147391 - RNA, 18 nt, Artificial Sequence
  Description of Artificial Sequence: Synthetic oligonucleotide
gggagaaaaugccaaagg

SEQ ID NO: 147392 - RNA, 18 nt, Artificial Sequence
  Description of Artificial Sequence: Synthetic oligonucleotide
agaugacagaaaagaggg

SEQ ID NO: 147393 - RNA, 18 nt, Artificial Sequence
  Description of Artificial Sequence: Synthetic oligonucleotide
ccagaugacagaaaagag

SEQ ID NO: 147394 - RNA, 18 nt, Artificial Sequence
  Description of Artificial Sequence: Synthetic oligonucleotide
agaaaccagaugacagaa

SEQ ID NO: 147395 - RNA, 18 nt, Artificial Sequence
  Description of Artificial Sequence: Synthetic oligonucleotide
uggagagaaaccagauga

SEQ ID NO: 147396 - RNA, 18 nt, Artificial Sequence
  Description of Artificial Sequence: Synthetic oligonucleotide
gggacuggagagaaacca

SEQ ID NO: 147397 - RNA, 18 nt, Artificial Sequence
  Description of Artificial Sequence: Synthetic oligonucleotide
aagguagaaagcaaaggg

SEQ ID NO: 147398 - RNA, 18 nt, Artificial Sequence
  Description of Artificial Sequence: Synthetic oligonucleotide
caagguagaaagcaaagg

SEQ ID NO: 147399 - RNA, 18 nt, Artificial Sequence
  Description of Artificial Sequence: Synthetic oligonucleotide
cgacgcaagguagaaagc

SEQ ID NO: 147400 - RNA, 18 nt, Artificial Sequence
  Description of Artificial Sequence: Synthetic oligonucleotide
ccuugcgacgcaagguag

SEQ ID NO: 147401 - RNA, 18 nt, Artificial Sequence
  Description of Artificial Sequence: Synthetic oligonucleotide
ucaggccuugcgacgcaa

SEQ ID NO: 147402 - RNA, 18 nt, Artificial Sequence
  Description of Artificial Sequence: Synthetic oligonucleotide
gcgacucaggccuugcga

SEQ ID NO: 147403 - RNA, 18 nt, Artificial Sequence
  Description of Artificial Sequence: Synthetic oligonucleotide
agagggcgacucaggccu

SEQ ID NO: 147404 - RNA, 18 nt, Artificial Sequence
  Description of Artificial Sequence: Synthetic oligonucleotide
gggcgagagggcgacuca

SEQ ID NO: 147405 - RNA, 18 nt, Artificial Sequence
  Description of Artificial Sequence: Synthetic oligonucleotide
gggcugggcgagagggcg

SEQ ID NO: 147406 - RNA, 18 nt, Artificial Sequence
  Description of Artificial Sequence: Synthetic oligonucleotide
gcugggcugaagacuggg

SEQ ID NO: 147407 - RNA, 18 nt, Artificial Sequence
  Description of Artificial Sequence: Synthetic oligonucleotide
gacgcugggcugaagacu

SEQ ID NO: 147408 - RNA, 18 nt, Artificial Sequence
  Description of Artificial Sequence: Synthetic oligonucleotide
gcacagacgcugggcuga

SEQ ID NO: 147409 - RNA, 18 nt, Artificial Sequence
  Description of Artificial Sequence: Synthetic oligonucleotide
uggaagcacagacgcugg

SEQ ID NO: 147410 - RNA, 18 nt, Artificial Sequence
  Description of Artificial Sequence: Synthetic oligonucleotide
gggacuggaagcacagac

SEQ ID NO: 147411 - RNA, 18 nt, Artificial Sequence
  Description of Artificial Sequence: Synthetic oligonucleotide
accacgcggaggaguggg

SEQ ID NO: 147412 - RNA, 18 nt, Artificial Sequence
  Description of Artificial Sequence: Synthetic oligonucleotide
cacgaccacgcggaggag

SEQ ID NO: 147413 - RNA, 18 nt, Artificial Sequence
  Description of Artificial Sequence: Synthetic oligonucleotide
accuccacgaccacgcgg

SEQ ID NO: 147414 - RNA, 18 nt, Artificial Sequence
  Description of Artificial Sequence: Synthetic oligonucleotide
gguggaccuccacgacca

SEQ ID NO: 147415 - RNA, 18 nt, Artificial Sequence
  Description of Artificial Sequence: Synthetic oligonucleotide
aaggugguggaccuccac

SEQ ID NO: 147416 - RNA, 18 nt, Artificial Sequence
  Description of Artificial Sequence: Synthetic oligonucleotide
gaagaaaggugguggacc

SEQ ID NO: 147417 - RNA, 18 nt, Artificial Sequence
  Description of Artificial Sequence: Synthetic oligonucleotide
cuugagaagaaagguggu

SEQ ID NO: 147418 - RNA, 18 nt, Artificial Sequence
  Description of Artificial Sequence: Synthetic oligonucleotide
ccgagcuugagaagaaag

SEQ ID NO: 147419 - RNA, 18 nt, Artificial Sequence
  Description of Artificial Sequence: Synthetic oligonucleotide
uguucccgagcuugagaa

SEQ ID NO: 147420 - RNA, 18 nt, Artificial Sequence
  Description of Artificial Sequence: Synthetic oligonucleotide
gggcauguucccgagcuu

SEQ ID NO: 147421 - RNA, 18 nt, Artificial Sequence
  Description of Artificial Sequence: Synthetic oligonucleotide
cggaagggcauguucccg

SEQ ID NO: 147422 - RNA, 18 nt, Artificial Sequence
  Description of Artificial Sequence: Synthetic oligonucleotide
cagggcggaagggcaugu

SEQ ID NO: 147423 - RNA, 18 nt, Artificial Sequence
  Description of Artificial Sequence: Synthetic oligonucleotide
gcaggcagggcggaaggg

SEQ ID NO: 147424 - RNA, 18 nt, Artificial Sequence
  Description of Artificial Sequence: Synthetic oligonucleotide
aggaagcaggcagggcgg

SEQ ID NO: 147425 - RNA, 18 nt, Artificial Sequence
  Description of Artificial Sequence: Synthetic oligonucleotide
ggcgaaggaagcaggcag

SEQ ID NO: 147426 - RNA, 18 nt, Artificial Sequence
  Description of Artificial Sequence: Synthetic oligonucleotide
ggacgggcgaaggaagca

SEQ ID NO: 147427 - RNA, 18 nt, Artificial Sequence
  Description of Artificial Sequence: Synthetic oligonucleotide
gcccgggacgggcgaagg

SEQ ID NO: 147428 - RNA, 18 nt, Artificial Sequence
  Description of Artificial Sequence: Synthetic oligonucleotide
ccgcggcccgggacgggc

SEQ ID NO: 147429 - RNA, 18 nt, Artificial Sequence
  Description of Artificial Sequence: Synthetic oligonucleotide
aggguccgcggcccggga

SEQ ID NO: 147430 - RNA, 18 nt, Artificial Sequence
  Description of Artificial Sequence: Synthetic oligonucleotide
uagucaggguccgcggcc

SEQ ID NO: 147431 - RNA, 18 nt, Artificial Sequence
  Description of Artificial Sequence: Synthetic oligonucleotide
gccauuagucaggguccg

SEQ ID NO: 147432 - RNA, 18 nt, Artificial Sequence
  Description of Artificial Sequence: Synthetic oligonucleotide
gaccggccauuagucagg

SEQ ID NO: 147433 - RNA, 18 nt, Artificial Sequence
  Description of Artificial Sequence: Synthetic oligonucleotide
gcagggaccggccauuag

SEQ ID NO: 147434 - RNA, 18 nt, Artificial Sequence
  Description of Artificial Sequence: Synthetic oligonucleotide
acacagcagggaccggcc

SEQ ID NO: 147435 - RNA, 18 nt, Artificial Sequence
  Description of Artificial Sequence: Synthetic oligonucleotide
cccacacacagcagggac

SEQ ID NO: 147436 - RNA, 18 nt, Artificial Sequence
  Description of Artificial Sequence: Synthetic oligonucleotide
aacaccccacacacagca

SEQ ID NO: 147437 - RNA, 18 nt, Artificial Sequence
  Description of Artificial Sequence: Synthetic oligonucleotide
aacacaacaccccacaca

SEQ ID NO: 147438 - RNA, 18 nt, Artificial Sequence
  Description of Artificial Sequence: Synthetic oligonucleotide
aaaaaaacacaacacccc

SEQ ID NO: 147439 - RNA, 18 nt, Artificial Sequence
  Description of Artificial Sequence: Synthetic oligonucleotide
uucacacccccgugcccu

SEQ ID NO: 147440 - RNA, 18 nt, Artificial Sequence
  Description of Artificial Sequence: Synthetic oligonucleotide
gcugguucacacccccgu

SEQ ID NO: 147441 - RNA, 18 nt, Artificial Sequence
  Description of Artificial Sequence: Synthetic oligonucleotide
cccgagcugguucacacc

SEQ ID NO: 147442 - RNA, 18 nt, Artificial Sequence
  Description of Artificial Sequence: Synthetic oligonucleotide
acccccccgagcugguuc

SEQ ID NO: 147443 - RNA, 18 nt, Artificial Sequence
  Description of Artificial Sequence: Synthetic oligonucleotide
caaacacccccccgagcu

SEQ ID NO: 147444 - RNA, 18 nt, Artificial Sequence
  Description of Artificial Sequence: Synthetic oligonucleotide
guucacaaacaccccccc

SEQ ID NO: 147445 - RNA, 18 nt, Artificial Sequence
  Description of Artificial Sequence: Synthetic oligonucleotide
cggccguucacaaacacc

SEQ ID NO: 147446 - RNA, 18 nt, Artificial Sequence
  Description of Artificial Sequence: Synthetic oligonucleotide
gggccggccguucacaaa

SEQ ID NO: 147447 - RNA, 18 nt, Artificial Sequence
  Description of Artificial Sequence: Synthetic oligonucleotide
ucaccacgucggguaggg

SEQ ID NO: 147448 - RNA, 18 nt, Artificial Sequence
  Description of Artificial Sequence: Synthetic oligonucleotide
cugccucaccacgucggg

SEQ ID NO: 147449 - RNA, 18 nt, Artificial Sequence
  Description of Artificial Sequence: Synthetic oligonucleotide
augcgcugccucaccacg

SEQ ID NO: 147450 - RNA, 18 nt, Artificial Sequence
  Description of Artificial Sequence: Synthetic oligonucleotide
ccacgaugcgcugccuca

SEQ ID NO: 147451 - RNA, 18 nt, Artificial Sequence
  Description of Artificial Sequence: Synthetic oligonucleotide
cagcuccacgaugcgcug

SEQ ID NO: 147452 - RNA, 18 nt, Artificial Sequence
  Description of Artificial Sequence: Synthetic oligonucleotide
ugggccagcuccacgaug

SEQ ID NO: 147453 - RNA, 18 nt, Artificial Sequence
  Description of Artificial Sequence: Synthetic oligonucleotide
ccuggugggccagcucca

SEQ ID NO: 147454 - RNA, 18 nt, Artificial Sequence
  Description of Artificial Sequence: Synthetic oligonucleotide
cacacccuggugggccag

SEQ ID NO: 147455 - RNA, 18 nt, Artificial Sequence
  Description of Artificial Sequence: Synthetic oligonucleotide
ggccgcacacccuggugg

SEQ ID NO: 147456 - RNA, 18 nt, Artificial Sequence
  Description of Artificial Sequence: Synthetic oligonucleotide
cacagggccgcacacccu

SEQ ID NO: 147457 - RNA, 18 nt, Artificial Sequence
  Description of Artificial Sequence: Synthetic oligonucleotide
gaugucacagggccgcac

SEQ ID NO: 147458 - RNA, 18 nt, Artificial Sequence
  Description of Artificial Sequence: Synthetic oligonucleotide
cgggagaugucacagggc

SEQ ID NO: 147459 - RNA, 18 nt, Artificial Sequence
  Description of Artificial Sequence: Synthetic oligonucleotide
gcugccgggagaugucac

SEQ ID NO: 147460 - RNA, 18 nt, Artificial Sequence
  Description of Artificial Sequence: Synthetic oligonucleotide
ccgcagcugccgggagau

SEQ ID NO: 147461 - RNA, 18 nt, Artificial Sequence
  Description of Artificial Sequence: Synthetic oligonucleotide
cugacccgcagcugccgg

SEQ ID NO: 147462 - RNA, 18 nt, Artificial Sequence
  Description of Artificial Sequence: Synthetic oligonucleotide
cguggcugacccgcagcu

SEQ ID NO: 147463 - RNA, 18 nt, Artificial Sequence
  Description of Artificial Sequence: Synthetic oligonucleotide
acagccguggcugacccg

SEQ ID NO: 147464 - RNA, 18 nt, Artificial Sequence
  Description of Artificial Sequence: Synthetic oligonucleotide
cugacacagccguggcug

SEQ ID NO: 147465 - RNA, 18 nt, Artificial Sequence
  Description of Artificial Sequence: Synthetic oligonucleotide
uuuugcugacacagccgu

SEQ ID NO: 147466 - RNA, 18 nt, Artificial Sequence
  Description of Artificial Sequence: Synthetic oligonucleotide
caggauuuugcugacaca

SEQ ID NO: 147467 - RNA, 18 nt, Artificial Sequence
  Description of Artificial Sequence: Synthetic oligonucleotide
cugcccaggauuuugcug

SEQ ID NO: 147468 - RNA, 18 nt, Artificial Sequence
  Description of Artificial Sequence: Synthetic oligonucleotide
cgcgcgggccaggccccc

SEQ ID NO: 147469 - RNA, 18 nt, Artificial Sequence
  Description of Artificial Sequence: Synthetic oligonucleotide
gggagcgcgcgggccagg

SEQ ID NO: 147470 - RNA, 18 nt, Artificial Sequence
  Description of Artificial Sequence: Synthetic oligonucleotide
guggcgccugcgggaggg

SEQ ID NO: 147471 - RNA, 18 nt, Artificial Sequence
  Description of Artificial Sequence: Synthetic oligonucleotide
agguggcgccugcgggag

SEQ ID NO: 147472 - RNA, 18 nt, Artificial Sequence
  Description of Artificial Sequence: Synthetic oligonucleotide
guccgagguggcgccugc

SEQ ID NO: 147473 - RNA, 18 nt, Artificial Sequence
  Description of Artificial Sequence: Synthetic oligonucleotide
gggauguccgagguggcg

SEQ ID NO: 147474 - RNA, 18 nt, Artificial Sequence
  Description of Artificial Sequence: Synthetic oligonucleotide
agaaguagcaaucccggg

SEQ ID NO: 147475 - RNA, 18 nt, Artificial Sequence
  Description of Artificial Sequence: Synthetic oligonucleotide
gagaaguagcaaucccgg

SEQ ID NO: 147476 - RNA, 18 nt, Artificial Sequence
  Description of Artificial Sequence: Synthetic oligonucleotide
uggcagagaaguagcaau

SEQ ID NO: 147477 - RNA, 18 nt, Artificial Sequence
  Description of Artificial Sequence: Synthetic oligonucleotide
gaaguuggcagagaagua

SEQ ID NO: 147478 - RNA, 18 nt, Artificial Sequence
  Description of Artificial Sequence: Synthetic oligonucleotide
uuggcgaaguuggcagag

SEQ ID NO: 147479 - RNA, 18 nt, Artificial Sequence
  Description of Artificial Sequence: Synthetic oligonucleotide
gcgaguuggcgaaguugg

SEQ ID NO: 147480 - RNA, 18 nt, Artificial Sequence
  Description of Artificial Sequence: Synthetic oligonucleotide
ugcuggcgaguuggcgaa

SEQ ID NO: 147481 - RNA, 18 nt, Artificial Sequence
  Description of Artificial Sequence: Synthetic oligonucleotide
ccaagugcuggcgaguug

SEQ ID NO: 147482 - RNA, 18 nt, Artificial Sequence
  Description of Artificial Sequence: Synthetic oligonucleotide
ccucuccaagugcuggcg

SEQ ID NO: 147483 - RNA, 18 nt, Artificial Sequence
  Description of Artificial Sequence: Synthetic oligonucleotide
ccgggccucuccaagugc

SEQ ID NO: 147484 - RNA, 18 nt, Artificial Sequence
  Description of Artificial Sequence: Synthetic oligonucleotide
gggagccgggccucucca

SEQ ID NO: 147485 - RNA, 18 nt, Artificial Sequence
  Description of Artificial Sequence: Synthetic oligonucleotide
cagagggcgccgggaggg

SEQ ID NO: 147486 - RNA, 18 nt, Artificial Sequence
  Description of Artificial Sequence: Synthetic oligonucleotide
cggucagagggcgccggg

SEQ ID NO: 147487 - RNA, 18 nt, Artificial Sequence
  Description of Artificial Sequence: Synthetic oligonucleotide
ggucggagagcgcgcggg

SEQ ID NO: 147488 - RNA, 18 nt, Artificial Sequence
  Description of Artificial Sequence: Synthetic oligonucleotide
gcgguggucggagagcgc

SEQ ID NO: 147489 - RNA, 18 nt, Artificial Sequence
  Description of Artificial Sequence: Synthetic oligonucleotide
gagaggcgguggucggag

SEQ ID NO: 147490 - RNA, 18 nt, Artificial Sequence
  Description of Artificial Sequence: Synthetic oligonucleotide
cauccgagaggcgguggu

SEQ ID NO: 147491 - RNA, 18 nt, Artificial Sequence
  Description of Artificial Sequence: Synthetic oligonucleotide
cuggucauccgagaggcg

SEQ ID NO: 147492 - RNA, 18 nt, Artificial Sequence
  Description of Artificial Sequence: Synthetic oligonucleotide
ggaaccuggucauccgag

SEQ ID NO: 147493 - RNA, 18 nt, Artificial Sequence
  Description of Artificial Sequence: Synthetic oligonucleotide
ccccuggaaccuggucau

SEQ ID NO: 147494 - RNA, 18 nt, Artificial Sequence
  Description of Artificial Sequence: Synthetic oligonucleotide
cagcuccccuggaaccug

SEQ ID NO: 147495 - RNA, 18 nt, Artificial Sequence
  Description of Artificial Sequence: Synthetic oligonucleotide
ucgcucagcuccccugga

SEQ ID NO: 147496 - RNA, 18 nt, Artificial Sequence
  Description of Artificial Sequence: Synthetic oligonucleotide
gcgacucgcucagcuccc

SEQ ID NO: 147497 - RNA, 18 nt, Artificial Sequence
  Description of Artificial Sequence: Synthetic oligonucleotide
gggaggcgacucgcucag

SEQ ID NO: 147498 - RNA, 18 nt, Artificial Sequence
  Description of Artificial Sequence: Synthetic oligonucleotide
gggcugaagcugggcggg

SEQ ID NO: 147499 - RNA, 18 nt, Artificial Sequence
  Description of Artificial Sequence: Synthetic oligonucleotide
agggcugaagcugggcgg

SEQ ID NO: 147500 - RNA, 18 nt, Artificial Sequence
  Description of Artificial Sequence: Synthetic oligonucleotide
cagccagggcugaagcug

SEQ ID NO: 147501 - RNA, 18 nt, Artificial Sequence
  Description of Artificial Sequence: Synthetic oligonucleotide
agcugcagccagggcuga

SEQ ID NO: 147502 - RNA, 18 nt, Artificial Sequence
  Description of Artificial Sequence: Synthetic oligonucleotide
gcugcagcugcagccagg

SEQ ID NO: 147503 - RNA, 18 nt, Artificial Sequence
  Description of Artificial Sequence: Synthetic oligonucleotide
cucgcgcugcagcugcag

SEQ ID NO: 147504 - RNA, 18 nt, Artificial Sequence
  Description of Artificial Sequence: Synthetic oligonucleotide
cauggcucgcgcugcagc

SEQ ID NO: 147505 - RNA, 18 nt, Artificial Sequence
  Description of Artificial Sequence: Synthetic oligonucleotide
gggcgcauggcucgcgcu

SEQ ID NO: 147506 - RNA, 18 nt, Artificial Sequence
  Description of Artificial Sequence: Synthetic oligonucleotide
gcggugggccgggccggg

SEQ ID NO: 147507 - RNA, 18 nt, Artificial Sequence
  Description of Artificial Sequence: Synthetic oligonucleotide
gggcggugggccgggccg

SEQ ID NO: 147508 - RNA, 18 nt, Artificial Sequence
  Description of Artificial Sequence: Synthetic oligonucleotide
cagcagaauggccccggg

SEQ ID NO: 147509 - RNA, 18 nt, Artificial Sequence
  Description of Artificial Sequence: Synthetic oligonucleotide
gucagcagaauggccccg

SEQ ID NO: 147510 - RNA, 18 nt, Artificial Sequence
  Description of Artificial Sequence: Synthetic oligonucleotide
gggcggucagcagaaugg

SEQ ID NO: 147511 - RNA, 18 nt, Artificial Sequence
  Description of Artificial Sequence: Synthetic oligonucleotide
gggcugggcggucagcag

SEQ ID NO: 147512 - RNA, 18 nt, Artificial Sequence
  Description of Artificial Sequence: Synthetic oligonucleotide
caacuugccacugucggg

SEQ ID NO: 147513 - RNA, 18 nt, Artificial Sequence
  Description of Artificial Sequence: Synthetic oligonucleotide
cgcaacuugccacugucg

SEQ ID NO: 147514 - RNA, 18 nt, Artificial Sequence
  Description of Artificial Sequence: Synthetic oligonucleotide
guagccgcaacuugccac

SEQ ID NO: 147515 - RNA, 18 nt, Artificial Sequence
  Description of Artificial Sequence: Synthetic oligonucleotide
cugcaguagccgcaacuu

SEQ ID NO: 147516 - RNA, 18 nt, Artificial Sequence
  Description of Artificial Sequence: Synthetic oligonucleotide
ugcaacugcaguagccgc

SEQ ID NO: 147517 - RNA, 18 nt, Artificial Sequence
  Description of Artificial Sequence: Synthetic oligonucleotide
gagcuugcaacugcagua

SEQ ID NO: 147518 - RNA, 18 nt, Artificial Sequence
  Description of Artificial Sequence: Synthetic oligonucleotide
ggccggagcuugcaacug

SEQ ID NO: 147519 - RNA, 18 nt, Artificial Sequence
  Description of Artificial Sequence: Synthetic oligonucleotide
ggguuggccggagcuugc

SEQ ID NO: 147520 - RNA, 18 nt, Artificial Sequence
  Description of Artificial Sequence: Synthetic oligonucleotide
ccuccggguuggccggag

SEQ ID NO: 147521 - RNA, 18 nt, Artificial Sequence
  Description of Artificial Sequence: Synthetic oligonucleotide
gggcuccuccggguuggc

SEQ ID NO: 147522 - RNA, 18 nt, Artificial Sequence
  Description of Artificial Sequence: Synthetic oligonucleotide
acugcgcuccccgcuggg

SEQ ID NO: 147523 - RNA, 18 nt, Artificial Sequence
  Description of Artificial Sequence: Synthetic oligonucleotide
cagcacugcgcuccccgc

SEQ ID NO: 147524 - RNA, 18 nt, Artificial Sequence
  Description of Artificial Sequence: Synthetic oligonucleotide
gggcgcagcacugcgcuc

SEQ ID NO: 147525 - RNA, 18 nt, Artificial Sequence
  Description of Artificial Sequence: Synthetic oligonucleotide
acgcccggcugcugcggg

SEQ ID NO: 147526 - RNA, 18 nt, Artificial Sequence
  Description of Artificial Sequence: Synthetic oligonucleotide
ugaacgcccggcugcugc

SEQ ID NO: 147527 - RNA, 18 nt, Artificial Sequence
  Description of Artificial Sequence: Synthetic oligonucleotide
augagugaacgcccggcu

SEQ ID NO: 147528 - RNA, 18 nt, Artificial Sequence
  Description of Artificial Sequence: Synthetic oligonucleotide
ggaggaugagugaacgcc

SEQ ID NO: 147529 - RNA, 18 nt, Artificial Sequence
  Description of Artificial Sequence: Synthetic oligonucleotide
gggagggaggaugaguga

SEQ ID NO: 147530 - RNA, 18 nt, Artificial Sequence
  Description of Artificial Sequence: Synthetic oligonucleotide
aaagggagggacgguggg

SEQ ID NO: 147531 - RNA, 18 nt, Artificial Sequence
  Description of Artificial Sequence: Synthetic oligonucleotide
gaaaagggagggacggug

SEQ ID NO: 147532 - RNA, 18 nt, Artificial Sequence
  Description of Artificial Sequence: Synthetic oligonucleotide
gaggagaaaagggaggga

SEQ ID NO: 147533 - RNA, 18 nt, Artificial Sequence
  Description of Artificial Sequence: Synthetic oligonucleotide
gacuugaggagaaaaggg

SEQ ID NO: 147534 - RNA, 18 nt, Artificial Sequence
  Description of Artificial Sequence: Synthetic oligonucleotide
uucaggacuugaggagaa

SEQ ID NO: 147535 - RNA, 18 nt, Artificial Sequence
  Description of Artificial Sequence: Synthetic oligonucleotide
ucaacuucaggacuugag

SEQ ID NO: 147536 - RNA, 18 nt, Artificial Sequence
  Description of Artificial Sequence: Synthetic oligonucleotide
caaacucaacuucaggac

SEQ ID NO: 147537 - RNA, 18 nt, Artificial Sequence
  Description of Artificial Sequence: Synthetic oligonucleotide
ccucucaaacucaacuuc

SEQ ID NO: 147538 - RNA, 18 nt, Artificial Sequence
  Description of Artificial Sequence: Synthetic oligonucleotide
ugucgccucucaaacuca

SEQ ID NO: 147539 - RNA, 18 nt, Artificial Sequence
  Description of Artificial Sequence: Synthetic oligonucleotide
cgccgugucgccucucaa

SEQ ID NO: 147540 - RNA, 18 nt, Artificial Sequence
  Description of Artificial Sequence: Synthetic oligonucleotide
gccgccgccgugucgccu

SEQ ID NO: 147541 - RNA, 18 nt, Artificial Sequence
  Description of Artificial Sequence: Synthetic oligonucleotide
cggccgccgccgccgugu

SEQ ID NO: 147542 - RNA, 18 nt, Artificial Sequence
  Description of Artificial Sequence: Synthetic oligonucleotide
cagcgcggccgccgccgc

SEQ ID NO: 147543 - RNA, 18 nt, Artificial Sequence
  Description of Artificial Sequence: Synthetic oligonucleotide
gggagcagcgcggccgcc

SEQ ID NO: 147544 - RNA, 18 nt, Artificial Sequence
  Description of Artificial Sequence: Synthetic oligonucleotide
ggagcgggagcagcgcgg

SEQ ID NO: 147545 - RNA, 18 nt, Artificial Sequence
  Description of Artificial Sequence: Synthetic oligonucleotide
gcagaggagcgggagcag

SEQ ID NO: 147546 - RNA, 18 nt, Artificial Sequence
  Description of Artificial Sequence: Synthetic oligonucleotide
gggaggcagaggagcggg

SEQ ID NO: 147547 - RNA, 18 nt, Artificial Sequence
  Description of Artificial Sequence: Synthetic oligonucleotide
gcagugcauauccauggg

SEQ ID NO: 147548 - RNA, 18 nt, Artificial Sequence
  Description of Artificial Sequence: Synthetic oligonucleotide
ugcagugcauauccaugg

SEQ ID NO: 147549 - RNA, 18 nt, Artificial Sequence
  Description of Artificial Sequence: Synthetic oligonucleotide
ugcuuugcagugcauauc

SEQ ID NO: 147550 - RNA, 18 nt, Artificial Sequence
  Description of Artificial Sequence: Synthetic oligonucleotide
gggucugcuuugcagugc

SEQ ID NO: 147551 - RNA, 18 nt, Artificial Sequence
  Description of Artificial Sequence: Synthetic oligonucleotide
gugcaucgcggagaaggg

SEQ ID NO: 147552 - RNA, 18 nt, Artificial Sequence
  Description of Artificial Sequence: Synthetic oligonucleotide
aggagccgggcgccggua

SEQ ID NO: 147553 - RNA, 18 nt, Artificial Sequence
  Description of Artificial Sequence: Synthetic oligonucleotide
gggacaggagccgggcgc

SEQ ID NO: 147554 - RNA, 18 nt, Artificial Sequence
  Description of Artificial Sequence: Synthetic oligonucleotide
gagccgggacaggagccg

SEQ ID NO: 147555 - RNA, 18 nt, Artificial Sequence
  Description of Artificial Sequence: Synthetic oligonucleotide
gccccgagccgggacagg

SEQ ID NO: 147556 - RNA, 18 nt, Artificial Sequence
  Description of Artificial Sequence: Synthetic oligonucleotide
ggagagccccgagccggg

SEQ ID NO: 147557 - RNA, 18 nt, Artificial Sequence
  Description of Artificial Sequence: Synthetic oligonucleotide
gggacggagagccccgag

SEQ ID NO: 147558 - RNA, 18 nt, Artificial Sequence
  Description of Artificial Sequence: Synthetic oligonucleotide
ggguugggacggagagcc

SEQ ID NO: 147559 - RNA, 18 nt, Artificial Sequence
  Description of Artificial Sequence: Synthetic oligonucleotide
ggacaggguugggacgga

SEQ ID NO: 147560 - RNA, 18 nt, Artificial Sequence
  Description of Artificial Sequence: Synthetic oligonucleotide
ggacuggacaggguuggg

SEQ ID NO: 147561 - RNA, 18 nt, Artificial Sequence
  Description of Artificial Sequence: Synthetic oligonucleotide
cgcugggacuggacaggg

SEQ ID NO: 147562 - RNA, 18 nt, Artificial Sequence
  Description of Artificial Sequence: Synthetic oligonucleotide
ggccacgcugggacugga

SEQ ID NO: 147563 - RNA, 18 nt, Artificial Sequence
  Description of Artificial Sequence: Synthetic oligonucleotide
gggccacgcugggacugg

SEQ ID NO: 147564 - RNA, 18 nt, Artificial Sequence
  Description of Artificial Sequence: Synthetic oligonucleotide
gggaccugagcgcgaggg

SEQ ID NO: 147565 - RNA, 18 nt, Artificial Sequence
  Description of Artificial Sequence: Synthetic oligonucleotide
aagaugggaccugagcgc

SEQ ID NO: 147566 - RNA, 18 nt, Artificial Sequence
  Description of Artificial Sequence: Synthetic oligonucleotide
ccuccaagaugggaccug

SEQ ID NO: 147567 - RNA, 18 nt, Artificial Sequence
  Description of Artificial Sequence: Synthetic oligonucleotide
ggaggccuccaagauggg

SEQ ID NO: 147568 - RNA, 18 nt, Artificial Sequence
  Description of Artificial Sequence: Synthetic oligonucleotide
gccagggaggccuccaag

SEQ ID NO: 147569 - RNA, 18 nt, Artificial Sequence
  Description of Artificial Sequence: Synthetic oligonucleotide
cagaagccagggaggccu

SEQ ID NO: 147570 - RNA, 18 nt, Artificial Sequence
  Description of Artificial Sequence: Synthetic oligonucleotide
gggaccagaagccaggga

SEQ ID NO: 147571 - RNA, 18 nt, Artificial Sequence
  Description of Artificial Sequence: Synthetic oligonucleotide
aaagagggaccagaagcc

SEQ ID NO: 147572 - RNA, 18 nt, Artificial Sequence
  Description of Artificial Sequence: Synthetic oligonucleotide
aacgaaaagagggaccag

SEQ ID NO: 147573 - RNA, 18 nt, Artificial Sequence
  Description of Artificial Sequence: Synthetic oligonucleotide
gaaagaacgaaaagaggg

SEQ ID NO: 147574 - RNA, 18 nt, Artificial Sequence
  Description of Artificial Sequence: Synthetic oligonucleotide
ggagagaaagaacgaaaa

SEQ ID NO: 147575 - RNA, 18 nt, Artificial Sequence
  Description of Artificial Sequence: Synthetic oligonucleotide
gcgagggagagaaagaac

SEQ ID NO: 147576 - RNA, 18 nt, Artificial Sequence
  Description of Artificial Sequence: Synthetic oligonucleotide
accgggcgagggagagaa

SEQ ID NO: 147577 - RNA, 18 nt, Artificial Sequence
  Description of Artificial Sequence: Synthetic oligonucleotide
gaaacaccgggcgaggga

SEQ ID NO: 147578 - RNA, 18 nt, Artificial Sequence
  Description of Artificial Sequence: Synthetic oligonucleotide
cauuagaaacaccgggcg

SEQ ID NO: 147579 - RNA, 18 nt, Artificial Sequence
  Description of Artificial Sequence: Synthetic oligonucleotide
ggaggcauuagaaacacc

SEQ ID NO: 147580 - RNA, 18 nt, Artificial Sequence
  Description of Artificial Sequence: Synthetic oligonucleotide
aaacuggaggcauuagaa

SEQ ID NO: 147581 - RNA, 18 nt, Artificial Sequence
  Description of Artificial Sequence: Synthetic oligonucleotide
gagagaaacuggaggcau

SEQ ID NO: 147582 - RNA, 18 nt, Artificial Sequence
  Description of Artificial Sequence: Synthetic oligonucleotide
ggcaggagagaaacugga

SEQ ID NO: 147583 - RNA, 18 nt, Artificial Sequence
  Description of Artificial Sequence: Synthetic oligonucleotide
cagaaggcaggagagaaa

SEQ ID NO: 147584 - RNA, 18 nt, Artificial Sequence
  Description of Artificial Sequence: Synthetic oligonucleotide
ggugacagaaggcaggag

SEQ ID NO: 147585 - RNA, 18 nt, Artificial Sequence
  Description of Artificial Sequence: Synthetic oligonucleotide
gaaugggugacagaaggc

SEQ ID NO: 147586 - RNA, 18 nt, Artificial Sequence
  Description of Artificial Sequence: Synthetic oligonucleotide
gguaagaaugggugacag

SEQ ID NO: 147587 - RNA, 18 nt, Artificial Sequence
  Description of Artificial Sequence: Synthetic oligonucleotide
agagagguaagaaugggu

SEQ ID NO: 147588 - RNA, 18 nt, Artificial Sequence
  Description of Artificial Sequence: Synthetic oligonucleotide
cagacagagagguaagaa

SEQ ID NO: 147589 - RNA, 18 nt, Artificial Sequence
  Description of Artificial Sequence: Synthetic oligonucleotide
gcaggcagacagagaggu

SEQ ID NO: 147590 - RNA, 18 nt, Artificial Sequence
  Description of Artificial Sequence: Synthetic oligonucleotide
ggaaggcaggcagacaga

SEQ ID NO: 147591 - RNA, 18 nt, Artificial Sequence
  Description of Artificial Sequence: Synthetic oligonucleotide
agguaggaaggcaggcag

SEQ ID NO: 147592 - RNA, 18 nt, Artificial Sequence
  Description of Artificial Sequence: Synthetic oligonucleotide
agggaagguaggaaggca

SEQ ID NO: 147593 - RNA, 18 nt, Artificial Sequence
  Description of Artificial Sequence: Synthetic oligonucleotide
ggaucagggaagguagga

SEQ ID NO: 147594 - RNA, 18 nt, Artificial Sequence
  Description of Artificial Sequence: Synthetic oligonucleotide
gauagggaucagggaagg

SEQ ID NO: 147595 - RNA, 18 nt, Artificial Sequence
  Description of Artificial Sequence: Synthetic oligonucleotide
caggugauagggaucagg

SEQ ID NO: 147596 - RNA, 18 nt, Artificial Sequence
  Description of Artificial Sequence: Synthetic oligonucleotide
aaaggcaggugauaggga

SEQ ID NO: 147597 - RNA, 18 nt, Artificial Sequence
  Description of Artificial Sequence: Synthetic oligonucleotide
agagcaaaggcaggugau

SEQ ID NO: 147598 - RNA, 18 nt, Artificial Sequence
  Description of Artificial Sequence: Synthetic oligonucleotide
uagaaagagcaaaggcag

SEQ ID NO: 147599 - RNA, 18 nt, Artificial Sequence
  Description of Artificial Sequence: Synthetic oligonucleotide
gcggauagaaagagcaaa

SEQ ID NO: 147600 - RNA, 18 nt, Artificial Sequence
  Description of Artificial Sequence: Synthetic oligonucleotide
aaggagcggauagaaaga

SEQ ID NO: 147601 - RNA, 18 nt, Artificial Sequence
  Description of Artificial Sequence: Synthetic oligonucleotide
cuaagaaggagcggauag

SEQ ID NO: 147602 - RNA, 18 nt, Artificial Sequence
  Description of Artificial Sequence: Synthetic oligonucleotide
augaccuaagaaggagcg

SEQ ID NO: 147603 - RNA, 18 nt, Artificial Sequence
  Description of Artificial Sequence: Synthetic oligonucleotide
aucccaugaccuaagaag

SEQ ID NO: 147604 - RNA, 18 nt, Artificial Sequence
  Description of Artificial Sequence: Synthetic oligonucleotide
cguggaucccaugaccua

SEQ ID NO: 147605 - RNA, 18 nt, Artificial Sequence
  Description of Artificial Sequence: Synthetic oligonucleotide
gaggccguggaucccaug

SEQ ID NO: 147606 - RNA, 18 nt, Artificial Sequence
  Description of Artificial Sequence: Synthetic oligonucleotide
gcuccgaggccguggauc

SEQ ID NO: 147607 - RNA, 18 nt, Artificial Sequence
  Description of Artificial Sequence: Synthetic oligonucleotide
ccagggcuccgaggccgu

SEQ ID NO: 147608 - RNA, 18 nt, Artificial Sequence
  Description of Artificial Sequence: Synthetic oligonucleotide
uggaaccagggcuccgag

SEQ ID NO: 147609 - RNA, 18 nt, Artificial Sequence
  Description of Artificial Sequence: Synthetic oligonucleotide
guggcuggaaccagggcu

SEQ ID NO: 147610 - RNA, 18 nt, Artificial Sequence
  Description of Artificial Sequence: Synthetic oligonucleotide
agaggguggcuggaacca

SEQ ID NO: 147611 - RNA, 18 nt, Artificial Sequence
  Description of Artificial Sequence: Synthetic oligonucleotide
uagggagaggguggcugg

SEQ ID NO: 147612 - RNA, 18 nt, Artificial Sequence
  Description of Artificial Sequence: Synthetic oligonucleotide
cugacuagggagagggug

SEQ ID NO: 147613 - RNA, 18 nt, Artificial Sequence
  Description of Artificial Sequence: Synthetic oligonucleotide
agaggcugacuagggaga

SEQ ID NO: 147614 - RNA, 18 nt, Artificial Sequence
  Description of Artificial Sequence: Synthetic oligonucleotide
gggcaagaggcugacuag

SEQ ID NO: 147615 - RNA, 18 nt, Artificial Sequence
  Description of Artificial Sequence: Synthetic oligonucleotide
gcccagggcaagaggcug

SEQ ID NO: 147616 - RNA, 18 nt, Artificial Sequence
  Description of Artificial Sequence: Synthetic oligonucleotide
ccccagcccagggcaaga

SEQ ID NO: 147617 - RNA, 18 nt, Artificial Sequence
  Description of Artificial Sequence: Synthetic oligonucleotide
uugccccccagcccaggg

SEQ ID NO: 147618 - RNA, 18 nt, Artificial Sequence
  Description of Artificial Sequence: Synthetic oligonucleotide
cuaauuugccccccagcc

SEQ ID NO: 147619 - RNA, 18 nt, Artificial Sequence
  Description of Artificial Sequence: Synthetic oligonucleotide
gccugcuaauuugccccc

SEQ ID NO: 147620 - RNA, 18 nt, Artificial Sequence
  Description of Artificial Sequence: Synthetic oligonucleotide
aaacugccugcuaauuug

SEQ ID NO: 147621 - RNA, 18 nt, Artificial Sequence
  Description of Artificial Sequence: Synthetic oligonucleotide
ccugaaaacugccugcua

SEQ ID NO: 147622 - RNA, 18 nt, Artificial Sequence
  Description of Artificial Sequence: Synthetic oligonucleotide
aacacccugaaaacugcc

SEQ ID NO: 147623 - RNA, 18 nt, Artificial Sequence
  Description of Artificial Sequence: Synthetic oligonucleotide
aaaacaacacccugaaaa

SEQ ID NO: 147624 - RNA, 18 nt, Artificial Sequence
  Description of Artificial Sequence: Synthetic oligonucleotide
acaacaaaacaacacccu

SEQ ID NO: 147625 - RNA, 18 nt, Artificial Sequence
  Description of Artificial Sequence: Synthetic oligonucleotide
agaaaacaacaaaacaac

SEQ ID NO: 147626 - RNA, 18 nt, Artificial Sequence
  Description of Artificial Sequence: Synthetic oligonucleotide
gacagagaaaacaacaaa

SEQ ID NO: 147627 - RNA, 18 nt, Artificial Sequence
  Description of Artificial Sequence: Synthetic oligonucleotide
gaaaagacagagaaaaca

SEQ ID NO: 147628 - RNA, 18 nt, Artificial Sequence
  Description of Artificial Sequence: Synthetic oligonucleotide
agagagaaaagacagaga

SEQ ID NO: 147629 - RNA, 18 nt, Artificial Sequence
  Description of Artificial Sequence: Synthetic oligonucleotide
gagaaagagagaaaagac

SEQ ID NO: 147630 - RNA, 18 nt, Artificial Sequence
  Description of Artificial Sequence: Synthetic oligonucleotide
gaagagagaaagagagaa

SEQ ID NO: 147631 - RNA, 18 nt, Artificial Sequence
  Description of Artificial Sequence: Synthetic oligonucleotide
cagaggaagagagaaaga

SEQ ID NO: 147632 - RNA, 18 nt, Artificial Sequence
  Description of Artificial Sequence: Synthetic oligonucleotide
gcaaacagaggaagagag

SEQ ID NO: 147633 - RNA, 18 nt, Artificial Sequence
  Description of Artificial Sequence: Synthetic oligonucleotide
gggaggcaaacagaggaa

SEQ ID NO: 147634 - RNA, 18 nt, Artificial Sequence
  Description of Artificial Sequence: Synthetic oligonucleotide
ggagagggaggcaaacag

SEQ ID NO: 147635 - RNA, 18 nt, Artificial Sequence
  Description of Artificial Sequence: Synthetic oligonucleotide
agacaggagagggaggca

SEQ ID NO: 147636 - RNA, 18 nt, Artificial Sequence
  Description of Artificial Sequence: Synthetic oligonucleotide
gggagacaggagagggag

SEQ ID NO: 147637 - RNA, 18 nt, Artificial Sequence
  Description of Artificial Sequence: Synthetic oligonucleotide
gaaagauaaagauguggg

SEQ ID NO: 147638 - RNA, 18 nt, Artificial Sequence
  Description of Artificial Sequence: Synthetic oligonucleotide
uuugagaaagauaaagau

SEQ ID NO: 147639 - RNA, 18 nt, Artificial Sequence
  Description of Artificial Sequence: Synthetic oligonucleotide
uuaaguuugagaaagaua

SEQ ID NO: 147640 - RNA, 18 nt, Artificial Sequence
  Description of Artificial Sequence: Synthetic oligonucleotide
gacucuuaaguuugagaa

SEQ ID NO: 147641 - RNA, 18 nt, Artificial Sequence
  Description of Artificial Sequence: Synthetic oligonucleotide
cccacgacucuuaaguuu

SEQ ID NO: 147642 - RNA, 18 nt, Artificial Sequence
  Description of Artificial Sequence: Synthetic oligonucleotide
uggaccccacgacucuua

SEQ ID NO: 147643 - RNA, 18 nt, Artificial Sequence
  Description of Artificial Sequence: Synthetic oligonucleotide
ucuccuggaccccacgac

SEQ ID NO: 147644 - RNA, 18 nt, Artificial Sequence
  Description of Artificial Sequence: Synthetic oligonucleotide
uggagucuccuggacccc

SEQ ID NO: 147645 - RNA, 18 nt, Artificial Sequence
  Description of Artificial Sequence: Synthetic oligonucleotide
acucuuggagucuccugg

SEQ ID NO: 147646 - RNA, 18 nt, Artificial Sequence
  Description of Artificial Sequence: Synthetic oligonucleotide
ugaauacucuuggagucu

SEQ ID NO: 147647 - RNA, 18 nt, Artificial Sequence
  Description of Artificial Sequence: Synthetic oligonucleotide
cuccuagcacagacaggg

SEQ ID NO: 147648 - RNA, 18 nt, Artificial Sequence
  Description of Artificial Sequence: Synthetic oligonucleotide
gagcuccuagcacagaca

SEQ ID NO: 147649 - RNA, 18 nt, Artificial Sequence
  Description of Artificial Sequence: Synthetic oligonucleotide
uauccgagcuccuagcac

SEQ ID NO: 147650 - RNA, 18 nt, Artificial Sequence
  Description of Artificial Sequence: Synthetic oligonucleotide
cuguuuauccgagcuccu

SEQ ID NO: 147651 - RNA, 18 nt, Artificial Sequence
  Description of Artificial Sequence: Synthetic oligonucleotide
gcugacuguuuauccgag

SEQ ID NO: 147652 - RNA, 18 nt, Artificial Sequence
  Description of Artificial Sequence: Synthetic oligonucleotide
gcucggcugacuguuuau

SEQ ID NO: 147653 - RNA, 18 nt, Artificial Sequence
  Description of Artificial Sequence: Synthetic oligonucleotide
ucgaggcucggcugacug

SEQ ID NO: 147654 - RNA, 18 nt, Artificial Sequence
  Description of Artificial Sequence: Synthetic oligonucleotide
gggcgucgaggcucggcu

SEQ ID NO: 147655 - RNA, 18 nt, Artificial Sequence
  Description of Artificial Sequence: Synthetic oligonucleotide
ggaggcggacgauuuggg

SEQ ID NO: 147656 - RNA, 18 nt, Artificial Sequence
  Description of Artificial Sequence: Synthetic oligonucleotide
uuggaggcggacgauuug

SEQ ID NO: 147657 - RNA, 18 nt, Artificial Sequence
  Description of Artificial Sequence: Synthetic oligonucleotide
gcuguccgcgcgugcggg

SEQ ID NO: 147658 - RNA, 18 nt, Artificial Sequence
  Description of Artificial Sequence: Synthetic oligonucleotide
cgggagcuguccgcgcgu

SEQ ID NO: 147659 - RNA, 18 nt, Artificial Sequence
  Description of Artificial Sequence: Synthetic oligonucleotide
caacccgggagcuguccg

SEQ ID NO: 147660 - RNA, 18 nt, Artificial Sequence
  Description of Artificial Sequence: Synthetic oligonucleotide
gcaggcaacccgggagcu

SEQ ID NO: 147661 - RNA, 18 nt, Artificial Sequence
  Description of Artificial Sequence: Synthetic oligonucleotide
gcgccgcaggcaacccgg

SEQ ID NO: 147662 - RNA, 18 nt, Artificial Sequence
  Description of Artificial Sequence: Synthetic oligonucleotide
cgccugcgccgcaggcaa

SEQ ID NO: 147663 - RNA, 18 nt, Artificial Sequence
  Description of Artificial Sequence: Synthetic oligonucleotide
caucccgccugcgccgca

SEQ ID NO: 147664 - RNA, 18 nt, Artificial Sequence
  Description of Artificial Sequence: Synthetic oligonucleotide
agcagcaucccgccugcg

SEQ ID NO: 147665 - RNA, 18 nt, Artificial Sequence
  Description of Artificial Sequence: Synthetic oligonucleotide
ugcgaagcagcaucccgc

SEQ ID NO: 147666 - RNA, 18 nt, Artificial Sequence
  Description of Artificial Sequence: Synthetic oligonucleotide
acuagugcgaagcagcau

SEQ ID NO: 147667 - RNA, 18 nt, Artificial Sequence
  Description of Artificial Sequence: Synthetic oligonucleotide
acuggacuagugcgaagc

SEQ ID NO: 147668 - RNA, 18 nt, Artificial Sequence
  Description of Artificial Sequence: Synthetic oligonucleotide
agaggacuggacuagugc

SEQ ID NO: 147669 - RNA, 18 nt, Artificial Sequence
  Description of Artificial Sequence: Synthetic oligonucleotide
cuggcagaggacuggacu

SEQ ID NO: 147670 - RNA, 18 nt, Artificial Sequence
  Description of Artificial Sequence: Synthetic oligonucleotide
agggccuggcagaggacu

SEQ ID NO: 147671 - RNA, 18 nt, Artificial Sequence
  Description of Artificial Sequence: Synthetic oligonucleotide
gaggaagggccuggcaga

SEQ ID NO: 147672 - RNA, 18 nt, Artificial Sequence
  Description of Artificial Sequence: Synthetic oligonucleotide
gaggagaggaagggccug

SEQ ID NO: 147673 - RNA, 18 nt, Artificial Sequence
  Description of Artificial Sequence: Synthetic oligonucleotide
aaagcgaggagaggaagg

SEQ ID NO: 147674 - RNA, 18 nt, Artificial Sequence
  Description of Artificial Sequence: Synthetic oligonucleotide
guaagaaagcgaggagag

SEQ ID NO: 147675 - RNA, 18 nt, Artificial Sequence
  Description of Artificial Sequence: Synthetic oligonucleotide
agggcguaagaaagcgag

SEQ ID NO: 147676 - RNA, 18 nt, Artificial Sequence
  Description of Artificial Sequence: Synthetic oligonucleotide
cggaaagggcguaagaaa

SEQ ID NO: 147677 - RNA, 18 nt, Artificial Sequence
  Description of Artificial Sequence: Synthetic oligonucleotide
gccagcggaaagggcgua

SEQ ID NO: 147678 - RNA, 18 nt, Artificial Sequence
  Description of Artificial Sequence: Synthetic oligonucleotide
uucaugccagcggaaagg

SEQ ID NO: 147679 - RNA, 18 nt, Artificial Sequence
  Description of Artificial Sequence: Synthetic oligonucleotide
gggaauucaugccagcgg

SEQ ID NO: 147680 - RNA, 18 nt, Artificial Sequence
  Description of Artificial Sequence: Synthetic oligonucleotide
ggagaaaaugccaaaggg

SEQ ID NO: 147681 - RNA, 18 nt, Artificial Sequence
  Description of Artificial Sequence: Synthetic oligonucleotide
gggagaaaaugccaaagg

SEQ ID NO: 147682 - RNA, 18 nt, Artificial Sequence
  Description of Artificial Sequence: Synthetic oligonucleotide
agaugacagaaaagaggg

SEQ ID NO: 147683 - RNA, 18 nt, Artificial Sequence
  Description of Artificial Sequence: Synthetic oligonucleotide
ccagaugacagaaaagag

SEQ ID NO: 147684 - RNA, 18 nt, Artificial Sequence
  Description of Artificial Sequence: Synthetic oligonucleotide
agaaaccagaugacagaa

SEQ ID NO: 147685 - RNA, 18 nt, Artificial Sequence
  Description of Artificial Sequence: Synthetic oligonucleotide
uggagagaaaccagauga

SEQ ID NO: 147686 - RNA, 18 nt, Artificial Sequence
  Description of Artificial Sequence: Synthetic oligonucleotide
gggacuggagagaaacca

SEQ ID NO: 147687 - RNA, 18 nt, Artificial Sequence
  Description of Artificial Sequence: Synthetic oligonucleotide
aagguagaaagcaaaggg

SEQ ID NO: 147688 - RNA, 18 nt, Artificial Sequence
  Description of Artificial Sequence: Synthetic oligonucleotide
caagguagaaagcaaagg

SEQ ID NO: 147689 - RNA, 18 nt, Artificial Sequence
  Description of Artificial Sequence: Synthetic oligonucleotide
cgacgcaagguagaaagc

SEQ ID NO: 147690 - RNA, 18 nt, Artificial Sequence
  Description of Artificial Sequence: Synthetic oligonucleotide
ccuugcgacgcaagguag

SEQ ID NO: 147691 - RNA, 18 nt, Artificial Sequence
  Description of Artificial Sequence: Synthetic oligonucleotide
ucaggccuugcgacgcaa

SEQ ID NO: 147692 - RNA, 18 nt, Artificial Sequence
  Description of Artificial Sequence: Synthetic oligonucleotide
gcgacucaggccuugcga

SEQ ID NO: 147693 - RNA, 18 nt, Artificial Sequence
  Description of Artificial Sequence: Synthetic oligonucleotide
agagggcgacucaggccu

SEQ ID NO: 147694 - RNA, 18 nt, Artificial Sequence
  Description of Artificial Sequence: Synthetic oligonucleotide
gggcgagagggcgacuca

SEQ ID NO: 147695 - RNA, 18 nt, Artificial Sequence
  Description of Artificial Sequence: Synthetic oligonucleotide
gggcugggcgagagggcg

SEQ ID NO: 147696 - RNA, 18 nt, Artificial Sequence
  Description of Artificial Sequence: Synthetic oligonucleotide
gcugggcugaagacuggg

SEQ ID NO: 147697 - RNA, 18 nt, Artificial Sequence
  Description of Artificial Sequence: Synthetic oligonucleotide
gacgcugggcugaagacu

SEQ ID NO: 147698 - RNA, 18 nt, Artificial Sequence
  Description of Artificial Sequence: Synthetic oligonucleotide
gcacagacgcugggcuga

SEQ ID NO: 147699 - RNA, 18 nt, Artificial Sequence
  Description of Artificial Sequence: Synthetic oligonucleotide
uggaagcacagacgcugg

SEQ ID NO: 147700 - RNA, 18 nt, Artificial Sequence
  Description of Artificial Sequence: Synthetic oligonucleotide
gggacuggaagcacagac

SEQ ID NO: 147701 - RNA, 18 nt, Artificial Sequence
  Description of Artificial Sequence: Synthetic oligonucleotide
accacgcggaggaguggg

SEQ ID NO: 147702 - RNA, 18 nt, Artificial Sequence
  Description of Artificial Sequence: Synthetic oligonucleotide
cacgaccacgcggaggag

SEQ ID NO: 147703 - RNA, 18 nt, Artificial Sequence
  Description of Artificial Sequence: Synthetic oligonucleotide
accuccacgaccacgcgg

SEQ ID NO: 147704 - RNA, 18 nt, Artificial Sequence
  Description of Artificial Sequence: Synthetic oligonucleotide
gguggaccuccacgacca

SEQ ID NO: 147705 - RNA, 18 nt, Artificial Sequence
  Description of Artificial Sequence: Synthetic oligonucleotide
aaggugguggaccuccac

SEQ ID NO: 147706 - RNA, 18 nt, Artificial Sequence
  Description of Artificial Sequence: Synthetic oligonucleotide
gaagaaaggugguggacc

SEQ ID NO: 147707 - RNA, 18 nt, Artificial Sequence
  Description of Artificial Sequence: Synthetic oligonucleotide
cuugagaagaaagguggu

SEQ ID NO: 147708 - RNA, 18 nt, Artificial Sequence
  Description of Artificial Sequence: Synthetic oligonucleotide
ccgagcuugagaagaaag

SEQ ID NO: 147709 - RNA, 18 nt, Artificial Sequence
  Description of Artificial Sequence: Synthetic oligonucleotide
uguucccgagcuugagaa

SEQ ID NO: 147710 - RNA, 18 nt, Artificial Sequence
  Description of Artificial Sequence: Synthetic oligonucleotide
gggcauguucccgagcuu

SEQ ID NO: 147711 - RNA, 18 nt, Artificial Sequence
  Description of Artificial Sequence: Synthetic oligonucleotide
cggaagggcauguucccg

SEQ ID NO: 147712 - RNA, 18 nt, Artificial Sequence
  Description of Artificial Sequence: Synthetic oligonucleotide
cagggcggaagggcaugu

SEQ ID NO: 147713 - RNA, 18 nt, Artificial Sequence
  Description of Artificial Sequence: Synthetic oligonucleotide
gcaggcagggcggaaggg

SEQ ID NO: 147714 - RNA, 18 nt, Artificial Sequence
  Description of Artificial Sequence: Synthetic oligonucleotide
aggaagcaggcagggcgg

SEQ ID NO: 147715 - RNA, 18 nt, Artificial Sequence
  Description of Artificial Sequence: Synthetic oligonucleotide
ggcgaaggaagcaggcag

SEQ ID NO: 147716 - RNA, 18 nt, Artificial Sequence
  Description of Artificial Sequence: Synthetic oligonucleotide
ggacgggcgaaggaagca

SEQ ID NO: 147717 - RNA, 18 nt, Artificial Sequence
  Description of Artificial Sequence: Synthetic oligonucleotide
gcccgggacgggcgaagg

SEQ ID NO: 147718 - RNA, 18 nt, Artificial Sequence
  Description of Artificial Sequence: Synthetic oligonucleotide
ccgcggcccgggacgggc

SEQ ID NO: 147719 - RNA, 18 nt, Artificial Sequence
  Description of Artificial Sequence: Synthetic oligonucleotide
aggguccgcggcccggga

SEQ ID NO: 147720 - RNA, 18 nt, Artificial Sequence
  Description of Artificial Sequence: Synthetic oligonucleotide
uagucaggguccgcggcc

SEQ ID NO: 147721 - RNA, 18 nt, Artificial Sequence
  Description of Artificial Sequence: Synthetic oligonucleotide
gccauuagucaggguccg

SEQ ID NO: 147722 - RNA, 18 nt, Artificial Sequence
  Description of Artificial Sequence: Synthetic oligonucleotide
gaccggccauuagucagg

SEQ ID NO: 147723 - RNA, 18 nt, Artificial Sequence
  Description of Artificial Sequence: Synthetic oligonucleotide
gcagggaccggccauuag

SEQ ID NO: 147724 - RNA, 18 nt, Artificial Sequence
  Description of Artificial Sequence: Synthetic oligonucleotide
acacagcagggaccggcc

SEQ ID NO: 147725 - RNA, 18 nt, Artificial Sequence
  Description of Artificial Sequence: Synthetic oligonucleotide
cccacacacagcagggac

SEQ ID NO: 147726 - RNA, 18 nt, Artificial Sequence
  Description of Artificial Sequence: Synthetic oligonucleotide
aacaccccacacacagca

SEQ ID NO: 147727 - RNA, 18 nt, Artificial Sequence
  Description of Artificial Sequence: Synthetic oligonucleotide
aacacaacaccccacaca

SEQ ID NO: 147728 - RNA, 18 nt, Artificial Sequence
  Description of Artificial Sequence: Synthetic oligonucleotide
aaaaaaacacaacacccc

SEQ ID NO: 147729 - RNA, 18 nt, Artificial Sequence
  Description of Artificial Sequence: Synthetic oligonucleotide
uucacacccccgugcccu

SEQ ID NO: 147730 - RNA, 18 nt, Artificial Sequence
  Description of Artificial Sequence: Synthetic oligonucleotide
gcugguucacacccccgu

SEQ ID NO: 147731 - RNA, 18 nt, Artificial Sequence
  Description of Artificial Sequence: Synthetic oligonucleotide
cccgagcugguucacacc

SEQ ID NO: 147732 - RNA, 18 nt, Artificial Sequence
  Description of Artificial Sequence: Synthetic oligonucleotide
acccccccgagcugguuc

SEQ ID NO: 147733 - RNA, 18 nt, Artificial Sequence
  Description of Artificial Sequence: Synthetic oligonucleotide
caaacacccccccgagcu

SEQ ID NO: 147734 - RNA, 18 nt, Artificial Sequence
  Description of Artificial Sequence: Synthetic oligonucleotide
guucacaaacaccccccc

SEQ ID NO: 147735 - RNA, 18 nt, Artificial Sequence
  Description of Artificial Sequence: Synthetic oligonucleotide
cggccguucacaaacacc

SEQ ID NO: 147736 - RNA, 18 nt, Artificial Sequence
  Description of Artificial Sequence: Synthetic oligonucleotide
gggccggccguucacaaa

SEQ ID NO: 147737 - RNA, 18 nt, Artificial Sequence
  Description of Artificial Sequence: Synthetic oligonucleotide
ucaccacgucggguaggg

SEQ ID NO: 147738 - RNA, 18 nt, Artificial Sequence
  Description of Artificial Sequence: Synthetic oligonucleotide
cugccucaccacgucggg

SEQ ID NO: 147739 - RNA, 18 nt, Artificial Sequence
  Description of Artificial Sequence: Synthetic oligonucleotide
augcgcugccucaccacg

SEQ ID NO: 147740 - RNA, 18 nt, Artificial Sequence
  Description of Artificial Sequence: Synthetic oligonucleotide
ccacgaugcgcugccuca

SEQ ID NO: 147741 - RNA, 18 nt, Artificial Sequence
  Description of Artificial Sequence: Synthetic oligonucleotide
cagcuccacgaugcgcug

SEQ ID NO: 147742 - RNA, 18 nt, Artificial Sequence
  Description of Artificial Sequence: Synthetic oligonucleotide
ugggccagcuccacgaug

SEQ ID NO: 147743 - RNA, 18 nt, Artificial Sequence
  Description of Artificial Sequence: Synthetic oligonucleotide
ccuggugggccagcucca

SEQ ID NO: 147744 - RNA, 18 nt, Artificial Sequence
  Description of Artificial Sequence: Synthetic oligonucleotide
cacacccuggugggccag

SEQ ID NO: 147745 - RNA, 18 nt, Artificial Sequence
  Description of Artificial Sequence: Synthetic oligonucleotide
ggccgcacacccuggugg

SEQ ID NO: 147746 - RNA, 18 nt, Artificial Sequence
  Description of Artificial Sequence: Synthetic oligonucleotide
cacagggccgcacacccu

SEQ ID NO: 147747 - RNA, 18 nt, Artificial Sequence
  Description of Artificial Sequence: Synthetic oligonucleotide
gaugucacagggccgcac

SEQ ID NO: 147748 - RNA, 18 nt, Artificial Sequence
  Description of Artificial Sequence: Synthetic oligonucleotide
cgggagaugucacagggc

SEQ ID NO: 147749 - RNA, 18 nt, Artificial Sequence
  Description of Artificial Sequence: Synthetic oligonucleotide
gcugccgggagaugucac

SEQ ID NO: 147750 - RNA, 18 nt, Artificial Sequence
  Description of Artificial Sequence: Synthetic oligonucleotide
ccgcagcugccgggagau

SEQ ID NO: 147751 - RNA, 18 nt, Artificial Sequence
  Description of Artificial Sequence: Synthetic oligonucleotide
cugacccgcagcugccgg

SEQ ID NO: 147752 - RNA, 18 nt, Artificial Sequence
  Description of Artificial Sequence: Synthetic oligonucleotide
cguggcugacccgcagcu

SEQ ID NO: 147753 - RNA, 18 nt, Artificial Sequence
  Description of Artificial Sequence: Synthetic oligonucleotide
acagccguggcugacccg

SEQ ID NO: 147754 - RNA, 18 nt, Artificial Sequence
  Description of Artificial Sequence: Synthetic oligonucleotide
cugacacagccguggcug

SEQ ID NO: 147755 - RNA, 18 nt, Artificial Sequence
  Description of Artificial Sequence: Synthetic oligonucleotide
uuuugcugacacagccgu

SEQ ID NO: 147756 - RNA, 18 nt, Artificial Sequence
  Description of Artificial Sequence: Synthetic oligonucleotide
caggauuuugcugacaca

SEQ ID NO: 147757 - RNA, 18 nt, Artificial Sequence
  Description of Artificial Sequence: Synthetic oligonucleotide
cugcccaggauuuugcug

SEQ ID NO: 147758 - RNA, 18 nt, Artificial Sequence
  Description of Artificial Sequence: Synthetic oligonucleotide
cgcgcgggccaggccccc

SEQ ID NO: 147759 - RNA, 18 nt, Artificial Sequence
  Description of Artificial Sequence: Synthetic oligonucleotide
gggagcgcgcgggccagg

SEQ ID NO: 147760 - RNA, 18 nt, Artificial Sequence
  Description of Artificial Sequence: Synthetic oligonucleotide
guggcgccugcgggaggg

SEQ ID NO: 147761 - RNA, 18 nt, Artificial Sequence
  Description of Artificial Sequence: Synthetic oligonucleotide
agguggcgccugcgggag

SEQ ID NO: 147762 - RNA, 18 nt, Artificial Sequence
  Description of Artificial Sequence: Synthetic oligonucleotide
guccgagguggcgccugc

SEQ ID NO: 147763 - RNA, 18 nt, Artificial Sequence
  Description of Artificial Sequence: Synthetic oligonucleotide
gggauguccgagguggcg

SEQ ID NO: 147764 - RNA, 18 nt, Artificial Sequence
  Description of Artificial Sequence: Synthetic oligonucleotide
agaaguagcaaucccggg

SEQ ID NO: 147765 - RNA, 18 nt, Artificial Sequence
  Description of Artificial Sequence: Synthetic oligonucleotide
gagaaguagcaaucccgg

SEQ ID NO: 147766 - RNA, 18 nt, Artificial Sequence
  Description of Artificial Sequence: Synthetic oligonucleotide
uggcagagaaguagcaau

SEQ ID NO: 147767 - RNA, 18 nt, Artificial Sequence
  Description of Artificial Sequence: Synthetic oligonucleotide
gaaguuggcagagaagua

SEQ ID NO: 147768 - RNA, 18 nt, Artificial Sequence
  Description of Artificial Sequence: Synthetic oligonucleotide
uuggcgaaguuggcagag

SEQ ID NO: 147769 - RNA, 18 nt, Artificial Sequence
  Description of Artificial Sequence: Synthetic oligonucleotide
gcgaguuggcgaaguugg

SEQ ID NO: 147770 - RNA, 18 nt, Artificial Sequence
  Description of Artificial Sequence: Synthetic oligonucleotide
ugcuggcgaguuggcgaa

SEQ ID NO: 147771 - RNA, 18 nt, Artificial Sequence
  Description of Artificial Sequence: Synthetic oligonucleotide
ccaagugcuggcgaguug

SEQ ID NO: 147772 - RNA, 18 nt, Artificial Sequence
  Description of Artificial Sequence: Synthetic oligonucleotide
ccucuccaagugcuggcg

SEQ ID NO: 147773 - RNA, 18 nt, Artificial Sequence
  Description of Artificial Sequence: Synthetic oligonucleotide
ccgggccucuccaagugc

SEQ ID NO: 147774 - RNA, 18 nt, Artificial Sequence
  Description of Artificial Sequence: Synthetic oligonucleotide
gggagccgggccucucca

SEQ ID NO: 147775 - RNA, 18 nt, Artificial Sequence
  Description of Artificial Sequence: Synthetic oligonucleotide
cagagggcgccgggaggg

SEQ ID NO: 147776 - RNA, 18 nt, Artificial Sequence
  Description of Artificial Sequence: Synthetic oligonucleotide
cggucagagggcgccggg

SEQ ID NO: 147777 - RNA, 18 nt, Artificial Sequence
  Description of Artificial Sequence: Synthetic oligonucleotide
ggucggagagcgcgcggg

SEQ ID NO: 147778 - RNA, 18 nt, Artificial Sequence
  Description of Artificial Sequence: Synthetic oligonucleotide
gcgguggucggagagcgc

SEQ ID NO: 147779 - RNA, 18 nt, Artificial Sequence
  Description of Artificial Sequence: Synthetic oligonucleotide
gagaggcgguggucggag

SEQ ID NO: 147780 - RNA, 18 nt, Artificial Sequence
  Description of Artificial Sequence: Synthetic oligonucleotide
cauccgagaggcgguggu

SEQ ID NO: 147781 - RNA, 18 nt, Artificial Sequence
  Description of Artificial Sequence: Synthetic oligonucleotide
cuggucauccgagaggcg

SEQ ID NO: 147782 - RNA, 18 nt, Artificial Sequence
  Description of Artificial Sequence: Synthetic oligonucleotide
ggaaccuggucauccgag

SEQ ID NO: 147783 - RNA, 18 nt, Artificial Sequence
  Description of Artificial Sequence: Synthetic oligonucleotide
ccccuggaaccuggucau

SEQ ID NO: 147784 - RNA, 18 nt, Artificial Sequence
  Description of Artificial Sequence: Synthetic oligonucleotide
cagcuccccuggaaccug

SEQ ID NO: 147785 - RNA, 18 nt, Artificial Sequence
  Description of Artificial Sequence: Synthetic oligonucleotide
ucgcucagcuccccugga

SEQ ID NO: 147786 - RNA, 18 nt, Artificial Sequence
  Description of Artificial Sequence: Synthetic oligonucleotide
gcgacucgcucagcuccc

SEQ ID NO: 147787 - RNA, 18 nt, Artificial Sequence
  Description of Artificial Sequence: Synthetic oligonucleotide
gggaggcgacucgcucag

SEQ ID NO: 147788 - RNA, 18 nt, Artificial Sequence
  Description of Artificial Sequence: Synthetic oligonucleotide
gggcugaagcugggcggg

SEQ ID NO: 147789 - RNA, 18 nt, Artificial Sequence
  Description of Artificial Sequence: Synthetic oligonucleotide
agggcugaagcugggcgg

SEQ ID NO: 147790 - RNA, 18 nt, Artificial Sequence
  Description of Artificial Sequence: Synthetic oligonucleotide
cagccagggcugaagcug

SEQ ID NO: 147791 - RNA, 18 nt, Artificial Sequence
  Description of Artificial Sequence: Synthetic oligonucleotide
agcugcagccagggcuga

SEQ ID NO: 147792 - RNA, 18 nt, Artificial Sequence
  Description of Artificial Sequence: Synthetic oligonucleotide
gcugcagcugcagccagg

SEQ ID NO: 147793 - RNA, 18 nt, Artificial Sequence
  Description of Artificial Sequence: Synthetic oligonucleotide
cucgcgcugcagcugcag

SEQ ID NO: 147794 - RNA, 18 nt, Artificial Sequence
  Description of Artificial Sequence: Synthetic oligonucleotide
cauggcucgcgcugcagc

SEQ ID NO: 147795 - RNA, 18 nt, Artificial Sequence
  Description of Artificial Sequence: Synthetic oligonucleotide
gggcgcauggcucgcgcu

SEQ ID NO: 147796 - RNA, 18 nt, Artificial Sequence
  Description of Artificial Sequence: Synthetic oligonucleotide
gcggugggccgggccggg

SEQ ID NO: 147797 - RNA, 18 nt, Artificial Sequence
  Description of Artificial Sequence: Synthetic oligonucleotide
gggcggugggccgggccg

SEQ ID NO: 147798 - RNA, 18 nt, Artificial Sequence
  Description of Artificial Sequence: Synthetic oligonucleotide
cagcagaauggccccggg

SEQ ID NO: 147799 - RNA, 18 nt, Artificial Sequence
  Description of Artificial Sequence: Synthetic oligonucleotide
gucagcagaauggccccg

SEQ ID NO: 147800 - RNA, 18 nt, Artificial Sequence
  Description of Artificial Sequence: Synthetic oligonucleotide
gggcggucagcagaaugg

SEQ ID NO: 147801 - RNA, 18 nt, Artificial Sequence
  Description of Artificial Sequence: Synthetic oligonucleotide
gggcugggcggucagcag

SEQ ID NO: 147802 - RNA, 18 nt, Artificial Sequence
  Description of Artificial Sequence: Synthetic oligonucleotide
caacuugccacugucggg

SEQ ID NO: 147803 - RNA, 18 nt, Artificial Sequence
  Description of Artificial Sequence: Synthetic oligonucleotide
cgcaacuugccacugucg

SEQ ID NO: 147804 - RNA, 18 nt, Artificial Sequence
  Description of Artificial Sequence: Synthetic oligonucleotide
guagccgcaacuugccac

SEQ ID NO: 147805 - RNA, 18 nt, Artificial Sequence
  Description of Artificial Sequence: Synthetic oligonucleotide
cugcaguagccgcaacuu

SEQ ID NO: 147806 - RNA, 18 nt, Artificial Sequence
  Description of Artificial Sequence: Synthetic oligonucleotide
ugcaacugcaguagccgc

SEQ ID NO: 147807 - RNA, 18 nt, Artificial Sequence
  Description of Artificial Sequence: Synthetic oligonucleotide
gagcuugcaacugcagua

SEQ ID NO: 147808 - RNA, 18 nt, Artificial Sequence
  Description of Artificial Sequence: Synthetic oligonucleotide
ggccggagcuugcaacug

SEQ ID NO: 147809 - RNA, 18 nt, Artificial Sequence
  Description of Artificial Sequence: Synthetic oligonucleotide
ggguuggccggagcuugc

SEQ ID NO: 147810 - RNA, 18 nt, Artificial Sequence
  Description of Artificial Sequence: Synthetic oligonucleotide
ccuccggguuggccggag

SEQ ID NO: 147811 - RNA, 18 nt, Artificial Sequence
  Description of Artificial Sequence: Synthetic oligonucleotide
gggcuccuccggguuggc

SEQ ID NO: 147812 - RNA, 18 nt, Artificial Sequence
  Description of Artificial Sequence: Synthetic oligonucleotide
acugcgcuccccgcuggg

SEQ ID NO: 147813 - RNA, 18 nt, Artificial Sequence
  Description of Artificial Sequence: Synthetic oligonucleotide
cagcacugcgcuccccgc

SEQ ID NO: 147814 - RNA, 18 nt, Artificial Sequence
  Description of Artificial Sequence: Synthetic oligonucleotide
gggcgcagcacugcgcuc

SEQ ID NO: 147815 - RNA, 18 nt, Artificial Sequence
  Description of Artificial Sequence: Synthetic oligonucleotide
acgcccggcugcugcggg

SEQ ID NO: 147816 - RNA, 18 nt, Artificial Sequence
  Description of Artificial Sequence: Synthetic oligonucleotide
ugaacgcccggcugcugc

SEQ ID NO: 147817 - RNA, 18 nt, Artificial Sequence
  Description of Artificial Sequence: Synthetic oligonucleotide
augagugaacgcccggcu

SEQ ID NO: 147818 - RNA, 18 nt, Artificial Sequence
  Description of Artificial Sequence: Synthetic oligonucleotide
ggaggaugagugaacgcc

SEQ ID NO: 147819 - RNA, 18 nt, Artificial Sequence
  Description of Artificial Sequence: Synthetic oligonucleotide
gggagggaggaugaguga

SEQ ID NO: 147820 - RNA, 18 nt, Artificial Sequence
  Description of Artificial Sequence: Synthetic oligonucleotide
aaagggagggacgguggg

SEQ ID NO: 147821 - RNA, 18 nt, Artificial Sequence
  Description of Artificial Sequence: Synthetic oligonucleotide
gaaaagggagggacggug

SEQ ID NO: 147822 - RNA, 18 nt, Artificial Sequence
  Description of Artificial Sequence: Synthetic oligonucleotide
gaggagaaaagggaggga

SEQ ID NO: 147823 - RNA, 18 nt, Artificial Sequence
  Description of Artificial Sequence: Synthetic oligonucleotide
gacuugaggagaaaaggg

SEQ ID NO: 147824 - RNA, 18 nt, Artificial Sequence
  Description of Artificial Sequence: Synthetic oligonucleotide
uucaggacuugaggagaa

SEQ ID NO: 147825 - RNA, 18 nt, Artificial Sequence
  Description of Artificial Sequence: Synthetic oligonucleotide
ucaacuucaggacuugag

SEQ ID NO: 147826 - RNA, 18 nt, Artificial Sequence
  Description of Artificial Sequence: Synthetic oligonucleotide
caaacucaacuucaggac

SEQ ID NO: 147827 - RNA, 18 nt, Artificial Sequence
  Description of Artificial Sequence: Synthetic oligonucleotide
ccucucaaacucaacuuc

SEQ ID NO: 147828 - RNA, 18 nt, Artificial Sequence
  Description of Artificial Sequence: Synthetic oligonucleotide
ugucgccucucaaacuca

SEQ ID NO: 147829 - RNA, 18 nt, Artificial Sequence
  Description of Artificial Sequence: Synthetic oligonucleotide
cgccgugucgccucucaa

SEQ ID NO: 147830 - RNA, 18 nt, Artificial Sequence
  Description of Artificial Sequence: Synthetic oligonucleotide
gccgccgccgugucgccu

SEQ ID NO: 147831 - RNA, 18 nt, Artificial Sequence
  Description of Artificial Sequence: Synthetic oligonucleotide
cggccgccgccgccgugu

SEQ ID NO: 147832 - RNA, 18 nt, Artificial Sequence
  Description of Artificial Sequence: Synthetic oligonucleotide
cagcgcggccgccgccgc

SEQ ID NO: 147833 - RNA, 18 nt, Artificial Sequence
  Description of Artificial Sequence: Synthetic oligonucleotide
gggagcagcgcggccgcc

SEQ ID NO: 147834 - RNA, 18 nt, Artificial Sequence
  Description of Artificial Sequence: Synthetic oligonucleotide
ggagcgggagcagcgcgg

SEQ ID NO: 147835 - RNA, 18 nt, Artificial Sequence
  Description of Artificial Sequence: Synthetic oligonucleotide
gcagaggagcgggagcag

SEQ ID NO: 147836 - RNA, 18 nt, Artificial Sequence
  Description of Artificial Sequence: Synthetic oligonucleotide
gggaggcagaggagcggg

SEQ ID NO: 147837 - RNA, 18 nt, Artificial Sequence
  Description of Artificial Sequence: Synthetic oligonucleotide
gcagugcauauccauggg

SEQ ID NO: 147838 - RNA, 18 nt, Artificial Sequence
  Description of Artificial Sequence: Synthetic oligonucleotide
ugcagugcauauccaugg

SEQ ID NO: 147839 - RNA, 18 nt, Artificial Sequence
  Description of Artificial Sequence: Synthetic oligonucleotide
ugcuuugcagugcauauc

SEQ ID NO: 147840 - RNA, 18 nt, Artificial Sequence
  Description of Artificial Sequence: Synthetic oligonucleotide
gggucugcuuugcagugc

SEQ ID NO: 147841 - RNA, 18 nt, Artificial Sequence
  Description of Artificial Sequence: Synthetic oligonucleotide
gugcaucgcggagaaggg

SEQ ID NO: 147842 - RNA, 18 nt, Artificial Sequence
  Description of Artificial Sequence: Synthetic oligonucleotide
aggagccgggcgccggua

SEQ ID NO: 147843 - RNA, 18 nt, Artificial Sequence
  Description of Artificial Sequence: Synthetic oligonucleotide
gggacaggagccgggcgc

SEQ ID NO: 147844 - RNA, 18 nt, Artificial Sequence
  Description of Artificial Sequence: Synthetic oligonucleotide
gagccgggacaggagccg

SEQ ID NO: 147845 - RNA, 18 nt, Artificial Sequence
  Description of Artificial Sequence: Synthetic oligonucleotide
gccccgagccgggacagg

SEQ ID NO: 147846 - RNA, 18 nt, Artificial Sequence
  Description of Artificial Sequence: Synthetic oligonucleotide
ggagagccccgagccggg

SEQ ID NO: 147847 - RNA, 18 nt, Artificial Sequence
  Description of Artificial Sequence: Synthetic oligonucleotide
gggacggagagccccgag

SEQ ID NO: 147848 - RNA, 18 nt, Artificial Sequence
  Description of Artificial Sequence: Synthetic oligonucleotide
ggguugggacggagagcc

SEQ ID NO: 147849 - RNA, 18 nt, Artificial Sequence
  Description of Artificial Sequence: Synthetic oligonucleotide
ggacaggguugggacgga

SEQ ID NO: 147850 - RNA, 18 nt, Artificial Sequence
  Description of Artificial Sequence: Synthetic oligonucleotide
ggacuggacaggguuggg

SEQ ID NO: 147851 - RNA, 18 nt, Artificial Sequence
  Description of Artificial Sequence: Synthetic oligonucleotide
cgcugggacuggacaggg

SEQ ID NO: 147852 - RNA, 18 nt, Artificial Sequence
  Description of Artificial Sequence: Synthetic oligonucleotide
ggccacgcugggacugga

SEQ ID NO: 147853 - RNA, 18 nt, Artificial Sequence
  Description of Artificial Sequence: Synthetic oligonucleotide
gggccacgcugggacugg

SEQ ID NO: 147854 - RNA, 18 nt, Artificial Sequence
  Description of Artificial Sequence: Synthetic oligonucleotide
gggaccugagcgcgaggg

SEQ ID NO: 147855 - RNA, 18 nt, Artificial Sequence
  Description of Artificial Sequence: Synthetic oligonucleotide
aagaugggaccugagcgc

SEQ ID NO: 147856 - RNA, 18 nt, Artificial Sequence
  Description of Artificial Sequence: Synthetic oligonucleotide
ccuccaagaugggaccug

SEQ ID NO: 147857 - RNA, 18 nt, Artificial Sequence
  Description of Artificial Sequence: Synthetic oligonucleotide
ggaggccuccaagauggg

SEQ ID NO: 147858 - RNA, 18 nt, Artificial Sequence
  Description of Artificial Sequence: Synthetic oligonucleotide
gccagggaggccuccaag

SEQ ID NO: 147859 - RNA, 18 nt, Artificial Sequence
  Description of Artificial Sequence: Synthetic oligonucleotide
cagaagccagggaggccu

SEQ ID NO: 147860 - RNA, 18 nt, Artificial Sequence
  Description of Artificial Sequence: Synthetic oligonucleotide
gggaccagaagccaggga

SEQ ID NO: 147861 - RNA, 18 nt, Artificial Sequence
  Description of Artificial Sequence: Synthetic oligonucleotide
aaagagggaccagaagcc

SEQ ID NO: 147862 - RNA, 18 nt, Artificial Sequence
  Description of Artificial Sequence: Synthetic oligonucleotide
aacgaaaagagggaccag

SEQ ID NO: 147863 - RNA, 18 nt, Artificial Sequence
  Description of Artificial Sequence: Synthetic oligonucleotide
gaaagaacgaaaagaggg

SEQ ID NO: 147864 - RNA, 18 nt, Artificial Sequence
  Description of Artificial Sequence: Synthetic oligonucleotide
ggagagaaagaacgaaaa

SEQ ID NO: 147865 - RNA, 18 nt, Artificial Sequence
  Description of Artificial Sequence: Synthetic oligonucleotide
gcgagggagagaaagaac

SEQ ID NO: 147866 - RNA, 18 nt, Artificial Sequence
  Description of Artificial Sequence: Synthetic oligonucleotide
accgggcgagggagagaa

SEQ ID NO: 147867 - RNA, 18 nt, Artificial Sequence
  Description of Artificial Sequence: Synthetic oligonucleotide
gaaacaccgggcgaggga

SEQ ID NO: 147868 - RNA, 18 nt, Artificial Sequence
  Description of Artificial Sequence: Synthetic oligonucleotide
cauuagaaacaccgggcg

SEQ ID NO: 147869 - RNA, 18 nt, Artificial Sequence
  Description of Artificial Sequence: Synthetic oligonucleotide
ggaggcauuagaaacacc

SEQ ID NO: 147870 - RNA, 18 nt, Artificial Sequence
  Description of Artificial Sequence: Synthetic oligonucleotide
aaacuggaggcauuagaa

SEQ ID NO: 147871 - RNA, 18 nt, Artificial Sequence
  Description of Artificial Sequence: Synthetic oligonucleotide
gagagaaacuggaggcau

SEQ ID NO: 147872 - RNA, 18 nt, Artificial Sequence
  Description of Artificial Sequence: Synthetic oligonucleotide
ggcaggagagaaacugga

SEQ ID NO: 147873 - RNA, 18 nt, Artificial Sequence
  Description of Artificial Sequence: Synthetic oligonucleotide
cagaaggcaggagagaaa

SEQ ID NO: 147874 - RNA, 18 nt, Artificial Sequence
  Description of Artificial Sequence: Synthetic oligonucleotide
ggugacagaaggcaggag

SEQ ID NO: 147875 - RNA, 18 nt, Artificial Sequence
  Description of Artificial Sequence: Synthetic oligonucleotide
gaaugggugacagaaggc

SEQ ID NO: 147876 - RNA, 18 nt, Artificial Sequence
  Description of Artificial Sequence: Synthetic oligonucleotide
gguaagaaugggugacag

SEQ ID NO: 147877 - RNA, 18 nt, Artificial Sequence
  Description of Artificial Sequence: Synthetic oligonucleotide
agagagguaagaaugggu

SEQ ID NO: 147878 - RNA, 18 nt, Artificial Sequence
  Description of Artificial Sequence: Synthetic oligonucleotide
cagacagagagguaagaa

SEQ ID NO: 147879 - RNA, 18 nt, Artificial Sequence
  Description of Artificial Sequence: Synthetic oligonucleotide
gcaggcagacagagaggu

SEQ ID NO: 147880 - RNA, 18 nt, Artificial Sequence
  Description of Artificial Sequence: Synthetic oligonucleotide
ggaaggcaggcagacaga

SEQ ID NO: 147881 - RNA, 18 nt, Artificial Sequence
  Description of Artificial Sequence: Synthetic oligonucleotide
agguaggaaggcaggcag

SEQ ID NO: 147882 - RNA, 18 nt, Artificial Sequence
  Description of Artificial Sequence: Synthetic oligonucleotide
agggaagguaggaaggca

SEQ ID NO: 147883 - RNA, 18 nt, Artificial Sequence
  Description of Artificial Sequence: Synthetic oligonucleotide
ggaucagggaagguagga

SEQ ID NO: 147884 - RNA, 18 nt, Artificial Sequence
  Description of Artificial Sequence: Synthetic oligonucleotide
gauagggaucagggaagg

SEQ ID NO: 147885 - RNA, 18 nt, Artificial Sequence
  Description of Artificial Sequence: Synthetic oligonucleotide
caggugauagggaucagg

SEQ ID NO: 147886 - RNA, 18 nt, Artificial Sequence
  Description of Artificial Sequence: Synthetic oligonucleotide
aaaggcaggugauaggga

SEQ ID NO: 147887 - RNA, 18 nt, Artificial Sequence
  Description of Artificial Sequence: Synthetic oligonucleotide
agagcaaaggcaggugau

SEQ ID NO: 147888 - RNA, 18 nt, Artificial Sequence
  Description of Artificial Sequence: Synthetic oligonucleotide
uagaaagagcaaaggcag

SEQ ID NO: 147889 - RNA, 18 nt, Artificial Sequence
  Description of Artificial Sequence: Synthetic oligonucleotide
gcggauagaaagagcaaa

SEQ ID NO: 147890 - RNA, 18 nt, Artificial Sequence
  Description of Artificial Sequence: Synthetic oligonucleotide
aaggagcggauagaaaga

SEQ ID NO: 147891 - RNA, 18 nt, Artificial Sequence
  Description of Artificial Sequence: Synthetic oligonucleotide
cuaagaaggagcggauag

SEQ ID NO: 147892 - RNA, 18 nt, Artificial Sequence
  Description of Artificial Sequence: Synthetic oligonucleotide
augaccuaagaaggagcg

SEQ ID NO: 147893 - RNA, 18 nt, Artificial Sequence
  Description of Artificial Sequence: Synthetic oligonucleotide
aucccaugaccuaagaag

SEQ ID NO: 147894 - RNA, 18 nt, Artificial Sequence
  Description of Artificial Sequence: Synthetic oligonucleotide
cguggaucccaugaccua

SEQ ID NO: 147895 - RNA, 18 nt, Artificial Sequence
  Description of Artificial Sequence: Synthetic oligonucleotide
gaggccguggaucccaug

SEQ ID NO: 147896 - RNA, 18 nt, Artificial Sequence
  Description of Artificial Sequence: Synthetic oligonucleotide
gcuccgaggccguggauc

SEQ ID NO: 147897 - RNA, 18 nt, Artificial Sequence
  Description of Artificial Sequence: Synthetic oligonucleotide
ccagggcuccgaggccgu

SEQ ID NO: 147898 - RNA, 18 nt, Artificial Sequence
  Description of Artificial Sequence: Synthetic oligonucleotide
uggaaccagggcuccgag

SEQ ID NO: 147899 - RNA, 18 nt, Artificial Sequence
  Description of Artificial Sequence: Synthetic oligonucleotide
guggcuggaaccagggcu

SEQ ID NO: 147900 - RNA, 18 nt, Artificial Sequence
  Description of Artificial Sequence: Synthetic oligonucleotide
agaggguggcuggaacca

SEQ ID NO: 147901 - RNA, 18 nt, Artificial Sequence
  Description of Artificial Sequence: Synthetic oligonucleotide
uagggagaggguggcugg

SEQ ID NO: 147902 - RNA, 18 nt, Artificial Sequence
  Description of Artificial Sequence: Synthetic oligonucleotide
cugacuagggagagggug

SEQ ID NO: 147903 - RNA, 18 nt, Artificial Sequence
  Description of Artificial Sequence: Synthetic oligonucleotide
agaggcugacuagggaga

SEQ ID NO: 147904 - RNA, 18 nt, Artificial Sequence
  Description of Artificial Sequence: Synthetic oligonucleotide
gggcaagaggcugacuag

SEQ ID NO: 147905 - RNA, 18 nt, Artificial Sequence
  Description of Artificial Sequence: Synthetic oligonucleotide
gcccagggcaagaggcug

SEQ ID NO: 147906 - RNA, 18 nt, Artificial Sequence
  Description of Artificial Sequence: Synthetic oligonucleotide
ccccagcccagggcaaga

SEQ ID NO: 147907 - RNA, 18 nt, Artificial Sequence
  Description of Artificial Sequence: Synthetic oligonucleotide
uugccccccagcccaggg

SEQ ID NO: 147908 - RNA, 18 nt, Artificial Sequence
  Description of Artificial Sequence: Synthetic oligonucleotide
cuaauuugccccccagcc

SEQ ID NO: 147909 - RNA, 18 nt, Artificial Sequence
  Description of Artificial Sequence: Synthetic oligonucleotide
gccugcuaauuugccccc

SEQ ID NO: 147910 - RNA, 18 nt, Artificial Sequence
  Description of Artificial Sequence: Synthetic oligonucleotide
aaacugccugcuaauuug

SEQ ID NO: 147911 - RNA, 18 nt, Artificial Sequence
  Description of Artificial Sequence: Synthetic oligonucleotide
ccugaaaacugccugcua

SEQ ID NO: 147912 - RNA, 18 nt, Artificial Sequence
  Description of Artificial Sequence: Synthetic oligonucleotide
aacacccugaaaacugcc

SEQ ID NO: 147913 - RNA, 18 nt, Artificial Sequence
  Description of Artificial Sequence: Synthetic oligonucleotide
aaaacaacacccugaaaa

SEQ ID NO: 147914 - RNA, 18 nt, Artificial Sequence
  Description of Artificial Sequence: Synthetic oligonucleotide
acaacaaaacaacacccu

SEQ ID NO: 147915 - RNA, 18 nt, Artificial Sequence
  Description of Artificial Sequence: Synthetic oligonucleotide
agaaaacaacaaaacaac

SEQ ID NO: 147916 - RNA, 18 nt, Artificial Sequence
  Description of Artificial Sequence: Synthetic oligonucleotide
gacagagaaaacaacaaa

SEQ ID NO: 147917 - RNA, 18 nt, Artificial Sequence
  Description of Artificial Sequence: Synthetic oligonucleotide
gaaaagacagagaaaaca

SEQ ID NO: 147918 - RNA, 18 nt, Artificial Sequence
  Description of Artificial Sequence: Synthetic oligonucleotide
agagagaaaagacagaga

SEQ ID NO: 147919 - RNA, 18 nt, Artificial Sequence
  Description of Artificial Sequence: Synthetic oligonucleotide
gagaaagagagaaaagac

SEQ ID NO: 147920 - RNA, 18 nt, Artificial Sequence
  Description of Artificial Sequence: Synthetic oligonucleotide
gaagagagaaagagagaa

SEQ ID NO: 147921 - RNA, 18 nt, Artificial Sequence
  Description of Artificial Sequence: Synthetic oligonucleotide
cagaggaagagagaaaga

SEQ ID NO: 147922 - RNA, 18 nt, Artificial Sequence
  Description of Artificial Sequence: Synthetic oligonucleotide
gcaaacagaggaagagag

SEQ ID NO: 147923 - RNA, 18 nt, Artificial Sequence
  Description of Artificial Sequence: Synthetic oligonucleotide
gggaggcaaacagaggaa

SEQ ID NO: 147924 - RNA, 18 nt, Artificial Sequence
  Description of Artificial Sequence: Synthetic oligonucleotide
ggagagggaggcaaacag

SEQ ID NO: 147925 - RNA, 18 nt, Artificial Sequence
  Description of Artificial Sequence: Synthetic oligonucleotide
agacaggagagggaggca

SEQ ID NO: 147926 - RNA, 18 nt, Artificial Sequence
  Description of Artificial Sequence: Synthetic oligonucleotide
gggagacaggagagggag

SEQ ID NO: 147927 - RNA, 18 nt, Artificial Sequence
  Description of Artificial Sequence: Synthetic oligonucleotide
gaaagauaaagauguggg

SEQ ID NO: 147928 - RNA, 18 nt, Artificial Sequence
  Description of Artificial Sequence: Synthetic oligonucleotide
uuugagaaagauaaagau

SEQ ID NO: 147929 - RNA, 18 nt, Artificial Sequence
  Description of Artificial Sequence: Synthetic oligonucleotide
uuaaguuugagaaagaua

SEQ ID NO: 147930 - RNA, 18 nt, Artificial Sequence
  Description of Artificial Sequence: Synthetic oligonucleotide
gacucuuaaguuugagaa

SEQ ID NO: 147931 - RNA, 18 nt, Artificial Sequence
  Description of Artificial Sequence: Synthetic oligonucleotide
cccacgacucuuaaguuu

SEQ ID NO: 147932 - RNA, 18 nt, Artificial Sequence
  Description of Artificial Sequence: Synthetic oligonucleotide
uggaccccacgacucuua

SEQ ID NO: 147933 - RNA, 18 nt, Artificial Sequence
  Description of Artificial Sequence: Synthetic oligonucleotide
ucuccuggaccccacgac

SEQ ID NO: 147934 - RNA, 18 nt, Artificial Sequence
  Description of Artificial Sequence: Synthetic oligonucleotide
uggagucuccuggacccc

SEQ ID NO: 147935 - RNA, 18 nt, Artificial Sequence
  Description of Artificial Sequence: Synthetic oligonucleotide
acucuuggagucuccugg

SEQ ID NO: 147936 - RNA, 18 nt, Artificial Sequence
  Description of Artificial Sequence: Synthetic oligonucleotide
ugaauacucuuggagucu

SEQ ID NO: 147937 - RNA, 18 nt, Artificial Sequence
  Description of Artificial Sequence: Synthetic oligonucleotide
cuccuagcacagacaggg

SEQ ID NO: 147938 - RNA, 18 nt, Artificial Sequence
  Description of Artificial Sequence: Synthetic oligonucleotide
gagcuccuagcacagaca

SEQ ID NO: 147939 - RNA, 18 nt, Artificial Sequence
  Description of Artificial Sequence: Synthetic oligonucleotide
uauccgagcuccuagcac

SEQ ID NO: 147940 - RNA, 18 nt, Artificial Sequence
  Description of Artificial Sequence: Synthetic oligonucleotide
cuguuuauccgagcuccu

SEQ ID NO: 147941 - RNA, 18 nt, Artificial Sequence
  Description of Artificial Sequence: Synthetic oligonucleotide
gcugacuguuuauccgag

SEQ ID NO: 147942 - RNA, 18 nt, Artificial Sequence
  Description of Artificial Sequence: Synthetic oligonucleotide
gcucggcugacuguuuau

SEQ ID NO: 147943 - RNA, 18 nt, Artificial Sequence
  Description of Artificial Sequence: Synthetic oligonucleotide
ucgaggcucggcugacug

SEQ ID NO: 147944 - RNA, 18 nt, Artificial Sequence
  Description of Artificial Sequence: Synthetic oligonucleotide
gggcgucgaggcucggcu

SEQ ID NO: 147945 - RNA, 18 nt, Artificial Sequence
  Description of Artificial Sequence: Synthetic oligonucleotide
ggaggcggacgauuuggg

SEQ ID NO: 147946 - RNA, 18 nt, Artificial Sequence
  Description of Artificial Sequence: Synthetic oligonucleotide
uuggaggcggacgauuug

SEQ ID NO: 147947 - RNA, 18 nt, Artificial Sequence
  Description of Artificial Sequence: Synthetic oligonucleotide
gcuguccgcgcgugcggg

SEQ ID NO: 147948 - RNA, 18 nt, Artificial Sequence
  Description of Artificial Sequence: Synthetic oligonucleotide
cgggagcuguccgcgcgu

SEQ ID NO: 147949 - RNA, 18 nt, Artificial Sequence
  Description of Artificial Sequence: Synthetic oligonucleotide
caacccgggagcuguccg

SEQ ID NO: 147950 - RNA, 18 nt, Artificial Sequence
  Description of Artificial Sequence: Synthetic oligonucleotide
gcaggcaacccgggagcu

SEQ ID NO: 147951 - RNA, 18 nt, Artificial Sequence
  Description of Artificial Sequence: Synthetic oligonucleotide
gcgccgcaggcaacccgg

SEQ ID NO: 147952 - RNA, 18 nt, Artificial Sequence
  Description of Artificial Sequence: Synthetic oligonucleotide
cgccugcgccgcaggcaa

SEQ ID NO: 147953 - RNA, 18 nt, Artificial Sequence
  Description of Artificial Sequence: Synthetic oligonucleotide
caucccgccugcgccgca

SEQ ID NO: 147954 - RNA, 18 nt, Artificial Sequence
  Description of Artificial Sequence: Synthetic oligonucleotide
agcagcaucccgccugcg

SEQ ID NO: 147955 - RNA, 18 nt, Artificial Sequence
  Description of Artificial Sequence: Synthetic oligonucleotide
ugcgaagcagcaucccgc

SEQ ID NO: 147956 - RNA, 18 nt, Artificial Sequence
  Description of Artificial Sequence: Synthetic oligonucleotide
acuagugcgaagcagcau

SEQ ID NO: 147957 - RNA, 18 nt, Artificial Sequence
  Description of Artificial Sequence: Synthetic oligonucleotide
acuggacuagugcgaagc

SEQ ID NO: 147958 - RNA, 18 nt, Artificial Sequence
  Description of Artificial Sequence: Synthetic oligonucleotide
agaggacuggacuagugc

SEQ ID NO: 147959 - RNA, 18 nt, Artificial Sequence
  Description of Artificial Sequence: Synthetic oligonucleotide
cuggcagaggacuggacu

SEQ ID NO: 147960 - RNA, 18 nt, Artificial Sequence
  Description of Artificial Sequence: Synthetic oligonucleotide
agggccuggcagaggacu

SEQ ID NO: 147961 - RNA, 18 nt, Artificial Sequence
  Description of Artificial Sequence: Synthetic oligonucleotide
gaggaagggccuggcaga

SEQ ID NO: 147962 - RNA, 18 nt, Artificial Sequence
  Description of Artificial Sequence: Synthetic oligonucleotide
gaggagaggaagggccug

SEQ ID NO: 147963 - RNA, 18 nt, Artificial Sequence
  Description of Artificial Sequence: Synthetic oligonucleotide
aaagcgaggagaggaagg

SEQ ID NO: 147964 - RNA, 18 nt, Artificial Sequence
  Description of Artificial Sequence: Synthetic oligonucleotide
guaagaaagcgaggagag

SEQ ID NO: 147965 - RNA, 18 nt, Artificial Sequence
  Description of Artificial Sequence: Synthetic oligonucleotide
agggcguaagaaagcgag

SEQ ID NO: 147966 - RNA, 18 nt, Artificial Sequence
  Description of Artificial Sequence: Synthetic oligonucleotide
cggaaagggcguaagaaa

SEQ ID NO: 147967 - RNA, 18 nt, Artificial Sequence
  Description of Artificial Sequence: Synthetic oligonucleotide
gccagcggaaagggcgua

SEQ ID NO: 147968 - RNA, 18 nt, Artificial Sequence
  Description of Artificial Sequence: Synthetic oligonucleotide
uucaugccagcggaaagg

SEQ ID NO: 147969 - RNA, 18 nt, Artificial Sequence
  Description of Artificial Sequence: Synthetic oligonucleotide
gggaauucaugccagcgg

SEQ ID NO: 147970 - RNA, 18 nt, Artificial Sequence
  Description of Artificial Sequence: Synthetic oligonucleotide
ggagaaaaugccaaaggg

SEQ ID NO: 147971 - RNA, 18 nt, Artificial Sequence
  Description of Artificial Sequence: Synthetic oligonucleotide
gggagaaaaugccaaagg

SEQ ID NO: 147972 - RNA, 18 nt, Artificial Sequence
  Description of Artificial Sequence: Synthetic oligonucleotide
agaugacagaaaagaggg

SEQ ID NO: 147973 - RNA, 18 nt, Artificial Sequence
  Description of Artificial Sequence: Synthetic oligonucleotide
ccagaugacagaaaagag

SEQ ID NO: 147974 - RNA, 18 nt, Artificial Sequence
  Description of Artificial Sequence: Synthetic oligonucleotide
agaaaccagaugacagaa

SEQ ID NO: 147975 - RNA, 18 nt, Artificial Sequence
  Description of Artificial Sequence: Synthetic oligonucleotide
uggagagaaaccagauga

SEQ ID NO: 147976 - RNA, 18 nt, Artificial Sequence
  Description of Artificial Sequence: Synthetic oligonucleotide
gggacuggagagaaacca

SEQ ID NO: 147977 - RNA, 18 nt, Artificial Sequence
  Description of Artificial Sequence: Synthetic oligonucleotide
aagguagaaagcaaaggg

SEQ ID NO: 147978 - RNA, 18 nt, Artificial Sequence
  Description of Artificial Sequence: Synthetic oligonucleotide
caagguagaaagcaaagg

SEQ ID NO: 147979 - RNA, 18 nt, Artificial Sequence
  Description of Artificial Sequence: Synthetic oligonucleotide
cgacgcaagguagaaagc

SEQ ID NO: 147980 - RNA, 18 nt, Artificial Sequence
  Description of Artificial Sequence: Synthetic oligonucleotide
ccuugcgacgcaagguag

SEQ ID NO: 147981 - RNA, 18 nt, Artificial Sequence
  Description of Artificial Sequence: Synthetic oligonucleotide
ucaggccuugcgacgcaa

SEQ ID NO: 147982 - RNA, 18 nt, Artificial Sequence
  Description of Artificial Sequence: Synthetic oligonucleotide
gcgacucaggccuugcga

SEQ ID NO: 147983 - RNA, 18 nt, Artificial Sequence
  Description of Artificial Sequence: Synthetic oligonucleotide
agagggcgacucaggccu

SEQ ID NO: 147984 - RNA, 18 nt, Artificial Sequence
  Description of Artificial Sequence: Synthetic oligonucleotide
gggcgagagggcgacuca

SEQ ID NO: 147985 - RNA, 18 nt, Artificial Sequence
  Description of Artificial Sequence: Synthetic oligonucleotide
gggcugggcgagagggcg

SEQ ID NO: 147986 - RNA, 18 nt, Artificial Sequence
  Description of Artificial Sequence: Synthetic oligonucleotide
gcugggcugaagacuggg

SEQ ID NO: 147987 - RNA, 18 nt, Artificial Sequence
  Description of Artificial Sequence: Synthetic oligonucleotide
gacgcugggcugaagacu

SEQ ID NO: 147988 - RNA, 18 nt, Artificial Sequence
  Description of Artificial Sequence: Synthetic oligonucleotide
gcacagacgcugggcuga

SEQ ID NO: 147989 - RNA, 18 nt, Artificial Sequence
  Description of Artificial Sequence: Synthetic oligonucleotide
uggaagcacagacgcugg

SEQ ID NO: 147990 - RNA, 18 nt, Artificial Sequence
  Description of Artificial Sequence: Synthetic oligonucleotide
gggacuggaagcacagac

SEQ ID NO: 147991 - RNA, 18 nt, Artificial Sequence
  Description of Artificial Sequence: Synthetic oligonucleotide
accacgcggaggaguggg

SEQ ID NO: 147992 - RNA, 18 nt, Artificial Sequence
  Description of Artificial Sequence: Synthetic oligonucleotide
cacgaccacgcggaggag

SEQ ID NO: 147993 - RNA, 18 nt, Artificial Sequence
  Description of Artificial Sequence: Synthetic oligonucleotide
accuccacgaccacgcgg

SEQ ID NO: 147994 - RNA, 18 nt, Artificial Sequence
  Description of Artificial Sequence: Synthetic oligonucleotide
gguggaccuccacgacca

SEQ ID NO: 147995 - RNA, 18 nt, Artificial Sequence
  Description of Artificial Sequence: Synthetic oligonucleotide
aaggugguggaccuccac

SEQ ID NO: 147996 - RNA, 18 nt, Artificial Sequence
  Description of Artificial Sequence: Synthetic oligonucleotide
gaagaaaggugguggacc

SEQ ID NO: 147997 - RNA, 18 nt, Artificial Sequence
  Description of Artificial Sequence: Synthetic oligonucleotide
cuugagaagaaagguggu

SEQ ID NO: 147998 - RNA, 18 nt, Artificial Sequence
  Description of Artificial Sequence: Synthetic oligonucleotide
ccgagcuugagaagaaag

SEQ ID NO: 147999 - RNA, 18 nt, Artificial Sequence
  Description of Artificial Sequence: Synthetic oligonucleotide
uguucccgagcuugagaa

SEQ ID NO: 148000 - RNA, 18 nt, Artificial Sequence
  Description of Artificial Sequence: Synthetic oligonucleotide
gggcauguucccgagcuu

SEQ ID NO: 148001 - RNA, 18 nt, Artificial Sequence
  Description of Artificial Sequence: Synthetic oligonucleotide
cggaagggcauguucccg

SEQ ID NO: 148002 - RNA, 18 nt, Artificial Sequence
  Description of Artificial Sequence: Synthetic oligonucleotide
cagggcggaagggcaugu

SEQ ID NO: 148003 - RNA, 18 nt, Artificial Sequence
  Description of Artificial Sequence: Synthetic oligonucleotide
gcaggcagggcggaaggg

SEQ ID NO: 148004 - RNA, 18 nt, Artificial Sequence
  Description of Artificial Sequence: Synthetic oligonucleotide
aggaagcaggcagggcgg

SEQ ID NO: 148005 - RNA, 18 nt, Artificial Sequence
  Description of Artificial Sequence: Synthetic oligonucleotide
ggcgaaggaagcaggcag

SEQ ID NO: 148006 - RNA, 18 nt, Artificial Sequence
  Description of Artificial Sequence: Synthetic oligonucleotide
ggacgggcgaaggaagca

SEQ ID NO: 148007 - RNA, 18 nt, Artificial Sequence
  Description of Artificial Sequence: Synthetic oligonucleotide
gcccgggacgggcgaagg

SEQ ID NO: 148008 - RNA, 18 nt, Artificial Sequence
  Description of Artificial Sequence: Synthetic oligonucleotide
ccgcggcccgggacgggc

SEQ ID NO: 148009 - RNA, 18 nt, Artificial Sequence
  Description of Artificial Sequence: Synthetic oligonucleotide
aggguccgcggcccggga

SEQ ID NO: 148010 - RNA, 18 nt, Artificial Sequence
  Description of Artificial Sequence: Synthetic oligonucleotide
uagucaggguccgcggcc

SEQ ID NO: 148011 - RNA, 18 nt, Artificial Sequence
  Description of Artificial Sequence: Synthetic oligonucleotide
gccauuagucaggguccg

SEQ ID NO: 148012 - RNA, 18 nt, Artificial Sequence
  Description of Artificial Sequence: Synthetic oligonucleotide
gaccggccauuagucagg

SEQ ID NO: 148013 - RNA, 18 nt, Artificial Sequence
  Description of Artificial Sequence: Synthetic oligonucleotide
gcagggaccggccauuag

SEQ ID NO: 148014 - RNA, 18 nt, Artificial Sequence
  Description of Artificial Sequence: Synthetic oligonucleotide
acacagcagggaccggcc

SEQ ID NO: 148015 - RNA, 18 nt, Artificial Sequence
  Description of Artificial Sequence: Synthetic oligonucleotide
cccacacacagcagggac

SEQ ID NO: 148016 - RNA, 18 nt, Artificial Sequence
  Description of Artificial Sequence: Synthetic oligonucleotide
aacaccccacacacagca

SEQ ID NO: 148017 - RNA, 18 nt, Artificial Sequence
  Description of Artificial Sequence: Synthetic oligonucleotide
aacacaacaccccacaca

SEQ ID NO: 148018 - RNA, 18 nt, Artificial Sequence
  Description of Artificial Sequence: Synthetic oligonucleotide
aaaaaaacacaacacccc

SEQ ID NO: 148019 - RNA, 18 nt, Artificial Sequence
  Description of Artificial Sequence: Synthetic oligonucleotide
uucacacccccgugcccu

SEQ ID NO: 148020 - RNA, 18 nt, Artificial Sequence
  Description of Artificial Sequence: Synthetic oligonucleotide
gcugguucacacccccgu

SEQ ID NO: 148021 - RNA, 18 nt, Artificial Sequence
  Description of Artificial Sequence: Synthetic oligonucleotide
cccgagcugguucacacc

SEQ ID NO: 148022 - RNA, 18 nt, Artificial Sequence
  Description of Artificial Sequence: Synthetic oligonucleotide
acccccccgagcugguuc

SEQ ID NO: 148023 - RNA, 18 nt, Artificial Sequence
  Description of Artificial Sequence: Synthetic oligonucleotide
caaacacccccccgagcu

SEQ ID NO: 148024 - RNA, 18 nt, Artificial Sequence
  Description of Artificial Sequence: Synthetic oligonucleotide
guucacaaacaccccccc

SEQ ID NO: 148025 - RNA, 18 nt, Artificial Sequence
  Description of Artificial Sequence: Synthetic oligonucleotide
cggccguucacaaacacc

SEQ ID NO: 148026 - RNA, 18 nt, Artificial Sequence
  Description of Artificial Sequence: Synthetic oligonucleotide
gggccggccguucacaaa

SEQ ID NO: 148027 - RNA, 18 nt, Artificial Sequence
  Description of Artificial Sequence: Synthetic oligonucleotide
ucaccacgucggguaggg

SEQ ID NO: 148028 - RNA, 18 nt, Artificial Sequence
  Description of Artificial Sequence: Synthetic oligonucleotide
cugccucaccacgucggg

SEQ ID NO: 148029 - RNA, 18 nt, Artificial Sequence
  Description of Artificial Sequence: Synthetic oligonucleotide
augcgcugccucaccacg

SEQ ID NO: 148030 - RNA, 18 nt, Artificial Sequence
  Description of Artificial Sequence: Synthetic oligonucleotide
ccacgaugcgcugccuca

SEQ ID NO: 148031 - RNA, 18 nt, Artificial Sequence
  Description of Artificial Sequence: Synthetic oligonucleotide
cagcuccacgaugcgcug

SEQ ID NO: 148032 - RNA, 18 nt, Artificial Sequence
  Description of Artificial Sequence: Synthetic oligonucleotide
ugggccagcuccacgaug

SEQ ID NO: 148033 - RNA, 18 nt, Artificial Sequence
  Description of Artificial Sequence: Synthetic oligonucleotide
ccuggugggccagcucca

SEQ ID NO: 148034 - RNA, 18 nt, Artificial Sequence
  Description of Artificial Sequence: Synthetic oligonucleotide
cacacccuggugggccag

SEQ ID NO: 148035 - RNA, 18 nt, Artificial Sequence
  Description of Artificial Sequence: Synthetic oligonucleotide
ggccgcacacccuggugg

SEQ ID NO: 148036 - RNA, 18 nt, Artificial Sequence
  Description of Artificial Sequence: Synthetic oligonucleotide
cacagggccgcacacccu

SEQ ID NO: 148037 - RNA, 18 nt, Artificial Sequence
  Description of Artificial Sequence: Synthetic oligonucleotide
gaugucacagggccgcac

SEQ ID NO: 148038 - RNA, 18 nt, Artificial Sequence
  Description of Artificial Sequence: Synthetic oligonucleotide
cgggagaugucacagggc

SEQ ID NO: 148039 - RNA, 18 nt, Artificial Sequence
  Description of Artificial Sequence: Synthetic oligonucleotide
gcugccgggagaugucac

SEQ ID NO: 148040 - RNA, 18 nt, Artificial Sequence
  Description of Artificial Sequence: Synthetic oligonucleotide
ccgcagcugccgggagau

SEQ ID NO: 148041 - RNA, 18 nt, Artificial Sequence
  Description of Artificial Sequence: Synthetic oligonucleotide
cugacccgcagcugccgg

SEQ ID NO: 148042 - RNA, 18 nt, Artificial Sequence
  Description of Artificial Sequence: Synthetic oligonucleotide
cguggcugacccgcagcu

SEQ ID NO: 148043 - RNA, 18 nt, Artificial Sequence
  Description of Artificial Sequence: Synthetic oligonucleotide
acagccguggcugacccg

SEQ ID NO: 148044 - RNA, 18 nt, Artificial Sequence
  Description of Artificial Sequence: Synthetic oligonucleotide
cugacacagccguggcug

SEQ ID NO: 148045 - RNA, 18 nt, Artificial Sequence
  Description of Artificial Sequence: Synthetic oligonucleotide
uuuugcugacacagccgu

SEQ ID NO: 148046 - RNA, 18 nt, Artificial Sequence
  Description of Artificial Sequence: Synthetic oligonucleotide
caggauuuugcugacaca

SEQ ID NO: 148047 - RNA, 18 nt, Artificial Sequence
  Description of Artificial Sequence: Synthetic oligonucleotide
cugcccaggauuuugcug

SEQ ID NO: 148048 - RNA, 18 nt, Artificial Sequence
  Description of Artificial Sequence: Synthetic oligonucleotide
cgcgcgggccaggccccc

SEQ ID NO: 148049 - RNA, 18 nt, Artificial Sequence
  Description of Artificial Sequence: Synthetic oligonucleotide
gggagcgcgcgggccagg

SEQ ID NO: 148050 - RNA, 18 nt, Artificial Sequence
  Description of Artificial Sequence: Synthetic oligonucleotide
guggcgccugcgggaggg

SEQ ID NO: 148051 - RNA, 18 nt, Artificial Sequence
  Description of Artificial Sequence: Synthetic oligonucleotide
agguggcgccugcgggag

SEQ ID NO: 148052 - RNA, 18 nt, Artificial Sequence
  Description of Artificial Sequence: Synthetic oligonucleotide
guccgagguggcgccugc

SEQ ID NO: 148053 - RNA, 18 nt, Artificial Sequence
  Description of Artificial Sequence: Synthetic oligonucleotide
gggauguccgagguggcg

SEQ ID NO: 148054 - RNA, 18 nt, Artificial Sequence
  Description of Artificial Sequence: Synthetic oligonucleotide
agaaguagcaaucccggg

SEQ ID NO: 148055 - RNA, 18 nt, Artificial Sequence
  Description of Artificial Sequence: Synthetic oligonucleotide
gagaaguagcaaucccgg

SEQ ID NO: 148056 - RNA, 18 nt, Artificial Sequence
  Description of Artificial Sequence: Synthetic oligonucleotide
uggcagagaaguagcaau

SEQ ID NO: 148057 - RNA, 18 nt, Artificial Sequence
  Description of Artificial Sequence: Synthetic oligonucleotide
gaaguuggcagagaagua

SEQ ID NO: 148058 - RNA, 18 nt, Artificial Sequence
  Description of Artificial Sequence: Synthetic oligonucleotide
uuggcgaaguuggcagag

SEQ ID NO: 148059 - RNA, 18 nt, Artificial Sequence
  Description of Artificial Sequence: Synthetic oligonucleotide
gcgaguuggcgaaguugg

SEQ ID NO: 148060 - RNA, 18 nt, Artificial Sequence
  Description of Artificial Sequence: Synthetic oligonucleotide
ugcuggcgaguuggcgaa

SEQ ID NO: 148061 - RNA, 18 nt, Artificial Sequence
  Description of Artificial Sequence: Synthetic oligonucleotide
ccaagugcuggcgaguug

SEQ ID NO: 148062 - RNA, 18 nt, Artificial Sequence
  Description of Artificial Sequence: Synthetic oligonucleotide
ccucuccaagugcuggcg

SEQ ID NO: 148063 - RNA, 18 nt, Artificial Sequence
  Description of Artificial Sequence: Synthetic oligonucleotide
ccgggccucuccaagugc

SEQ ID NO: 148064 - RNA, 18 nt, Artificial Sequence
  Description of Artificial Sequence: Synthetic oligonucleotide
gggagccgggccucucca

SEQ ID NO: 148065 - RNA, 18 nt, Artificial Sequence
  Description of Artificial Sequence: Synthetic oligonucleotide
cagagggcgccgggaggg

SEQ ID NO: 148066 - RNA, 18 nt, Artificial Sequence
  Description of Artificial Sequence: Synthetic oligonucleotide
cggucagagggcgccggg

SEQ ID NO: 148067 - RNA, 18 nt, Artificial Sequence
  Description of Artificial Sequence: Synthetic oligonucleotide
ggucggagagcgcgcggg

SEQ ID NO: 148068 - RNA, 18 nt, Artificial Sequence
  Description of Artificial Sequence: Synthetic oligonucleotide
gcgguggucggagagcgc

SEQ ID NO: 148069 - RNA, 18 nt, Artificial Sequence
  Description of Artificial Sequence: Synthetic oligonucleotide
gagaggcgguggucggag

SEQ ID NO: 148070 - RNA, 18 nt, Artificial Sequence
  Description of Artificial Sequence: Synthetic oligonucleotide
cauccgagaggcgguggu

SEQ ID NO: 148071 - RNA, 18 nt, Artificial Sequence
  Description of Artificial Sequence: Synthetic oligonucleotide
cuggucauccgagaggcg

SEQ ID NO: 148072 - RNA, 18 nt, Artificial Sequence
  Description of Artificial Sequence: Synthetic oligonucleotide
ggaaccuggucauccgag

SEQ ID NO: 148073 - RNA, 18 nt, Artificial Sequence
  Description of Artificial Sequence: Synthetic oligonucleotide
ccccuggaaccuggucau

SEQ ID NO: 148074 - RNA, 18 nt, Artificial Sequence
  Description of Artificial Sequence: Synthetic oligonucleotide
cagcuccccuggaaccug

SEQ ID NO: 148075 - RNA, 18 nt, Artificial Sequence
  Description of Artificial Sequence: Synthetic oligonucleotide
ucgcucagcuccccugga

SEQ ID NO: 148076 - RNA, 18 nt, Artificial Sequence
  Description of Artificial Sequence: Synthetic oligonucleotide
gcgacucgcucagcuccc

SEQ ID NO: 148077 - RNA, 18 nt, Artificial Sequence
  Description of Artificial Sequence: Synthetic oligonucleotide
gggaggcgacucgcucag

SEQ ID NO: 148078 - RNA, 18 nt, Artificial Sequence
  Description of Artificial Sequence: Synthetic oligonucleotide
gggcugaagcugggcggg

SEQ ID NO: 148079 - RNA, 18 nt, Artificial Sequence
  Description of Artificial Sequence: Synthetic oligonucleotide
agggcugaagcugggcgg

SEQ ID NO: 148080 - RNA, 18 nt, Artificial Sequence
  Description of Artificial Sequence: Synthetic oligonucleotide
cagccagggcugaagcug

SEQ ID NO: 148081 - RNA, 18 nt, Artificial Sequence
  Description of Artificial Sequence: Synthetic oligonucleotide
agcugcagccagggcuga

SEQ ID NO: 148082 - RNA, 18 nt, Artificial Sequence
  Description of Artificial Sequence: Synthetic oligonucleotide
gcugcagcugcagccagg

SEQ ID NO: 148083 - RNA, 18 nt, Artificial Sequence
  Description of Artificial Sequence: Synthetic oligonucleotide
cucgcgcugcagcugcag

SEQ ID NO: 148084 - RNA, 18 nt, Artificial Sequence
  Description of Artificial Sequence: Synthetic oligonucleotide
cauggcucgcgcugcagc

SEQ ID NO: 148085 - RNA, 18 nt, Artificial Sequence
  Description of Artificial Sequence: Synthetic oligonucleotide
gggcgcauggcucgcgcu

SEQ ID NO: 148086 - RNA, 18 nt, Artificial Sequence
  Description of Artificial Sequence: Synthetic oligonucleotide
gcggugggccgggccggg

SEQ ID NO: 148087 - RNA, 18 nt, Artificial Sequence
  Description of Artificial Sequence: Synthetic oligonucleotide
gggcggugggccgggccg

SEQ ID NO: 148088 - RNA, 18 nt, Artificial Sequence
  Description of Artificial Sequence: Synthetic oligonucleotide
cagcagaauggccccggg

SEQ ID NO: 148089 - RNA, 18 nt, Artificial Sequence
  Description of Artificial Sequence: Synthetic oligonucleotide
gucagcagaauggccccg

SEQ ID NO: 148090 - RNA, 18 nt, Artificial Sequence
  Description of Artificial Sequence: Synthetic oligonucleotide
gggcggucagcagaaugg

SEQ ID NO: 148091 - RNA, 18 nt, Artificial Sequence
  Description of Artificial Sequence: Synthetic oligonucleotide
gggcugggcggucagcag

SEQ ID NO: 148092 - RNA, 18 nt, Artificial Sequence
  Description of Artificial Sequence: Synthetic oligonucleotide
caacuugccacugucggg

SEQ ID NO: 148093 - RNA, 18 nt, Artificial Sequence
  Description of Artificial Sequence: Synthetic oligonucleotide
cgcaacuugccacugucg

SEQ ID NO: 148094 - RNA, 18 nt, Artificial Sequence
  Description of Artificial Sequence: Synthetic oligonucleotide
guagccgcaacuugccac

SEQ ID NO: 148095 - RNA, 18 nt, Artificial Sequence
  Description of Artificial Sequence: Synthetic oligonucleotide
cugcaguagccgcaacuu

SEQ ID NO: 148096 - RNA, 18 nt, Artificial Sequence
  Description of Artificial Sequence: Synthetic oligonucleotide
ugcaacugcaguagccgc

SEQ ID NO: 148097 - RNA, 18 nt, Artificial Sequence
  Description of Artificial Sequence: Synthetic oligonucleotide
gagcuugcaacugcagua

SEQ ID NO: 148098 - RNA, 18 nt, Artificial Sequence
  Description of Artificial Sequence: Synthetic oligonucleotide
ggccggagcuugcaacug

SEQ ID NO: 148099 - RNA, 18 nt, Artificial Sequence
  Description of Artificial Sequence: Synthetic oligonucleotide
ggguuggccggagcuugc

SEQ ID NO: 148100 - RNA, 18 nt, Artificial Sequence
  Description of Artificial Sequence: Synthetic oligonucleotide
ccuccggguuggccggag

SEQ ID NO: 148101 - RNA, 18 nt, Artificial Sequence
  Description of Artificial Sequence: Synthetic oligonucleotide
gggcuccuccggguuggc

SEQ ID NO: 148102 - RNA, 18 nt, Artificial Sequence
  Description of Artificial Sequence: Synthetic oligonucleotide
acugcgcuccccgcuggg

SEQ ID NO: 148103 - RNA, 18 nt, Artificial Sequence
  Description of Artificial Sequence: Synthetic oligonucleotide
cagcacugcgcuccccgc

SEQ ID NO: 148104 - RNA, 18 nt, Artificial Sequence
  Description of Artificial Sequence: Synthetic oligonucleotide
gggcgcagcacugcgcuc

SEQ ID NO: 148105 - RNA, 18 nt, Artificial Sequence
  Description of Artificial Sequence: Synthetic oligonucleotide
acgcccggcugcugcggg

SEQ ID NO: 148106 - RNA, 18 nt, Artificial Sequence
  Description of Artificial Sequence: Synthetic oligonucleotide
ugaacgcccggcugcugc

SEQ ID NO: 148107 - RNA, 18 nt, Artificial Sequence
  Description of Artificial Sequence: Synthetic oligonucleotide
augagugaacgcccggcu

SEQ ID NO: 148108 - RNA, 18 nt, Artificial Sequence
  Description of Artificial Sequence: Synthetic oligonucleotide
ggaggaugagugaacgcc

SEQ ID NO: 148109 - RNA, 18 nt, Artificial Sequence
  Description of Artificial Sequence: Synthetic oligonucleotide
gggagggaggaugaguga

SEQ ID NO: 148110 - RNA, 18 nt, Artificial Sequence
  Description of Artificial Sequence: Synthetic oligonucleotide
aaagggagggacgguggg

SEQ ID NO: 148111 - RNA, 18 nt, Artificial Sequence
  Description of Artificial Sequence: Synthetic oligonucleotide
gaaaagggagggacggug

SEQ ID NO: 148112 - RNA, 18 nt, Artificial Sequence
  Description of Artificial Sequence: Synthetic oligonucleotide
gaggagaaaagggaggga

SEQ ID NO: 148113 - RNA, 18 nt, Artificial Sequence
  Description of Artificial Sequence: Synthetic oligonucleotide
gacuugaggagaaaaggg

SEQ ID NO: 148114 - RNA, 18 nt, Artificial Sequence
  Description of Artificial Sequence: Synthetic oligonucleotide
uucaggacuugaggagaa

SEQ ID NO: 148115 - RNA, 18 nt, Artificial Sequence
  Description of Artificial Sequence: Synthetic oligonucleotide
ucaacuucaggacuugag

SEQ ID NO: 148116 - RNA, 18 nt, Artificial Sequence
  Description of Artificial Sequence: Synthetic oligonucleotide
caaacucaacuucaggac

SEQ ID NO: 148117 - RNA, 18 nt, Artificial Sequence
  Description of Artificial Sequence: Synthetic oligonucleotide
ccucucaaacucaacuuc

SEQ ID NO: 148118 - RNA, 18 nt, Artificial Sequence
  Description of Artificial Sequence: Synthetic oligonucleotide
ugucgccucucaaacuca

SEQ ID NO: 148119 - RNA, 18 nt, Artificial Sequence
  Description of Artificial Sequence: Synthetic oligonucleotide
cgccgugucgccucucaa

SEQ ID NO: 148120 - RNA, 18 nt, Artificial Sequence
  Description of Artificial Sequence: Synthetic oligonucleotide
gccgccgccgugucgccu

SEQ ID NO: 148121 - RNA, 18 nt, Artificial Sequence
  Description of Artificial Sequence: Synthetic oligonucleotide
cggccgccgccgccgugu

SEQ ID NO: 148122 - RNA, 18 nt, Artificial Sequence
  Description of Artificial Sequence: Synthetic oligonucleotide
cagcgcggccgccgccgc

SEQ ID NO: 148123 - RNA, 18 nt, Artificial Sequence
  Description of Artificial Sequence: Synthetic oligonucleotide
gggagcagcgcggccgcc

SEQ ID NO: 148124 - RNA, 18 nt, Artificial Sequence
  Description of Artificial Sequence: Synthetic oligonucleotide
ggagcgggagcagcgcgg

SEQ ID NO: 148125 - RNA, 18 nt, Artificial Sequence
  Description of Artificial Sequence: Synthetic oligonucleotide
gcagaggagcgggagcag

SEQ ID NO: 148126 - RNA, 18 nt, Artificial Sequence
  Description of Artificial Sequence: Synthetic oligonucleotide
gggaggcagaggagcggg

SEQ ID NO: 148127 - RNA, 18 nt, Artificial Sequence
  Description of Artificial Sequence: Synthetic oligonucleotide
gcagugcauauccauggg

SEQ ID NO: 148128 - RNA, 18 nt, Artificial Sequence
  Description of Artificial Sequence: Synthetic oligonucleotide
ugcagugcauauccaugg

SEQ ID NO: 148129 - RNA, 18 nt, Artificial Sequence
  Description of Artificial Sequence: Synthetic oligonucleotide
ugcuuugcagugcauauc

SEQ ID NO: 148130 - RNA, 18 nt, Artificial Sequence
  Description of Artificial Sequence: Synthetic oligonucleotide
gggucugcuuugcagugc

SEQ ID NO: 148131 - RNA, 18 nt, Artificial Sequence
  Description of Artificial Sequence: Synthetic oligonucleotide
gugcaucgcggagaaggg

SEQ ID NO: 148132 - RNA, 18 nt, Artificial Sequence
  Description of Artificial Sequence: Synthetic oligonucleotide
aggagccgggcgccggua

SEQ ID NO: 148133 - RNA, 18 nt, Artificial Sequence
  Description of Artificial Sequence: Synthetic oligonucleotide
gggacaggagccgggcgc

SEQ ID NO: 148134 - RNA, 18 nt, Artificial Sequence
  Description of Artificial Sequence: Synthetic oligonucleotide
gagccgggacaggagccg

SEQ ID NO: 148135 - RNA, 18 nt, Artificial Sequence
  Description of Artificial Sequence: Synthetic oligonucleotide
gccccgagccgggacagg

SEQ ID NO: 148136 - RNA, 18 nt, Artificial Sequence
  Description of Artificial Sequence: Synthetic oligonucleotide
ggagagccccgagccggg

SEQ ID NO: 148137 - RNA, 18 nt, Artificial Sequence
  Description of Artificial Sequence: Synthetic oligonucleotide
gggacggagagccccgag

SEQ ID NO: 148138 - RNA, 18 nt, Artificial Sequence
  Description of Artificial Sequence: Synthetic oligonucleotide
ggguugggacggagagcc

SEQ ID NO: 148139 - RNA, 18 nt, Artificial Sequence
  Description of Artificial Sequence: Synthetic oligonucleotide
ggacaggguugggacgga

SEQ ID NO: 148140 - RNA, 18 nt, Artificial Sequence
  Description of Artificial Sequence: Synthetic oligonucleotide
ggacuggacaggguuggg

SEQ ID NO: 148141 - RNA, 18 nt, Artificial Sequence
  Description of Artificial Sequence: Synthetic oligonucleotide
cgcugggacuggacaggg

SEQ ID NO: 148142 - RNA, 18 nt, Artificial Sequence
  Description of Artificial Sequence: Synthetic oligonucleotide
ggccacgcugggacugga

SEQ ID NO: 148143 - RNA, 18 nt, Artificial Sequence
  Description of Artificial Sequence: Synthetic oligonucleotide
gggccacgcugggacugg

SEQ ID NO: 148144 - RNA, 18 nt, Artificial Sequence
  Description of Artificial Sequence: Synthetic oligonucleotide
gggaccugagcgcgaggg

SEQ ID NO: 148145 - RNA, 18 nt, Artificial Sequence
  Description of Artificial Sequence: Synthetic oligonucleotide
aagaugggaccugagcgc

SEQ ID NO: 148146 - RNA, 18 nt, Artificial Sequence
  Description of Artificial Sequence: Synthetic oligonucleotide
ccuccaagaugggaccug

SEQ ID NO: 148147 - RNA, 18 nt, Artificial Sequence
  Description of Artificial Sequence: Synthetic oligonucleotide
ggaggccuccaagauggg

SEQ ID NO: 148148 - RNA, 18 nt, Artificial Sequence
  Description of Artificial Sequence: Synthetic oligonucleotide
gccagggaggccuccaag

SEQ ID NO: 148149 - RNA, 18 nt, Artificial Sequence
  Description of Artificial Sequence: Synthetic oligonucleotide
cagaagccagggaggccu

SEQ ID NO: 148150 - RNA, 18 nt, Artificial Sequence
  Description of Artificial Sequence: Synthetic oligonucleotide
gggaccagaagccaggga

SEQ ID NO: 148151 - RNA, 18 nt, Artificial Sequence
  Description of Artificial Sequence: Synthetic oligonucleotide
aaagagggaccagaagcc

SEQ ID NO: 148152 - RNA, 18 nt, Artificial Sequence
  Description of Artificial Sequence: Synthetic oligonucleotide
aacgaaaagagggaccag

SEQ ID NO: 148153 - RNA, 18 nt, Artificial Sequence
  Description of Artificial Sequence: Synthetic oligonucleotide
gaaagaacgaaaagaggg

SEQ ID NO: 148154 - RNA, 18 nt, Artificial Sequence
  Description of Artificial Sequence: Synthetic oligonucleotide
ggagagaaagaacgaaaa

SEQ ID NO: 148155 - RNA, 18 nt, Artificial Sequence
  Description of Artificial Sequence: Synthetic oligonucleotide
gcgagggagagaaagaac

SEQ ID NO: 148156 - RNA, 18 nt, Artificial Sequence
  Description of Artificial Sequence: Synthetic oligonucleotide
accgggcgagggagagaa

SEQ ID NO: 148157 - RNA, 18 nt, Artificial Sequence
  Description of Artificial Sequence: Synthetic oligonucleotide
gaaacaccgggcgaggga

SEQ ID NO: 148158 - RNA, 18 nt, Artificial Sequence
  Description of Artificial Sequence: Synthetic oligonucleotide
cauuagaaacaccgggcg

SEQ ID NO: 148159 - RNA, 18 nt, Artificial Sequence
  Description of Artificial Sequence: Synthetic oligonucleotide
ggaggcauuagaaacacc

SEQ ID NO: 148160 - RNA, 18 nt, Artificial Sequence
  Description of Artificial Sequence: Synthetic oligonucleotide
aaacuggaggcauuagaa

SEQ ID NO: 148161 - RNA, 18 nt, Artificial Sequence
  Description of Artificial Sequence: Synthetic oligonucleotide
gagagaaacuggaggcau

SEQ ID NO: 148162 - RNA, 18 nt, Artificial Sequence
  Description of Artificial Sequence: Synthetic oligonucleotide
ggcaggagagaaacugga

SEQ ID NO: 148163 - RNA, 18 nt, Artificial Sequence
  Description of Artificial Sequence: Synthetic oligonucleotide
cagaaggcaggagagaaa

SEQ ID NO: 148164 - RNA, 18 nt, Artificial Sequence
  Description of Artificial Sequence: Synthetic oligonucleotide
ggugacagaaggcaggag

SEQ ID NO: 148165 - RNA, 18 nt, Artificial Sequence
  Description of Artificial Sequence: Synthetic oligonucleotide
gaaugggugacagaaggc

SEQ ID NO: 148166 - RNA, 18 nt, Artificial Sequence
  Description of Artificial Sequence: Synthetic oligonucleotide
gguaagaaugggugacag

SEQ ID NO: 148167 - RNA, 18 nt, Artificial Sequence
  Description of Artificial Sequence: Synthetic oligonucleotide
agagagguaagaaugggu

SEQ ID NO: 148168 - RNA, 18 nt, Artificial Sequence
  Description of Artificial Sequence: Synthetic oligonucleotide
cagacagagagguaagaa

SEQ ID NO: 148169 - RNA, 18 nt, Artificial Sequence
  Description of Artificial Sequence: Synthetic oligonucleotide
gcaggcagacagagaggu

SEQ ID NO: 148170 - RNA, 18 nt, Artificial Sequence
  Description of Artificial Sequence: Synthetic oligonucleotide
ggaaggcaggcagacaga

SEQ ID NO: 148171 - RNA, 18 nt, Artificial Sequence
  Description of Artificial Sequence: Synthetic oligonucleotide
agguaggaaggcaggcag

SEQ ID NO: 148172 - RNA, 18 nt, Artificial Sequence
  Description of Artificial Sequence: Synthetic oligonucleotide
agggaagguaggaaggca

SEQ ID NO: 148173 - RNA, 18 nt, Artificial Sequence
  Description of Artificial Sequence: Synthetic oligonucleotide
ggaucagggaagguagga

SEQ ID NO: 148174 - RNA, 18 nt, Artificial Sequence
  Description of Artificial Sequence: Synthetic oligonucleotide
gauagggaucagggaagg

SEQ ID NO: 148175 - RNA, 18 nt, Artificial Sequence
  Description of Artificial Sequence: Synthetic oligonucleotide
caggugauagggaucagg

SEQ ID NO: 148176 - RNA, 18 nt, Artificial Sequence
  Description of Artificial Sequence: Synthetic oligonucleotide
aaaggcaggugauaggga

SEQ ID NO: 148177 - RNA, 18 nt, Artificial Sequence
  Description of Artificial Sequence: Synthetic oligonucleotide
agagcaaaggcaggugau

SEQ ID NO: 148178 - RNA, 18 nt, Artificial Sequence
  Description of Artificial Sequence: Synthetic oligonucleotide
uagaaagagcaaaggcag

SEQ ID NO: 148179 - RNA, 18 nt, Artificial Sequence
  Description of Artificial Sequence: Synthetic oligonucleotide
gcggauagaaagagcaaa

SEQ ID NO: 148180 - RNA, 18 nt, Artificial Sequence
  Description of Artificial Sequence: Synthetic oligonucleotide
aaggagcggauagaaaga

SEQ ID NO: 148181 - RNA, 18 nt, Artificial Sequence
  Description of Artificial Sequence: Synthetic oligonucleotide
cuaagaaggagcggauag

SEQ ID NO: 148182 - RNA, 18 nt, Artificial Sequence
  Description of Artificial Sequence: Synthetic oligonucleotide
augaccuaagaaggagcg

SEQ ID NO: 148183 - RNA, 18 nt, Artificial Sequence
  Description of Artificial Sequence: Synthetic oligonucleotide
aucccaugaccuaagaag

SEQ ID NO: 148184 - RNA, 18 nt, Artificial Sequence
  Description of Artificial Sequence: Synthetic oligonucleotide
cguggaucccaugaccua

SEQ ID NO: 148185 - RNA, 18 nt, Artificial Sequence
  Description of Artificial Sequence: Synthetic oligonucleotide
gaggccguggaucccaug

SEQ ID NO: 148186 - RNA, 18 nt, Artificial Sequence
  Description of Artificial Sequence: Synthetic oligonucleotide
gcuccgaggccguggauc

SEQ ID NO: 148187 - RNA, 18 nt, Artificial Sequence
  Description of Artificial Sequence: Synthetic oligonucleotide
ccagggcuccgaggccgu

SEQ ID NO: 148188 - RNA, 18 nt, Artificial Sequence
  Description of Artificial Sequence: Synthetic oligonucleotide
uggaaccagggcuccgag

SEQ ID NO: 148189 - RNA, 18 nt, Artificial Sequence
  Description of Artificial Sequence: Synthetic oligonucleotide
guggcuggaaccagggcu

SEQ ID NO: 148190 - RNA, 18 nt, Artificial Sequence
  Description of Artificial Sequence: Synthetic oligonucleotide
agaggguggcuggaacca

SEQ ID NO: 148191 - RNA, 18 nt, Artificial Sequence
  Description of Artificial Sequence: Synthetic oligonucleotide
uagggagaggguggcugg

SEQ ID NO: 148192 - RNA, 18 nt, Artificial Sequence
  Description of Artificial Sequence: Synthetic oligonucleotide
cugacuagggagagggug

SEQ ID NO: 148193 - RNA, 18 nt, Artificial Sequence
  Description of Artificial Sequence: Synthetic oligonucleotide
agaggcugacuagggaga

SEQ ID NO: 148194 - RNA, 18 nt, Artificial Sequence
  Description of Artificial Sequence: Synthetic oligonucleotide
gggcaagaggcugacuag

SEQ ID NO: 148195 - RNA, 18 nt, Artificial Sequence
  Description of Artificial Sequence: Synthetic oligonucleotide
gcccagggcaagaggcug

SEQ ID NO: 148196 - RNA, 18 nt, Artificial Sequence
  Description of Artificial Sequence: Synthetic oligonucleotide
ccccagcccagggcaaga

SEQ ID NO: 148197 - RNA, 18 nt, Artificial Sequence
  Description of Artificial Sequence: Synthetic oligonucleotide
uugccccccagcccaggg

SEQ ID NO: 148198 - RNA, 18 nt, Artificial Sequence
  Description of Artificial Sequence: Synthetic oligonucleotide
cuaauuugccccccagcc

SEQ ID NO: 148199 - RNA, 18 nt, Artificial Sequence
  Description of Artificial Sequence: Synthetic oligonucleotide
gccugcuaauuugccccc

SEQ ID NO: 148200 - RNA, 18 nt, Artificial Sequence
  Description of Artificial Sequence: Synthetic oligonucleotide
aaacugccugcuaauuug

SEQ ID NO: 148201 - RNA, 18 nt, Artificial Sequence
  Description of Artificial Sequence: Synthetic oligonucleotide
ccugaaaacugccugcua

SEQ ID NO: 148202 - RNA, 18 nt, Artificial Sequence
  Description of Artificial Sequence: Synthetic oligonucleotide
aacacccugaaaacugcc

SEQ ID NO: 148203 - RNA, 18 nt, Artificial Sequence
  Description of Artificial Sequence: Synthetic oligonucleotide
aaaacaacacccugaaaa

SEQ ID NO: 148204 - RNA, 18 nt, Artificial Sequence
  Description of Artificial Sequence: Synthetic oligonucleotide
acaacaaaacaacacccu

SEQ ID NO: 148205 - RNA, 18 nt, Artificial Sequence
  Description of Artificial Sequence: Synthetic oligonucleotide
agaaaacaacaaaacaac

SEQ ID NO: 148206 - RNA, 18 nt, Artificial Sequence
  Description of Artificial Sequence: Synthetic oligonucleotide
gacagagaaaacaacaaa

SEQ ID NO: 148207 - RNA, 18 nt, Artificial Sequence
  Description of Artificial Sequence: Synthetic oligonucleotide
gaaaagacagagaaaaca

SEQ ID NO: 148208 - RNA, 18 nt, Artificial Sequence
  Description of Artificial Sequence: Synthetic oligonucleotide
agagagaaaagacagaga

SEQ ID NO: 148209 - RNA, 18 nt, Artificial Sequence
  Description of Artificial Sequence: Synthetic oligonucleotide
gagaaagagagaaaagac

SEQ ID NO: 148210 - RNA, 18 nt, Artificial Sequence
  Description of Artificial Sequence: Synthetic oligonucleotide
gaagagagaaagagagaa

SEQ ID NO: 148211 - RNA, 18 nt, Artificial Sequence
  Description of Artificial Sequence: Synthetic oligonucleotide
cagaggaagagagaaaga

SEQ ID NO: 148212 - RNA, 18 nt, Artificial Sequence
  Description of Artificial Sequence: Synthetic oligonucleotide
gcaaacagaggaagagag

SEQ ID NO: 148213 - RNA, 18 nt, Artificial Sequence
  Description of Artificial Sequence: Synthetic oligonucleotide
gggaggcaaacagaggaa

SEQ ID NO: 148214 - RNA, 18 nt, Artificial Sequence
  Description of Artificial Sequence: Synthetic oligonucleotide
ggagagggaggcaaacag

SEQ ID NO: 148215 - RNA, 18 nt, Artificial Sequence
  Description of Artificial Sequence: Synthetic oligonucleotide
agacaggagagggaggca

SEQ ID NO: 148216 - RNA, 18 nt, Artificial Sequence
  Description of Artificial Sequence: Synthetic oligonucleotide
gggagacaggagagggag

SEQ ID NO: 148217 - RNA, 18 nt, Artificial Sequence
  Description of Artificial Sequence: Synthetic oligonucleotide
gaaagauaaagauguggg

SEQ ID NO: 148218 - RNA, 18 nt, Artificial Sequence
  Description of Artificial Sequence: Synthetic oligonucleotide
uuugagaaagauaaagau

SEQ ID NO: 148219 - RNA, 18 nt, Artificial Sequence
  Description of Artificial Sequence: Synthetic oligonucleotide
uuaaguuugagaaagaua

SEQ ID NO: 148220 - RNA, 18 nt, Artificial Sequence
  Description of Artificial Sequence: Synthetic oligonucleotide
gacucuuaaguuugagaa

SEQ ID NO: 148221 - RNA, 18 nt, Artificial Sequence
  Description of Artificial Sequence: Synthetic oligonucleotide
cccacgacucuuaaguuu

SEQ ID NO: 148222 - RNA, 18 nt, Artificial Sequence
  Description of Artificial Sequence: Synthetic oligonucleotide
uggaccccacgacucuua

SEQ ID NO: 148223 - RNA, 18 nt, Artificial Sequence
  Description of Artificial Sequence: Synthetic oligonucleotide
ucuccuggaccccacgac

SEQ ID NO: 148224 - RNA, 18 nt, Artificial Sequence
  Description of Artificial Sequence: Synthetic oligonucleotide
uggagucuccuggacccc

SEQ ID NO: 148225 - RNA, 18 nt, Artificial Sequence
  Description of Artificial Sequence: Synthetic oligonucleotide
acucuuggagucuccugg

SEQ ID NO: 148226 - RNA, 18 nt, Artificial Sequence
  Description of Artificial Sequence: Synthetic oligonucleotide
ugaauacucuuggagucu

SEQ ID NO: 148227 - RNA, 18 nt, Artificial Sequence
  Description of Artificial Sequence: Synthetic oligonucleotide
cuccuagcacagacaggg

SEQ ID NO: 148228 - RNA, 18 nt, Artificial Sequence
  Description of Artificial Sequence: Synthetic oligonucleotide
gagcuccuagcacagaca

SEQ ID NO: 148229 - RNA, 18 nt, Artificial Sequence
  Description of Artificial Sequence: Synthetic oligonucleotide
uauccgagcuccuagcac

SEQ ID NO: 148230 - RNA, 18 nt, Artificial Sequence
  Description of Artificial Sequence: Synthetic oligonucleotide
cuguuuauccgagcuccu

SEQ ID NO: 148231 - RNA, 18 nt, Artificial Sequence
  Description of Artificial Sequence: Synthetic oligonucleotide
gcugacuguuuauccgag

SEQ ID NO: 148232 - RNA, 18 nt, Artificial Sequence
  Description of Artificial Sequence: Synthetic oligonucleotide
gcucggcugacuguuuau

SEQ ID NO: 148233 - RNA, 18 nt, Artificial Sequence
  Description of Artificial Sequence: Synthetic oligonucleotide
ucgaggcucggcugacug

SEQ ID NO: 148234 - RNA, 18 nt, Artificial Sequence
  Description of Artificial Sequence: Synthetic oligonucleotide
gggcgucgaggcucggcu

SEQ ID NO: 148235 - RNA, 18 nt, Artificial Sequence
  Description of Artificial Sequence: Synthetic oligonucleotide
ggaggcggacgauuuggg

SEQ ID NO: 148236 - RNA, 18 nt, Artificial Sequence
  Description of Artificial Sequence: Synthetic oligonucleotide
uuggaggcggacgauuug

SEQ ID NO: 148237 - RNA, 18 nt, Artificial Sequence
  Description of Artificial Sequence: Synthetic oligonucleotide
gcuguccgcgcgugcggg

SEQ ID NO: 148238 - RNA, 18 nt, Artificial Sequence
  Description of Artificial Sequence: Synthetic oligonucleotide
cgggagcuguccgcgcgu

SEQ ID NO: 148239 - RNA, 18 nt, Artificial Sequence
  Description of Artificial Sequence: Synthetic oligonucleotide
caacccgggagcuguccg

SEQ ID NO: 148240 - RNA, 18 nt, Artificial Sequence
  Description of Artificial Sequence: Synthetic oligonucleotide
gcaggcaacccgggagcu

SEQ ID NO: 148241 - RNA, 18 nt, Artificial Sequence
  Description of Artificial Sequence: Synthetic oligonucleotide
gcgccgcaggcaacccgg

SEQ ID NO: 148242 - RNA, 18 nt, Artificial Sequence
  Description of Artificial Sequence: Synthetic oligonucleotide
cgccugcgccgcaggcaa

SEQ ID NO: 148243 - RNA, 18 nt, Artificial Sequence
  Description of Artificial Sequence: Synthetic oligonucleotide
caucccgccugcgccgca

SEQ ID NO: 148244 - RNA, 18 nt, Artificial Sequence
  Description of Artificial Sequence: Synthetic oligonucleotide
agcagcaucccgccugcg

SEQ ID NO: 148245 - RNA, 18 nt, Artificial Sequence
  Description of Artificial Sequence: Synthetic oligonucleotide
ugcgaagcagcaucccgc

SEQ ID NO: 148246 - RNA, 18 nt, Artificial Sequence
  Description of Artificial Sequence: Synthetic oligonucleotide
acuagugcgaagcagcau

SEQ ID NO: 148247 - RNA, 18 nt, Artificial Sequence
  Description of Artificial Sequence: Synthetic oligonucleotide
acuggacuagugcgaagc

SEQ ID NO: 148248 - RNA, 18 nt, Artificial Sequence
  Description of Artificial Sequence: Synthetic oligonucleotide
agaggacuggacuagugc

SEQ ID NO: 148249 - RNA, 18 nt, Artificial Sequence
  Description of Artificial Sequence: Synthetic oligonucleotide
cuggcagaggacuggacu

SEQ ID NO: 148250 - RNA, 18 nt, Artificial Sequence
  Description of Artificial Sequence: Synthetic oligonucleotide
agggccuggcagaggacu

SEQ ID NO: 148251 - RNA, 18 nt, Artificial Sequence
  Description of Artificial Sequence: Synthetic oligonucleotide
gaggaagggccuggcaga

SEQ ID NO: 148252 - RNA, 18 nt, Artificial Sequence
  Description of Artificial Sequence: Synthetic oligonucleotide
gaggagaggaagggccug

SEQ ID NO: 148253 - RNA, 18 nt, Artificial Sequence
  Description of Artificial Sequence: Synthetic oligonucleotide
aaagcgaggagaggaagg

SEQ ID NO: 148254 - RNA, 18 nt, Artificial Sequence
  Description of Artificial Sequence: Synthetic oligonucleotide
guaagaaagcgaggagag

SEQ ID NO: 148255 - RNA, 18 nt, Artificial Sequence
  Description of Artificial Sequence: Synthetic oligonucleotide
agggcguaagaaagcgag

SEQ ID NO: 148256 - RNA, 18 nt, Artificial Sequence
  Description of Artificial Sequence: Synthetic oligonucleotide
cggaaagggcguaagaaa

SEQ ID NO: 148257 - RNA, 18 nt, Artificial Sequence
  Description of Artificial Sequence: Synthetic oligonucleotide
gccagcggaaagggcgua

SEQ ID NO: 148258 - RNA, 18 nt, Artificial Sequence
  Description of Artificial Sequence: Synthetic oligonucleotide
uucaugccagcggaaagg

SEQ ID NO: 148259 - RNA, 18 nt, Artificial Sequence
  Description of Artificial Sequence: Synthetic oligonucleotide
gggaauucaugccagcgg

SEQ ID NO: 148260 - RNA, 18 nt, Artificial Sequence
  Description of Artificial Sequence: Synthetic oligonucleotide
ggagaaaaugccaaaggg

SEQ ID NO: 148261 - RNA, 18 nt, Artificial Sequence
  Description of Artificial Sequence: Synthetic oligonucleotide
gggagaaaaugccaaagg

SEQ ID NO: 148262 - RNA, 18 nt, Artificial Sequence
  Description of Artificial Sequence: Synthetic oligonucleotide
agaugacagaaaagaggg

SEQ ID NO: 148263 - RNA, 18 nt, Artificial Sequence
  Description of Artificial Sequence: Synthetic oligonucleotide
ccagaugacagaaaagag

SEQ ID NO: 148264 - RNA, 18 nt, Artificial Sequence
  Description of Artificial Sequence: Synthetic oligonucleotide
agaaaccagaugacagaa

SEQ ID NO: 148265 - RNA, 18 nt, Artificial Sequence
  Description of Artificial Sequence: Synthetic oligonucleotide
uggagagaaaccagauga

SEQ ID NO: 148266 - RNA, 18 nt, Artificial Sequence
  Description of Artificial Sequence: Synthetic oligonucleotide
gggacuggagagaaacca

SEQ ID NO: 148267 - RNA, 18 nt, Artificial Sequence
  Description of Artificial Sequence: Synthetic oligonucleotide
aagguagaaagcaaaggg

SEQ ID NO: 148268 - RNA, 18 nt, Artificial Sequence
  Description of Artificial Sequence: Synthetic oligonucleotide
caagguagaaagcaaagg

SEQ ID NO: 148269 - RNA, 18 nt, Artificial Sequence
  Description of Artificial Sequence: Synthetic oligonucleotide
cgacgcaagguagaaagc

SEQ ID NO: 148270 - RNA, 18 nt, Artificial Sequence
  Description of Artificial Sequence: Synthetic oligonucleotide
ccuugcgacgcaagguag

SEQ ID NO: 148271 - RNA, 18 nt, Artificial Sequence
  Description of Artificial Sequence: Synthetic oligonucleotide
ucaggccuugcgacgcaa

SEQ ID NO: 148272 - RNA, 18 nt, Artificial Sequence
  Description of Artificial Sequence: Synthetic oligonucleotide
gcgacucaggccuugcga

SEQ ID NO: 148273 - RNA, 18 nt, Artificial Sequence
  Description of Artificial Sequence: Synthetic oligonucleotide
agagggcgacucaggccu

SEQ ID NO: 148274 - RNA, 18 nt, Artificial Sequence
  Description of Artificial Sequence: Synthetic oligonucleotide
gggcgagagggcgacuca

SEQ ID NO: 148275 - RNA, 18 nt, Artificial Sequence
  Description of Artificial Sequence: Synthetic oligonucleotide
gggcugggcgagagggcg

SEQ ID NO: 148276 - RNA, 18 nt, Artificial Sequence
  Description of Artificial Sequence: Synthetic oligonucleotide
gcugggcugaagacuggg

SEQ ID NO: 148277 - RNA, 18 nt, Artificial Sequence
  Description of Artificial Sequence: Synthetic oligonucleotide
gacgcugggcugaagacu

SEQ ID NO: 148278 - RNA, 18 nt, Artificial Sequence
  Description of Artificial Sequence: Synthetic oligonucleotide
gcacagacgcugggcuga

SEQ ID NO: 148279 - RNA, 18 nt, Artificial Sequence
  Description of Artificial Sequence: Synthetic oligonucleotide
uggaagcacagacgcugg

SEQ ID NO: 148280 - RNA, 18 nt, Artificial Sequence
  Description of Artificial Sequence: Synthetic oligonucleotide
gggacuggaagcacagac

SEQ ID NO: 148281 - RNA, 18 nt, Artificial Sequence
  Description of Artificial Sequence: Synthetic oligonucleotide
accacgcggaggaguggg

SEQ ID NO: 148282 - RNA, 18 nt, Artificial Sequence
  Description of Artificial Sequence: Synthetic oligonucleotide
cacgaccacgcggaggag

SEQ ID NO: 148283 - RNA, 18 nt, Artificial Sequence
  Description of Artificial Sequence: Synthetic oligonucleotide
accuccacgaccacgcgg

SEQ ID NO: 148284 - RNA, 18 nt, Artificial Sequence
  Description of Artificial Sequence: Synthetic oligonucleotide
gguggaccuccacgacca

SEQ ID NO: 148285 - RNA, 18 nt, Artificial Sequence
  Description of Artificial Sequence: Synthetic oligonucleotide
aaggugguggaccuccac

SEQ ID NO: 148286 - RNA, 18 nt, Artificial Sequence
  Description of Artificial Sequence: Synthetic oligonucleotide
gaagaaaggugguggacc

SEQ ID NO: 148287 - RNA, 18 nt, Artificial Sequence
  Description of Artificial Sequence: Synthetic oligonucleotide
cuugagaagaaagguggu

SEQ ID NO: 148288 - RNA, 18 nt, Artificial Sequence
  Description of Artificial Sequence: Synthetic oligonucleotide
ccgagcuugagaagaaag

SEQ ID NO: 148289 - RNA, 18 nt, Artificial Sequence
  Description of Artificial Sequence: Synthetic oligonucleotide
uguucccgagcuugagaa

SEQ ID NO: 148290 - RNA, 18 nt, Artificial Sequence
  Description of Artificial Sequence: Synthetic oligonucleotide
gggcauguucccgagcuu

SEQ ID NO: 148291 - RNA, 18 nt, Artificial Sequence
  Description of Artificial Sequence: Synthetic oligonucleotide
cggaagggcauguucccg

SEQ ID NO: 148292 - RNA, 18 nt, Artificial Sequence
  Description of Artificial Sequence: Synthetic oligonucleotide
cagggcggaagggcaugu

SEQ ID NO: 148293 - RNA, 18 nt, Artificial Sequence
  Description of Artificial Sequence: Synthetic oligonucleotide
gcaggcagggcggaaggg

SEQ ID NO: 148294 - RNA, 18 nt, Artificial Sequence
  Description of Artificial Sequence: Synthetic oligonucleotide
aggaagcaggcagggcgg

SEQ ID NO: 148295 - RNA, 18 nt, Artificial Sequence
  Description of Artificial Sequence: Synthetic oligonucleotide
ggcgaaggaagcaggcag

SEQ ID NO: 148296 - RNA, 18 nt, Artificial Sequence
  Description of Artificial Sequence: Synthetic oligonucleotide
ggacgggcgaaggaagca

SEQ ID NO: 148297 - RNA, 18 nt, Artificial Sequence
  Description of Artificial Sequence: Synthetic oligonucleotide
gcccgggacgggcgaagg

SEQ ID NO: 148298 - RNA, 18 nt, Artificial Sequence
  Description of Artificial Sequence: Synthetic oligonucleotide
ccgcggcccgggacgggc

SEQ ID NO: 148299 - RNA, 18 nt, Artificial Sequence
  Description of Artificial Sequence: Synthetic oligonucleotide
aggguccgcggcccggga

SEQ ID NO: 148300 - RNA, 18 nt, Artificial Sequence
  Description of Artificial Sequence: Synthetic oligonucleotide
uagucaggguccgcggcc

SEQ ID NO: 148301 - RNA, 18 nt, Artificial Sequence
  Description of Artificial Sequence: Synthetic oligonucleotide
gccauuagucaggguccg

SEQ ID NO: 148302 - RNA, 18 nt, Artificial Sequence
  Description of Artificial Sequence: Synthetic oligonucleotide
gaccggccauuagucagg

SEQ ID NO: 148303 - RNA, 18 nt, Artificial Sequence
  Description of Artificial Sequence: Synthetic oligonucleotide
gcagggaccggccauuag

SEQ ID NO: 148304 - RNA, 18 nt, Artificial Sequence
  Description of Artificial Sequence: Synthetic oligonucleotide
acacagcagggaccggcc

SEQ ID NO: 148305 - RNA, 18 nt, Artificial Sequence
  Description of Artificial Sequence: Synthetic oligonucleotide
cccacacacagcagggac

SEQ ID NO: 148306 - RNA, 18 nt, Artificial Sequence
  Description of Artificial Sequence: Synthetic oligonucleotide
aacaccccacacacagca

SEQ ID NO: 148307 - RNA, 18 nt, Artificial Sequence
  Description of Artificial Sequence: Synthetic oligonucleotide
aacacaacaccccacaca

SEQ ID NO: 148308 - RNA, 18 nt, Artificial Sequence
  Description of Artificial Sequence: Synthetic oligonucleotide
aaaaaaacacaacacccc

SEQ ID NO: 148309 - RNA, 18 nt, Artificial Sequence
  Description of Artificial Sequence: Synthetic oligonucleotide
uucacacccccgugcccu

SEQ ID NO: 148310 - RNA, 18 nt, Artificial Sequence
  Description of Artificial Sequence: Synthetic oligonucleotide
gcugguucacacccccgu

SEQ ID NO: 148311 - RNA, 18 nt, Artificial Sequence
  Description of Artificial Sequence: Synthetic oligonucleotide
cccgagcugguucacacc

SEQ ID NO: 148312 - RNA, 18 nt, Artificial Sequence
  Description of Artificial Sequence: Synthetic oligonucleotide
acccccccgagcugguuc

SEQ ID NO: 148313 - RNA, 18 nt, Artificial Sequence
  Description of Artificial Sequence: Synthetic oligonucleotide
caaacacccccccgagcu

SEQ ID NO: 148314 - RNA, 18 nt, Artificial Sequence
  Description of Artificial Sequence: Synthetic oligonucleotide
guucacaaacaccccccc

SEQ ID NO: 148315 - RNA, 18 nt, Artificial Sequence
  Description of Artificial Sequence: Synthetic oligonucleotide
cggccguucacaaacacc

SEQ ID NO: 148316 - RNA, 18 nt, Artificial Sequence
  Description of Artificial Sequence: Synthetic oligonucleotide
gggccggccguucacaaa

SEQ ID NO: 148317 - RNA, 18 nt, Artificial Sequence
  Description of Artificial Sequence: Synthetic oligonucleotide
ucaccacgucggguaggg

SEQ ID NO: 148318 - RNA, 18 nt, Artificial Sequence
  Description of Artificial Sequence: Synthetic oligonucleotide
cugccucaccacgucggg

SEQ ID NO: 148319 - RNA, 18 nt, Artificial Sequence
  Description of Artificial Sequence: Synthetic oligonucleotide
augcgcugccucaccacg

SEQ ID NO: 148320 - RNA, 18 nt, Artificial Sequence
  Description of Artificial Sequence: Synthetic oligonucleotide
ccacgaugcgcugccuca

SEQ ID NO: 148321 - RNA, 18 nt, Artificial Sequence
  Description of Artificial Sequence: Synthetic oligonucleotide
cagcuccacgaugcgcug

SEQ ID NO: 148322 - RNA, 18 nt, Artificial Sequence
  Description of Artificial Sequence: Synthetic oligonucleotide
ugggccagcuccacgaug

SEQ ID NO: 148323 - RNA, 18 nt, Artificial Sequence
  Description of Artificial Sequence: Synthetic oligonucleotide
ccuggugggccagcucca

SEQ ID NO: 148324 - RNA, 18 nt, Artificial Sequence
  Description of Artificial Sequence: Synthetic oligonucleotide
cacacccuggugggccag

SEQ ID NO: 148325 - RNA, 18 nt, Artificial Sequence
  Description of Artificial Sequence: Synthetic oligonucleotide
ggccgcacacccuggugg

SEQ ID NO: 148326 - RNA, 18 nt, Artificial Sequence
  Description of Artificial Sequence: Synthetic oligonucleotide
cacagggccgcacacccu

SEQ ID NO: 148327 - RNA, 18 nt, Artificial Sequence
  Description of Artificial Sequence: Synthetic oligonucleotide
gaugucacagggccgcac

SEQ ID NO: 148328 - RNA, 18 nt, Artificial Sequence
  Description of Artificial Sequence: Synthetic oligonucleotide
cgggagaugucacagggc

SEQ ID NO: 148329 - RNA, 18 nt, Artificial Sequence
  Description of Artificial Sequence: Synthetic oligonucleotide
gcugccgggagaugucac

SEQ ID NO: 148330 - RNA, 18 nt, Artificial Sequence
  Description of Artificial Sequence: Synthetic oligonucleotide
ccgcagcugccgggagau

SEQ ID NO: 148331 - RNA, 18 nt, Artificial Sequence
  Description of Artificial Sequence: Synthetic oligonucleotide
cugacccgcagcugccgg

SEQ ID NO: 148332 - RNA, 18 nt, Artificial Sequence
  Description of Artificial Sequence: Synthetic oligonucleotide
cguggcugacccgcagcu

SEQ ID NO: 148333 - RNA, 18 nt, Artificial Sequence
  Description of Artificial Sequence: Synthetic oligonucleotide
acagccguggcugacccg

SEQ ID NO: 148334 - RNA, 18 nt, Artificial Sequence
  Description of Artificial Sequence: Synthetic oligonucleotide
cugacacagccguggcug

SEQ ID NO: 148335 - RNA, 18 nt, Artificial Sequence
  Description of Artificial Sequence: Synthetic oligonucleotide
uuuugcugacacagccgu

SEQ ID NO: 148336 - RNA, 18 nt, Artificial Sequence
  Description of Artificial Sequence: Synthetic oligonucleotide
caggauuuugcugacaca

SEQ ID NO: 148337 - RNA, 18 nt, Artificial Sequence
  Description of Artificial Sequence: Synthetic oligonucleotide
cugcccaggauuuugcug

SEQ ID NO: 148338 - RNA, 18 nt, Artificial Sequence
  Description of Artificial Sequence: Synthetic oligonucleotide
cgcgcgggccaggccccc

SEQ ID NO: 148339 - RNA, 18 nt, Artificial Sequence
  Description of Artificial Sequence: Synthetic oligonucleotide
gggagcgcgcgggccagg

SEQ ID NO: 148340 - RNA, 18 nt, Artificial Sequence
  Description of Artificial Sequence: Synthetic oligonucleotide
guggcgccugcgggaggg

SEQ ID NO: 148341 - RNA, 18 nt, Artificial Sequence
  Description of Artificial Sequence: Synthetic oligonucleotide
agguggcgccugcgggag

SEQ ID NO: 148342 - RNA, 18 nt, Artificial Sequence
  Description of Artificial Sequence: Synthetic oligonucleotide
guccgagguggcgccugc

SEQ ID NO: 148343 - RNA, 18 nt, Artificial Sequence
  Description of Artificial Sequence: Synthetic oligonucleotide
gggauguccgagguggcg

SEQ ID NO: 148344 - RNA, 18 nt, Artificial Sequence
  Description of Artificial Sequence: Synthetic oligonucleotide
agaaguagcaaucccggg

SEQ ID NO: 148345 - RNA, 18 nt, Artificial Sequence
  Description of Artificial Sequence: Synthetic oligonucleotide
gagaaguagcaaucccgg

SEQ ID NO: 148346 - RNA, 18 nt, Artificial Sequence
  Description of Artificial Sequence: Synthetic oligonucleotide
uggcagagaaguagcaau

SEQ ID NO: 148347 - RNA, 18 nt, Artificial Sequence
  Description of Artificial Sequence: Synthetic oligonucleotide
gaaguuggcagagaagua

SEQ ID NO: 148348 - RNA, 18 nt, Artificial Sequence
  Description of Artificial Sequence: Synthetic oligonucleotide
uuggcgaaguuggcagag

SEQ ID NO: 148349 - RNA, 18 nt, Artificial Sequence
  Description of Artificial Sequence: Synthetic oligonucleotide
gcgaguuggcgaaguugg

SEQ ID NO: 148350 - RNA, 18 nt, Artificial Sequence
  Description of Artificial Sequence: Synthetic oligonucleotide
ugcuggcgaguuggcgaa

SEQ ID NO: 148351 - RNA, 18 nt, Artificial Sequence
  Description of Artificial Sequence: Synthetic oligonucleotide
ccaagugcuggcgaguug

SEQ ID NO: 148352 - RNA, 18 nt, Artificial Sequence
  Description of Artificial Sequence: Synthetic oligonucleotide
ccucuccaagugcuggcg

SEQ ID NO: 148353 - RNA, 18 nt, Artificial Sequence
  Description of Artificial Sequence: Synthetic oligonucleotide
ccgggccucuccaagugc

SEQ ID NO: 148354 - RNA, 18 nt, Artificial Sequence
  Description of Artificial Sequence: Synthetic oligonucleotide
gggagccgggccucucca

SEQ ID NO: 148355 - RNA, 18 nt, Artificial Sequence
  Description of Artificial Sequence: Synthetic oligonucleotide
cagagggcgccgggaggg

SEQ ID NO: 148356 - RNA, 18 nt, Artificial Sequence
  Description of Artificial Sequence: Synthetic oligonucleotide
cggucagagggcgccggg

SEQ ID NO: 148357 - RNA, 18 nt, Artificial Sequence
  Description of Artificial Sequence: Synthetic oligonucleotide
ggucggagagcgcgcggg

SEQ ID NO: 148358 - RNA, 18 nt, Artificial Sequence
  Description of Artificial Sequence: Synthetic oligonucleotide
gcgguggucggagagcgc

SEQ ID NO: 148359 - RNA, 18 nt, Artificial Sequence
  Description of Artificial Sequence: Synthetic oligonucleotide
gagaggcgguggucggag

SEQ ID NO: 148360 - RNA, 18 nt, Artificial Sequence
  Description of Artificial Sequence: Synthetic oligonucleotide
cauccgagaggcgguggu

SEQ ID NO: 148361 - RNA, 18 nt, Artificial Sequence
  Description of Artificial Sequence: Synthetic oligonucleotide
cuggucauccgagaggcg

SEQ ID NO: 148362 - RNA, 18 nt, Artificial Sequence
  Description of Artificial Sequence: Synthetic oligonucleotide
ggaaccuggucauccgag

SEQ ID NO: 148363 - RNA, 18 nt, Artificial Sequence
  Description of Artificial Sequence: Synthetic oligonucleotide
ccccuggaaccuggucau

SEQ ID NO: 148364 - RNA, 18 nt, Artificial Sequence
  Description of Artificial Sequence: Synthetic oligonucleotide
cagcuccccuggaaccug

SEQ ID NO: 148365 - RNA, 18 nt, Artificial Sequence
  Description of Artificial Sequence: Synthetic oligonucleotide
ucgcucagcuccccugga

SEQ ID NO: 148366 - RNA, 18 nt, Artificial Sequence
  Description of Artificial Sequence: Synthetic oligonucleotide
gcgacucgcucagcuccc

SEQ ID NO: 148367 - RNA, 18 nt, Artificial Sequence
  Description of Artificial Sequence: Synthetic oligonucleotide
gggaggcgacucgcucag

SEQ ID NO: 148368 - RNA, 18 nt, Artificial Sequence
  Description of Artificial Sequence: Synthetic oligonucleotide
gggcugaagcugggcggg

SEQ ID NO: 148369 - RNA, 18 nt, Artificial Sequence
  Description of Artificial Sequence: Synthetic oligonucleotide
agggcugaagcugggcgg

SEQ ID NO: 148370 - RNA, 18 nt, Artificial Sequence
  Description of Artificial Sequence: Synthetic oligonucleotide
cagccagggcugaagcug

SEQ ID NO: 148371 - RNA, 18 nt, Artificial Sequence
  Description of Artificial Sequence: Synthetic oligonucleotide
agcugcagccagggcuga

SEQ ID NO: 148372 - RNA, 18 nt, Artificial Sequence
  Description of Artificial Sequence: Synthetic oligonucleotide
gcugcagcugcagccagg

SEQ ID NO: 148373 - RNA, 18 nt, Artificial Sequence
  Description of Artificial Sequence: Synthetic oligonucleotide
cucgcgcugcagcugcag

SEQ ID NO: 148374 - RNA, 18 nt, Artificial Sequence
  Description of Artificial Sequence: Synthetic oligonucleotide
cauggcucgcgcugcagc

SEQ ID NO: 148375 - RNA, 18 nt, Artificial Sequence
  Description of Artificial Sequence: Synthetic oligonucleotide
gggcgcauggcucgcgcu

SEQ ID NO: 148376 - RNA, 18 nt, Artificial Sequence
  Description of Artificial Sequence: Synthetic oligonucleotide
gcggugggccgggccggg

SEQ ID NO: 148377 - RNA, 18 nt, Artificial Sequence
  Description of Artificial Sequence: Synthetic oligonucleotide
gggcggugggccgggccg

SEQ ID NO: 148378 - RNA, 18 nt, Artificial Sequence
  Description of Artificial Sequence: Synthetic oligonucleotide
cagcagaauggccccggg

SEQ ID NO: 148379 - RNA, 18 nt, Artificial Sequence
  Description of Artificial Sequence: Synthetic oligonucleotide
gucagcagaauggccccg

SEQ ID NO: 148380 - RNA, 18 nt, Artificial Sequence
  Description of Artificial Sequence: Synthetic oligonucleotide
gggcggucagcagaaugg

SEQ ID NO: 148381 - RNA, 18 nt, Artificial Sequence
  Description of Artificial Sequence: Synthetic oligonucleotide
gggcugggcggucagcag

SEQ ID NO: 148382 - RNA, 18 nt, Artificial Sequence
  Description of Artificial Sequence: Synthetic oligonucleotide
caacuugccacugucggg

SEQ ID NO: 148383 - RNA, 18 nt, Artificial Sequence
  Description of Artificial Sequence: Synthetic oligonucleotide
cgcaacuugccacugucg

SEQ ID NO: 148384 - RNA, 18 nt, Artificial Sequence
  Description of Artificial Sequence: Synthetic oligonucleotide
guagccgcaacuugccac

SEQ ID NO: 148385 - RNA, 18 nt, Artificial Sequence
  Description of Artificial Sequence: Synthetic oligonucleotide
cugcaguagccgcaacuu

SEQ ID NO: 148386 - RNA, 18 nt, Artificial Sequence
  Description of Artificial Sequence: Synthetic oligonucleotide
ugcaacugcaguagccgc

SEQ ID NO: 148387 - RNA, 18 nt, Artificial Sequence
  Description of Artificial Sequence: Synthetic oligonucleotide
gagcuugcaacugcagua

SEQ ID NO: 148388 - RNA, 18 nt, Artificial Sequence
  Description of Artificial Sequence: Synthetic oligonucleotide
ggccggagcuugcaacug

SEQ ID NO: 148389 - RNA, 18 nt, Artificial Sequence
  Description of Artificial Sequence: Synthetic oligonucleotide
ggguuggccggagcuugc

SEQ ID NO: 148390 - RNA, 18 nt, Artificial Sequence
  Description of Artificial Sequence: Synthetic oligonucleotide
ccuccggguuggccggag

SEQ ID NO: 148391 - RNA, 18 nt, Artificial Sequence
  Description of Artificial Sequence: Synthetic oligonucleotide
gggcuccuccggguuggc

SEQ ID NO: 148392 - RNA, 18 nt, Artificial Sequence
  Description of Artificial Sequence: Synthetic oligonucleotide
acugcgcuccccgcuggg

SEQ ID NO: 148393 - RNA, 18 nt, Artificial Sequence
  Description of Artificial Sequence: Synthetic oligonucleotide
cagcacugcgcuccccgc

SEQ ID NO: 148394 - RNA, 18 nt, Artificial Sequence
  Description of Artificial Sequence: Synthetic oligonucleotide
gggcgcagcacugcgcuc

SEQ ID NO: 148395 - RNA, 18 nt, Artificial Sequence
  Description of Artificial Sequence: Synthetic oligonucleotide
acgcccggcugcugcggg

SEQ ID NO: 148396 - RNA, 18 nt, Artificial Sequence
  Description of Artificial Sequence: Synthetic oligonucleotide
ugaacgcccggcugcugc

SEQ ID NO: 148397 - RNA, 18 nt, Artificial Sequence
  Description of Artificial Sequence: Synthetic oligonucleotide
augagugaacgcccggcu

SEQ ID NO: 148398 - RNA, 18 nt, Artificial Sequence
  Description of Artificial Sequence: Synthetic oligonucleotide
ggaggaugagugaacgcc

SEQ ID NO: 148399 - RNA, 18 nt, Artificial Sequence
  Description of Artificial Sequence: Synthetic oligonucleotide
gggagggaggaugaguga

SEQ ID NO: 148400 - RNA, 18 nt, Artificial Sequence
  Description of Artificial Sequence: Synthetic oligonucleotide
aaagggagggacgguggg

SEQ ID NO: 148401 - RNA, 18 nt, Artificial Sequence
  Description of Artificial Sequence: Synthetic oligonucleotide
gaaaagggagggacggug

SEQ ID NO: 148402 - RNA, 18 nt, Artificial Sequence
  Description of Artificial Sequence: Synthetic oligonucleotide
gaggagaaaagggaggga

SEQ ID NO: 148403 - RNA, 18 nt, Artificial Sequence
  Description of Artificial Sequence: Synthetic oligonucleotide
gacuugaggagaaaaggg

SEQ ID NO: 148404 - RNA, 18 nt, Artificial Sequence
  Description of Artificial Sequence: Synthetic oligonucleotide
uucaggacuugaggagaa

SEQ ID NO: 148405 - RNA, 18 nt, Artificial Sequence
  Description of Artificial Sequence: Synthetic oligonucleotide
ucaacuucaggacuugag

SEQ ID NO: 148406 - RNA, 18 nt, Artificial Sequence
  Description of Artificial Sequence: Synthetic oligonucleotide
caaacucaacuucaggac

SEQ ID NO: 148407 - RNA, 18 nt, Artificial Sequence
  Description of Artificial Sequence: Synthetic oligonucleotide
ccucucaaacucaacuuc

SEQ ID NO: 148408 - RNA, 18 nt, Artificial Sequence
  Description of Artificial Sequence: Synthetic oligonucleotide
ugucgccucucaaacuca

SEQ ID NO: 148409 - RNA, 18 nt, Artificial Sequence
  Description of Artificial Sequence: Synthetic oligonucleotide
cgccgugucgccucucaa

SEQ ID NO: 148410 - RNA, 18 nt, Artificial Sequence
  Description of Artificial Sequence: Synthetic oligonucleotide
gccgccgccgugucgccu

SEQ ID NO: 148411 - RNA, 18 nt, Artificial Sequence
  Description of Artificial Sequence: Synthetic oligonucleotide
cggccgccgccgccgugu

SEQ ID NO: 148412 - RNA, 18 nt, Artificial Sequence
  Description of Artificial Sequence: Synthetic oligonucleotide
cagcgcggccgccgccgc

SEQ ID NO: 148413 - RNA, 18 nt, Artificial Sequence
  Description of Artificial Sequence: Synthetic oligonucleotide
gggagcagcgcggccgcc

SEQ ID NO: 148414 - RNA, 18 nt, Artificial Sequence
  Description of Artificial Sequence: Synthetic oligonucleotide
ggagcgggagcagcgcgg

SEQ ID NO: 148415 - RNA, 18 nt, Artificial Sequence
  Description of Artificial Sequence: Synthetic oligonucleotide
gcagaggagcgggagcag

SEQ ID NO: 148416 - RNA, 18 nt, Artificial Sequence
  Description of Artificial Sequence: Synthetic oligonucleotide
gggaggcagaggagcggg

SEQ ID NO: 148417 - RNA, 18 nt, Artificial Sequence
  Description of Artificial Sequence: Synthetic oligonucleotide
gcagugcauauccauggg

SEQ ID NO: 148418 - RNA, 18 nt, Artificial Sequence
  Description of Artificial Sequence: Synthetic oligonucleotide
ugcagugcauauccaugg

SEQ ID NO: 148419 - RNA, 18 nt, Artificial Sequence
  Description of Artificial Sequence: Synthetic oligonucleotide
ugcuuugcagugcauauc

SEQ ID NO: 148420 - RNA, 18 nt, Artificial Sequence
  Description of Artificial Sequence: Synthetic oligonucleotide
gggucugcuuugcagugc

SEQ ID NO: 148421 - RNA, 18 nt, Artificial Sequence
  Description of Artificial Sequence: Synthetic oligonucleotide
gugcaucgcggagaaggg

SEQ ID NO: 148422 - RNA, 18 nt, Artificial Sequence
  Description of Artificial Sequence: Synthetic oligonucleotide
aggagccgggcgccggua

SEQ ID NO: 148423 - RNA, 18 nt, Artificial Sequence
  Description of Artificial Sequence: Synthetic oligonucleotide
gggacaggagccgggcgc

SEQ ID NO: 148424 - RNA, 18 nt, Artificial Sequence
  Description of Artificial Sequence: Synthetic oligonucleotide
gagccgggacaggagccg

SEQ ID NO: 148425 - RNA, 18 nt, Artificial Sequence
  Description of Artificial Sequence: Synthetic oligonucleotide
gccccgagccgggacagg

SEQ ID NO: 148426 - RNA, 18 nt, Artificial Sequence
  Description of Artificial Sequence: Synthetic oligonucleotide
ggagagccccgagccggg

SEQ ID NO: 148427 - RNA, 18 nt, Artificial Sequence
  Description of Artificial Sequence: Synthetic oligonucleotide
gggacggagagccccgag

SEQ ID NO: 148428 - RNA, 18 nt, Artificial Sequence
  Description of Artificial Sequence: Synthetic oligonucleotide
ggguugggacggagagcc

SEQ ID NO: 148429 - RNA, 18 nt, Artificial Sequence
  Description of Artificial Sequence: Synthetic oligonucleotide
ggacaggguugggacgga

SEQ ID NO: 148430 - RNA, 18 nt, Artificial Sequence
  Description of Artificial Sequence: Synthetic oligonucleotide
ggacuggacaggguuggg

SEQ ID NO: 148431 - RNA, 18 nt, Artificial Sequence
  Description of Artificial Sequence: Synthetic oligonucleotide
cgcugggacuggacaggg

SEQ ID NO: 148432 - RNA, 18 nt, Artificial Sequence
  Description of Artificial Sequence: Synthetic oligonucleotide
ggccacgcugggacugga

SEQ ID NO: 148433 - RNA, 18 nt, Artificial Sequence
  Description of Artificial Sequence: Synthetic oligonucleotide
gggccacgcugggacugg

SEQ ID NO: 148434 - RNA, 18 nt, Artificial Sequence
  Description of Artificial Sequence: Synthetic oligonucleotide
gggaccugagcgcgaggg

SEQ ID NO: 148435 - RNA, 18 nt, Artificial Sequence
  Description of Artificial Sequence: Synthetic oligonucleotide
aagaugggaccugagcgc

SEQ ID NO: 148436 - RNA, 18 nt, Artificial Sequence
  Description of Artificial Sequence: Synthetic oligonucleotide
ccuccaagaugggaccug

SEQ ID NO: 148437 - RNA, 18 nt, Artificial Sequence
  Description of Artificial Sequence: Synthetic oligonucleotide
ggaggccuccaagauggg

SEQ ID NO: 148438 - RNA, 18 nt, Artificial Sequence
  Description of Artificial Sequence: Synthetic oligonucleotide
gccagggaggccuccaag

SEQ ID NO: 148439 - RNA, 18 nt, Artificial Sequence
  Description of Artificial Sequence: Synthetic oligonucleotide
cagaagccagggaggccu

SEQ ID NO: 148440 - RNA, 18 nt, Artificial Sequence
  Description of Artificial Sequence: Synthetic oligonucleotide
gggaccagaagccaggga

SEQ ID NO: 148441 - RNA, 18 nt, Artificial Sequence
  Description of Artificial Sequence: Synthetic oligonucleotide
aaagagggaccagaagcc

SEQ ID NO: 148442 - RNA, 18 nt, Artificial Sequence
  Description of Artificial Sequence: Synthetic oligonucleotide
aacgaaaagagggaccag

SEQ ID NO: 148443 - RNA, 18 nt, Artificial Sequence
  Description of Artificial Sequence: Synthetic oligonucleotide
gaaagaacgaaaagaggg

SEQ ID NO: 148444 - RNA, 18 nt, Artificial Sequence
  Description of Artificial Sequence: Synthetic oligonucleotide
ggagagaaagaacgaaaa

SEQ ID NO: 148445 - RNA, 18 nt, Artificial Sequence
  Description of Artificial Sequence: Synthetic oligonucleotide
gcgagggagagaaagaac

SEQ ID NO: 148446 - RNA, 18 nt, Artificial Sequence
  Description of Artificial Sequence: Synthetic oligonucleotide
accgggcgagggagagaa

SEQ ID NO: 148447 - RNA, 18 nt, Artificial Sequence
  Description of Artificial Sequence: Synthetic oligonucleotide
gaaacaccgggcgaggga

SEQ ID NO: 148448 - RNA, 18 nt, Artificial Sequence
  Description of Artificial Sequence: Synthetic oligonucleotide
cauuagaaacaccgggcg

SEQ ID NO: 148449 - RNA, 18 nt, Artificial Sequence
  Description of Artificial Sequence: Synthetic oligonucleotide
ggaggcauuagaaacacc

SEQ ID NO: 148450 - RNA, 18 nt, Artificial Sequence
  Description of Artificial Sequence: Synthetic oligonucleotide
aaacuggaggcauuagaa

SEQ ID NO: 148451 - RNA, 18 nt, Artificial Sequence
  Description of Artificial Sequence: Synthetic oligonucleotide
gagagaaacuggaggcau

SEQ ID NO: 148452 - RNA, 18 nt, Artificial Sequence
  Description of Artificial Sequence: Synthetic oligonucleotide
ggcaggagagaaacugga

SEQ ID NO: 148453 - RNA, 18 nt, Artificial Sequence
  Description of Artificial Sequence: Synthetic oligonucleotide
cagaaggcaggagagaaa

SEQ ID NO: 148454 - RNA, 18 nt, Artificial Sequence
  Description of Artificial Sequence: Synthetic oligonucleotide
ggugacagaaggcaggag

SEQ ID NO: 148455 - RNA, 18 nt, Artificial Sequence
  Description of Artificial Sequence: Synthetic oligonucleotide
gaaugggugacagaaggc

SEQ ID NO: 148456 - RNA, 18 nt, Artificial Sequence
  Description of Artificial Sequence: Synthetic oligonucleotide
gguaagaaugggugacag

SEQ ID NO: 148457 - RNA, 18 nt, Artificial Sequence
  Description of Artificial Sequence: Synthetic oligonucleotide
agagagguaagaaugggu

SEQ ID NO: 148458 - RNA, 18 nt, Artificial Sequence
  Description of Artificial Sequence: Synthetic oligonucleotide
cagacagagagguaagaa

SEQ ID NO: 148459 - RNA, 18 nt, Artificial Sequence
  Description of Artificial Sequence: Synthetic oligonucleotide
gcaggcagacagagaggu

SEQ ID NO: 148460 - RNA, 18 nt, Artificial Sequence
  Description of Artificial Sequence: Synthetic oligonucleotide
ggaaggcaggcagacaga

SEQ ID NO: 148461 - RNA, 18 nt, Artificial Sequence
  Description of Artificial Sequence: Synthetic oligonucleotide
agguaggaaggcaggcag

SEQ ID NO: 148462 - RNA, 18 nt, Artificial Sequence
  Description of Artificial Sequence: Synthetic oligonucleotide
agggaagguaggaaggca

SEQ ID NO: 148463 - RNA, 18 nt, Artificial Sequence
  Description of Artificial Sequence: Synthetic oligonucleotide
ggaucagggaagguagga

SEQ ID NO: 148464 - RNA, 18 nt, Artificial Sequence
  Description of Artificial Sequence: Synthetic oligonucleotide
gauagggaucagggaagg

SEQ ID NO: 148465 - RNA, 18 nt, Artificial Sequence
  Description of Artificial Sequence: Synthetic oligonucleotide
caggugauagggaucagg

SEQ ID NO: 148466 - RNA, 18 nt, Artificial Sequence
  Description of Artificial Sequence: Synthetic oligonucleotide
aaaggcaggugauaggga

SEQ ID NO: 148467 - RNA, 18 nt, Artificial Sequence
  Description of Artificial Sequence: Synthetic oligonucleotide
agagcaaaggcaggugau

SEQ ID NO: 148468 - RNA, 18 nt, Artificial Sequence
  Description of Artificial Sequence: Synthetic oligonucleotide
uagaaagagcaaaggcag

SEQ ID NO: 148469 - RNA, 18 nt, Artificial Sequence
  Description of Artificial Sequence: Synthetic oligonucleotide
gcggauagaaagagcaaa

SEQ ID NO: 148470 - RNA, 18 nt, Artificial Sequence
  Description of Artificial Sequence: Synthetic oligonucleotide
aaggagcggauagaaaga

SEQ ID NO: 148471 - RNA, 18 nt, Artificial Sequence
  Description of Artificial Sequence: Synthetic oligonucleotide
cuaagaaggagcggauag

SEQ ID NO: 148472 - RNA, 18 nt, Artificial Sequence
  Description of Artificial Sequence: Synthetic oligonucleotide
augaccuaagaaggagcg

SEQ ID NO: 148473 - RNA, 18 nt, Artificial Sequence
  Description of Artificial Sequence: Synthetic oligonucleotide
aucccaugaccuaagaag

SEQ ID NO: 148474 - RNA, 18 nt, Artificial Sequence
  Description of Artificial Sequence: Synthetic oligonucleotide
cguggaucccaugaccua

SEQ ID NO: 148475 - RNA, 18 nt, Artificial Sequence
  Description of Artificial Sequence: Synthetic oligonucleotide
gaggccguggaucccaug

SEQ ID NO: 148476 - RNA, 18 nt, Artificial Sequence
  Description of Artificial Sequence: Synthetic oligonucleotide
gcuccgaggccguggauc

SEQ ID NO: 148477 - RNA, 18 nt, Artificial Sequence
  Description of Artificial Sequence: Synthetic oligonucleotide
ccagggcuccgaggccgu

SEQ ID NO: 148478 - RNA, 18 nt, Artificial Sequence
  Description of Artificial Sequence: Synthetic oligonucleotide
uggaaccagggcuccgag

SEQ ID NO: 148479 - RNA, 18 nt, Artificial Sequence
  Description of Artificial Sequence: Synthetic oligonucleotide
guggcuggaaccagggcu

SEQ ID NO: 148480 - RNA, 18 nt, Artificial Sequence
  Description of Artificial Sequence: Synthetic oligonucleotide
agaggguggcuggaacca

SEQ ID NO: 148481 - RNA, 18 nt, Artificial Sequence
  Description of Artificial Sequence: Synthetic oligonucleotide
uagggagaggguggcugg

SEQ ID NO: 148482 - RNA, 18 nt, Artificial Sequence
  Description of Artificial Sequence: Synthetic oligonucleotide
cugacuagggagagggug

SEQ ID NO: 148483 - RNA, 18 nt, Artificial Sequence
  Description of Artificial Sequence: Synthetic oligonucleotide
agaggcugacuagggaga

SEQ ID NO: 148484 - RNA, 18 nt, Artificial Sequence
  Description of Artificial Sequence: Synthetic oligonucleotide
gggcaagaggcugacuag

SEQ ID NO: 148485 - RNA, 18 nt, Artificial Sequence
  Description of Artificial Sequence: Synthetic oligonucleotide
gcccagggcaagaggcug

SEQ ID NO: 148486 - RNA, 18 nt, Artificial Sequence
  Description of Artificial Sequence: Synthetic oligonucleotide
ccccagcccagggcaaga

SEQ ID NO: 148487 - RNA, 18 nt, Artificial Sequence
  Description of Artificial Sequence: Synthetic oligonucleotide
uugccccccagcccaggg

SEQ ID NO: 148488 - RNA, 18 nt, Artificial Sequence
  Description of Artificial Sequence: Synthetic oligonucleotide
cuaauuugccccccagcc

SEQ ID NO: 148489 - RNA, 18 nt, Artificial Sequence
  Description of Artificial Sequence: Synthetic oligonucleotide
gccugcuaauuugccccc

SEQ ID NO: 148490 - RNA, 18 nt, Artificial Sequence
  Description of Artificial Sequence: Synthetic oligonucleotide
aaacugccugcuaauuug

SEQ ID NO: 148491 - RNA, 18 nt, Artificial Sequence
  Description of Artificial Sequence: Synthetic oligonucleotide
ccugaaaacugccugcua

SEQ ID NO: 148492 - RNA, 18 nt, Artificial Sequence
  Description of Artificial Sequence: Synthetic oligonucleotide
aacacccugaaaacugcc

SEQ ID NO: 148493 - RNA, 18 nt, Artificial Sequence
  Description of Artificial Sequence: Synthetic oligonucleotide
aaaacaacacccugaaaa

SEQ ID NO: 148494 - RNA, 18 nt, Artificial Sequence
  Description of Artificial Sequence: Synthetic oligonucleotide
acaacaaaacaacacccu

SEQ ID NO: 148495 - RNA, 18 nt, Artificial Sequence
  Description of Artificial Sequence: Synthetic oligonucleotide
agaaaacaacaaaacaac

SEQ ID NO: 148496 - RNA, 18 nt, Artificial Sequence
  Description of Artificial Sequence: Synthetic oligonucleotide
gacagagaaaacaacaaa

SEQ ID NO: 148497 - RNA, 18 nt, Artificial Sequence
  Description of Artificial Sequence: Synthetic oligonucleotide
gaaaagacagagaaaaca

SEQ ID NO: 148498 - RNA, 18 nt, Artificial Sequence
  Description of Artificial Sequence: Synthetic oligonucleotide
agagagaaaagacagaga

SEQ ID NO: 148499 - RNA, 18 nt, Artificial Sequence
  Description of Artificial Sequence: Synthetic oligonucleotide
gagaaagagagaaaagac

SEQ ID NO: 148500 - RNA, 18 nt, Artificial Sequence
  Description of Artificial Sequence: Synthetic oligonucleotide
gaagagagaaagagagaa

SEQ ID NO: 148501 - RNA, 18 nt, Artificial Sequence
  Description of Artificial Sequence: Synthetic oligonucleotide
cagaggaagagagaaaga

SEQ ID NO: 148502 - RNA, 18 nt, Artificial Sequence
  Description of Artificial Sequence: Synthetic oligonucleotide
gcaaacagaggaagagag

SEQ ID NO: 148503 - RNA, 18 nt, Artificial Sequence
  Description of Artificial Sequence: Synthetic oligonucleotide
gggaggcaaacagaggaa

SEQ ID NO: 148504 - RNA, 18 nt, Artificial Sequence
  Description of Artificial Sequence: Synthetic oligonucleotide
ggagagggaggcaaacag

SEQ ID NO: 148505 - RNA, 18 nt, Artificial Sequence
  Description of Artificial Sequence: Synthetic oligonucleotide
agacaggagagggaggca

SEQ ID NO: 148506 - RNA, 18 nt, Artificial Sequence
  Description of Artificial Sequence: Synthetic oligonucleotide
gggagacaggagagggag

SEQ ID NO: 148507 - RNA, 18 nt, Artificial Sequence
  Description of Artificial Sequence: Synthetic oligonucleotide
gaaagauaaagauguggg

SEQ ID NO: 148508 - RNA, 18 nt, Artificial Sequence
  Description of Artificial Sequence: Synthetic oligonucleotide
uuugagaaagauaaagau

SEQ ID NO: 148509 - RNA, 18 nt, Artificial Sequence
  Description of Artificial Sequence: Synthetic oligonucleotide
uuaaguuugagaaagaua

SEQ ID NO: 148510 - RNA, 18 nt, Artificial Sequence
  Description of Artificial Sequence: Synthetic oligonucleotide
gacucuuaaguuugagaa

SEQ ID NO: 148511 - RNA, 18 nt, Artificial Sequence
  Description of Artificial Sequence: Synthetic oligonucleotide
cccacgacucuuaaguuu

SEQ ID NO: 148512 - RNA, 18 nt, Artificial Sequence
  Description of Artificial Sequence: Synthetic oligonucleotide
uggaccccacgacucuua

SEQ ID NO: 148513 - RNA, 18 nt, Artificial Sequence
  Description of Artificial Sequence: Synthetic oligonucleotide
ucuccuggaccccacgac

SEQ ID NO: 148514 - RNA, 18 nt, Artificial Sequence
  Description of Artificial Sequence: Synthetic oligonucleotide
uggagucuccuggacccc

SEQ ID NO: 148515 - RNA, 18 nt, Artificial Sequence
  Description of Artificial Sequence: Synthetic oligonucleotide
acucuuggagucuccugg

SEQ ID NO: 148516 - RNA, 18 nt, Artificial Sequence
  Description of Artificial Sequence: Synthetic oligonucleotide
ugaauacucuuggagucu

SEQ ID NO: 148517 - RNA, 18 nt, Artificial Sequence
  Description of Artificial Sequence: Synthetic oligonucleotide
cuccuagcacagacaggg

SEQ ID NO: 148518 - RNA, 18 nt, Artificial Sequence
  Description of Artificial Sequence: Synthetic oligonucleotide
gagcuccuagcacagaca

SEQ ID NO: 148519 - RNA, 18 nt, Artificial Sequence
  Description of Artificial Sequence: Synthetic oligonucleotide
uauccgagcuccuagcac

SEQ ID NO: 148520 - RNA, 18 nt, Artificial Sequence
  Description of Artificial Sequence: Synthetic oligonucleotide
cuguuuauccgagcuccu

SEQ ID NO: 148521 - RNA, 18 nt, Artificial Sequence
  Description of Artificial Sequence: Synthetic oligonucleotide
gcugacuguuuauccgag

SEQ ID NO: 148522 - RNA, 18 nt, Artificial Sequence
  Description of Artificial Sequence: Synthetic oligonucleotide
gcucggcugacuguuuau

SEQ ID NO: 148523 - RNA, 18 nt, Artificial Sequence
  Description of Artificial Sequence: Synthetic oligonucleotide
ucgaggcucggcugacug

SEQ ID NO: 148524 - RNA, 18 nt, Artificial Sequence
  Description of Artificial Sequence: Synthetic oligonucleotide
gggcgucgaggcucggcu

SEQ ID NO: 148525 - RNA, 18 nt, Artificial Sequence
  Description of Artificial Sequence: Synthetic oligonucleotide
ggaggcggacgauuuggg

SEQ ID NO: 148526 - RNA, 18 nt, Artificial Sequence
  Description of Artificial Sequence: Synthetic oligonucleotide
uuggaggcggacgauuug

SEQ ID NO: 148527 - RNA, 18 nt, Artificial Sequence
  Description of Artificial Sequence: Synthetic oligonucleotide
gcuguccgcgcgugcggg

SEQ ID NO: 148528 - RNA, 18 nt, Artificial Sequence
  Description of Artificial Sequence: Synthetic oligonucleotide
cgggagcuguccgcgcgu

SEQ ID NO: 148529 - RNA, 18 nt, Artificial Sequence
  Description of Artificial Sequence: Synthetic oligonucleotide
caacccgggagcuguccg

SEQ ID NO: 148530 - RNA, 18 nt, Artificial Sequence
  Description of Artificial Sequence: Synthetic oligonucleotide
gcaggcaacccgggagcu

SEQ ID NO: 148531 - RNA, 18 nt, Artificial Sequence
  Description of Artificial Sequence: Synthetic oligonucleotide
gcgccgcaggcaacccgg

SEQ ID NO: 148532 - RNA, 18 nt, Artificial Sequence
  Description of Artificial Sequence: Synthetic oligonucleotide
cgccugcgccgcaggcaa

SEQ ID NO: 148533 - RNA, 18 nt, Artificial Sequence
  Description of Artificial Sequence: Synthetic oligonucleotide
caucccgccugcgccgca

SEQ ID NO: 148534 - RNA, 18 nt, Artificial Sequence
  Description of Artificial Sequence: Synthetic oligonucleotide
agcagcaucccgccugcg

SEQ ID NO: 148535 - RNA, 18 nt, Artificial Sequence
  Description of Artificial Sequence: Synthetic oligonucleotide
ugcgaagcagcaucccgc

SEQ ID NO: 148536 - RNA, 18 nt, Artificial Sequence
  Description of Artificial Sequence: Synthetic oligonucleotide
acuagugcgaagcagcau

SEQ ID NO: 148537 - RNA, 18 nt, Artificial Sequence
  Description of Artificial Sequence: Synthetic oligonucleotide
acuggacuagugcgaagc

SEQ ID NO: 148538 - RNA, 18 nt, Artificial Sequence
  Description of Artificial Sequence: Synthetic oligonucleotide
agaggacuggacuagugc

SEQ ID NO: 148539 - RNA, 18 nt, Artificial Sequence
  Description of Artificial Sequence: Synthetic oligonucleotide
cuggcagaggacuggacu

SEQ ID NO: 148540 - RNA, 18 nt, Artificial Sequence
  Description of Artificial Sequence: Synthetic oligonucleotide
agggccuggcagaggacu

SEQ ID NO: 148541 - RNA, 18 nt, Artificial Sequence
  Description of Artificial Sequence: Synthetic oligonucleotide
gaggaagggccuggcaga

SEQ ID NO: 148542 - RNA, 18 nt, Artificial Sequence
  Description of Artificial Sequence: Synthetic oligonucleotide
gaggagaggaagggccug

SEQ ID NO: 148543 - RNA, 18 nt, Artificial Sequence
  Description of Artificial Sequence: Synthetic oligonucleotide
aaagcgaggagaggaagg

SEQ ID NO: 148544 - RNA, 18 nt, Artificial Sequence
  Description of Artificial Sequence: Synthetic oligonucleotide
guaagaaagcgaggagag

SEQ ID NO: 148545 - RNA, 18 nt, Artificial Sequence
  Description of Artificial Sequence: Synthetic oligonucleotide
agggcguaagaaagcgag

SEQ ID NO: 148546 - RNA, 18 nt, Artificial Sequence
  Description of Artificial Sequence: Synthetic oligonucleotide
cggaaagggcguaagaaa

SEQ ID NO: 148547 - RNA, 18 nt, Artificial Sequence
  Description of Artificial Sequence: Synthetic oligonucleotide
gccagcggaaagggcgua

SEQ ID NO: 148548 - RNA, 18 nt, Artificial Sequence
  Description of Artificial Sequence: Synthetic oligonucleotide
uucaugccagcggaaagg

SEQ ID NO: 148549 - RNA, 18 nt, Artificial Sequence
  Description of Artificial Sequence: Synthetic oligonucleotide
gggaauucaugccagcgg

SEQ ID NO: 148550 - RNA, 18 nt, Artificial Sequence
  Description of Artificial Sequence: Synthetic oligonucleotide
ggagaaaaugccaaaggg

SEQ ID NO: 148551 - RNA, 18 nt, Artificial Sequence
  Description of Artificial Sequence: Synthetic oligonucleotide
gggagaaaaugccaaagg

SEQ ID NO: 148552 - RNA, 18 nt, Artificial Sequence
  Description of Artificial Sequence: Synthetic oligonucleotide
agaugacagaaaagaggg

SEQ ID NO: 148553 - RNA, 18 nt, Artificial Sequence
  Description of Artificial Sequence: Synthetic oligonucleotide
ccagaugacagaaaagag

SEQ ID NO: 148554 - RNA, 18 nt, Artificial Sequence
  Description of Artificial Sequence: Synthetic oligonucleotide
agaaaccagaugacagaa

SEQ ID NO: 148555 - RNA, 18 nt, Artificial Sequence
  Description of Artificial Sequence: Synthetic oligonucleotide
uggagagaaaccagauga

SEQ ID NO: 148556 - RNA, 18 nt, Artificial Sequence
  Description of Artificial Sequence: Synthetic oligonucleotide
gggacuggagagaaacca

SEQ ID NO: 148557 - RNA, 18 nt, Artificial Sequence
  Description of Artificial Sequence: Synthetic oligonucleotide
aagguagaaagcaaaggg

SEQ ID NO: 148558 - RNA, 18 nt, Artificial Sequence
  Description of Artificial Sequence: Synthetic oligonucleotide
caagguagaaagcaaagg

SEQ ID NO: 148559 - RNA, 18 nt, Artificial Sequence
  Description of Artificial Sequence: Synthetic oligonucleotide
cgacgcaagguagaaagc

SEQ ID NO: 148560 - RNA, 18 nt, Artificial Sequence
  Description of Artificial Sequence: Synthetic oligonucleotide
ccuugcgacgcaagguag

SEQ ID NO: 148561 - RNA, 18 nt, Artificial Sequence
  Description of Artificial Sequence: Synthetic oligonucleotide
ucaggccuugcgacgcaa

SEQ ID NO: 148562 - RNA, 18 nt, Artificial Sequence
  Description of Artificial Sequence: Synthetic oligonucleotide
gcgacucaggccuugcga

SEQ ID NO: 148563 - RNA, 18 nt, Artificial Sequence
  Description of Artificial Sequence: Synthetic oligonucleotide
agagggcgacucaggccu

SEQ ID NO: 148564 - RNA, 18 nt, Artificial Sequence
  Description of Artificial Sequence: Synthetic oligonucleotide
gggcgagagggcgacuca

SEQ ID NO: 148565 - RNA, 18 nt, Artificial Sequence
  Description of Artificial Sequence: Synthetic oligonucleotide
gggcugggcgagagggcg

SEQ ID NO: 148566 - RNA, 18 nt, Artificial Sequence
  Description of Artificial Sequence: Synthetic oligonucleotide
gcugggcugaagacuggg

SEQ ID NO: 148567 - RNA, 18 nt, Artificial Sequence
  Description of Artificial Sequence: Synthetic oligonucleotide
gacgcugggcugaagacu

SEQ ID NO: 148568 - RNA, 18 nt, Artificial Sequence
  Description of Artificial Sequence: Synthetic oligonucleotide
gcacagacgcugggcuga

SEQ ID NO: 148569 - RNA, 18 nt, Artificial Sequence
  Description of Artificial Sequence: Synthetic oligonucleotide
uggaagcacagacgcugg

SEQ ID NO: 148570 - RNA, 18 nt, Artificial Sequence
  Description of Artificial Sequence: Synthetic oligonucleotide
gggacuggaagcacagac

SEQ ID NO: 148571 - RNA, 18 nt, Artificial Sequence
  Description of Artificial Sequence: Synthetic oligonucleotide
accacgcggaggaguggg

SEQ ID NO: 148572 - RNA, 18 nt, Artificial Sequence
  Description of Artificial Sequence: Synthetic oligonucleotide
cacgaccacgcggaggag

SEQ ID NO: 148573 - RNA, 18 nt, Artificial Sequence
  Description of Artificial Sequence: Synthetic oligonucleotide
accuccacgaccacgcgg

SEQ ID NO: 148574 - RNA, 18 nt, Artificial Sequence
  Description of Artificial Sequence: Synthetic oligonucleotide
gguggaccuccacgacca

SEQ ID NO: 148575 - RNA, 18 nt, Artificial Sequence
  Description of Artificial Sequence: Synthetic oligonucleotide
aaggugguggaccuccac

SEQ ID NO: 148576 - RNA, 18 nt, Artificial Sequence
  Description of Artificial Sequence: Synthetic oligonucleotide
gaagaaaggugguggacc

SEQ ID NO: 148577 - RNA, 18 nt, Artificial Sequence
  Description of Artificial Sequence: Synthetic oligonucleotide
cuugagaagaaagguggu

SEQ ID NO: 148578 - RNA, 18 nt, Artificial Sequence
  Description of Artificial Sequence: Synthetic oligonucleotide
ccgagcuugagaagaaag

SEQ ID NO: 148579 - RNA, 18 nt, Artificial Sequence
  Description of Artificial Sequence: Synthetic oligonucleotide
uguucccgagcuugagaa

SEQ ID NO: 148580 - RNA, 18 nt, Artificial Sequence
  Description of Artificial Sequence: Synthetic oligonucleotide
gggcauguucccgagcuu

SEQ ID NO: 148581 - RNA, 18 nt, Artificial Sequence
  Description of Artificial Sequence: Synthetic oligonucleotide
cggaagggcauguucccg

SEQ ID NO: 148582 - RNA, 18 nt, Artificial Sequence
  Description of Artificial Sequence: Synthetic oligonucleotide
cagggcggaagggcaugu

SEQ ID NO: 148583 - RNA, 18 nt, Artificial Sequence
  Description of Artificial Sequence: Synthetic oligonucleotide
gcaggcagggcggaaggg

SEQ ID NO: 148584 - RNA, 18 nt, Artificial Sequence
  Description of Artificial Sequence: Synthetic oligonucleotide
aggaagcaggcagggcgg

SEQ ID NO: 148585 - RNA, 18 nt, Artificial Sequence
  Description of Artificial Sequence: Synthetic oligonucleotide
ggcgaaggaagcaggcag

SEQ ID NO: 148586 - RNA, 18 nt, Artificial Sequence
  Description of Artificial Sequence: Synthetic oligonucleotide
ggacgggcgaaggaagca

SEQ ID NO: 148587 - RNA, 18 nt, Artificial Sequence
  Description of Artificial Sequence: Synthetic oligonucleotide
gcccgggacgggcgaagg

SEQ ID NO: 148588 - RNA, 18 nt, Artificial Sequence
  Description of Artificial Sequence: Synthetic oligonucleotide
ccgcggcccgggacgggc

SEQ ID NO: 148589 - RNA, 18 nt, Artificial Sequence
  Description of Artificial Sequence: Synthetic oligonucleotide
aggguccgcggcccggga

SEQ ID NO: 148590 - RNA, 18 nt, Artificial Sequence
  Description of Artificial Sequence: Synthetic oligonucleotide
uagucaggguccgcggcc

SEQ ID NO: 148591 - RNA, 18 nt, Artificial Sequence
  Description of Artificial Sequence: Synthetic oligonucleotide
gccauuagucaggguccg

SEQ ID NO: 148592 - RNA, 18 nt, Artificial Sequence
  Description of Artificial Sequence: Synthetic oligonucleotide
gaccggccauuagucagg

SEQ ID NO: 148593 - RNA, 18 nt, Artificial Sequence
  Description of Artificial Sequence: Synthetic oligonucleotide
gcagggaccggccauuag

SEQ ID NO: 148594 - RNA, 18 nt, Artificial Sequence
  Description of Artificial Sequence: Synthetic oligonucleotide
acacagcagggaccggcc

SEQ ID NO: 148595 - RNA, 18 nt, Artificial Sequence
  Description of Artificial Sequence: Synthetic oligonucleotide
cccacacacagcagggac

SEQ ID NO: 148596 - RNA, 18 nt, Artificial Sequence
  Description of Artificial Sequence: Synthetic oligonucleotide
aacaccccacacacagca

SEQ ID NO: 148597 - RNA, 18 nt, Artificial Sequence
  Description of Artificial Sequence: Synthetic oligonucleotide
aacacaacaccccacaca

SEQ ID NO: 148598 - RNA, 18 nt, Artificial Sequence
  Description of Artificial Sequence: Synthetic oligonucleotide
aaaaaaacacaacacccc

SEQ ID NO: 148599 - RNA, 18 nt, Artificial Sequence
  Description of Artificial Sequence: Synthetic oligonucleotide
uucacacccccgugcccu

SEQ ID NO: 148600 - RNA, 18 nt, Artificial Sequence
  Description of Artificial Sequence: Synthetic oligonucleotide
gcugguucacacccccgu

SEQ ID NO: 148601 - RNA, 18 nt, Artificial Sequence
  Description of Artificial Sequence: Synthetic oligonucleotide
cccgagcugguucacacc

SEQ ID NO: 148602 - RNA, 18 nt, Artificial Sequence
  Description of Artificial Sequence: Synthetic oligonucleotide
acccccccgagcugguuc

SEQ ID NO: 148603 - RNA, 18 nt, Artificial Sequence
  Description of Artificial Sequence: Synthetic oligonucleotide
caaacacccccccgagcu

SEQ ID NO: 148604 - RNA, 18 nt, Artificial Sequence
  Description of Artificial Sequence: Synthetic oligonucleotide
guucacaaacaccccccc

SEQ ID NO: 148605 - RNA, 18 nt, Artificial Sequence
  Description of Artificial Sequence: Synthetic oligonucleotide
cggccguucacaaacacc

SEQ ID NO: 148606 - RNA, 18 nt, Artificial Sequence
  Description of Artificial Sequence: Synthetic oligonucleotide
gggccggccguucacaaa

SEQ ID NO: 148607 - RNA, 18 nt, Artificial Sequence
  Description of Artificial Sequence: Synthetic oligonucleotide
ucaccacgucggguaggg

SEQ ID NO: 148608 - RNA, 18 nt, Artificial Sequence
  Description of Artificial Sequence: Synthetic oligonucleotide
cugccucaccacgucggg

SEQ ID NO: 148609 - RNA, 18 nt, Artificial Sequence
  Description of Artificial Sequence: Synthetic oligonucleotide
augcgcugccucaccacg

SEQ ID NO: 148610 - RNA, 18 nt, Artificial Sequence
  Description of Artificial Sequence: Synthetic oligonucleotide
ccacgaugcgcugccuca

SEQ ID NO: 148611 - RNA, 18 nt, Artificial Sequence
  Description of Artificial Sequence: Synthetic oligonucleotide
cagcuccacgaugcgcug

SEQ ID NO: 148612 - RNA, 18 nt, Artificial Sequence
  Description of Artificial Sequence: Synthetic oligonucleotide
ugggccagcuccacgaug

SEQ ID NO: 148613 - RNA, 18 nt, Artificial Sequence
  Description of Artificial Sequence: Synthetic oligonucleotide
ccuggugggccagcucca

SEQ ID NO: 148614 - RNA, 18 nt, Artificial Sequence
  Description of Artificial Sequence: Synthetic oligonucleotide
cacacccuggugggccag

SEQ ID NO: 148615 - RNA, 18 nt, Artificial Sequence
  Description of Artificial Sequence: Synthetic oligonucleotide
ggccgcacacccuggugg

SEQ ID NO: 148616 - RNA, 18 nt, Artificial Sequence
  Description of Artificial Sequence: Synthetic oligonucleotide
cacagggccgcacacccu

SEQ ID NO: 148617 - RNA, 18 nt, Artificial Sequence
  Description of Artificial Sequence: Synthetic oligonucleotide
gaugucacagggccgcac

SEQ ID NO: 148618 - RNA, 18 nt, Artificial Sequence
  Description of Artificial Sequence: Synthetic oligonucleotide
cgggagaugucacagggc

SEQ ID NO: 148619 - RNA, 18 nt, Artificial Sequence
  Description of Artificial Sequence: Synthetic oligonucleotide
gcugccgggagaugucac

SEQ ID NO: 148620 - RNA, 18 nt, Artificial Sequence
  Description of Artificial Sequence: Synthetic oligonucleotide
ccgcagcugccgggagau

SEQ ID NO: 148621 - RNA, 18 nt, Artificial Sequence
  Description of Artificial Sequence: Synthetic oligonucleotide
cugacccgcagcugccgg

SEQ ID NO: 148622 - RNA, 18 nt, Artificial Sequence
  Description of Artificial Sequence: Synthetic oligonucleotide
cguggcugacccgcagcu

SEQ ID NO: 148623 - RNA, 18 nt, Artificial Sequence
  Description of Artificial Sequence: Synthetic oligonucleotide
acagccguggcugacccg

SEQ ID NO: 148624 - RNA, 18 nt, Artificial Sequence
  Description of Artificial Sequence: Synthetic oligonucleotide
cugacacagccguggcug

SEQ ID NO: 148625 - RNA, 18 nt, Artificial Sequence
  Description of Artificial Sequence: Synthetic oligonucleotide
uuuugcugacacagccgu

SEQ ID NO: 148626 - RNA, 18 nt, Artificial Sequence
  Description of Artificial Sequence: Synthetic oligonucleotide
caggauuuugcugacaca

SEQ ID NO: 148627 - RNA, 18 nt, Artificial Sequence
  Description of Artificial Sequence: Synthetic oligonucleotide
cugcccaggauuuugcug

SEQ ID NO: 148628 - RNA, 18 nt, Artificial Sequence
  Description of Artificial Sequence: Synthetic oligonucleotide
uuugaggagaaacugcuc

SEQ ID NO: 148629 - RNA, 18 nt, Artificial Sequence
  Description of Artificial Sequence: Synthetic oligonucleotide
ggguauuugaggagaaac

SEQ ID NO: 148630 - RNA, 18 nt, Artificial Sequence
  Description of Artificial Sequence: Synthetic oligonucleotide
gucguugcuguucacggg

SEQ ID NO: 148631 - RNA, 18 nt, Artificial Sequence
  Description of Artificial Sequence: Synthetic oligonucleotide
gacgucguugcuguucac

SEQ ID NO: 148632 - RNA, 18 nt, Artificial Sequence
  Description of Artificial Sequence: Synthetic oligonucleotide
aagaagacgucguugcug

SEQ ID NO: 148633 - RNA, 18 nt, Artificial Sequence
  Description of Artificial Sequence: Synthetic oligonucleotide
ggcugaagaagacgucgu

SEQ ID NO: 148634 - RNA, 18 nt, Artificial Sequence
  Description of Artificial Sequence: Synthetic oligonucleotide
gugcaggcugaagaagac

SEQ ID NO: 148635 - RNA, 18 nt, Artificial Sequence
  Description of Artificial Sequence: Synthetic oligonucleotide
accgcgugcaggcugaag

SEQ ID NO: 148636 - RNA, 18 nt, Artificial Sequence
  Description of Artificial Sequence: Synthetic oligonucleotide
ggacaaccgcgugcaggc

SEQ ID NO: 148637 - RNA, 18 nt, Artificial Sequence
  Description of Artificial Sequence: Synthetic oligonucleotide
cgugaggacaaccgcgug

SEQ ID NO: 148638 - RNA, 18 nt, Artificial Sequence
  Description of Artificial Sequence: Synthetic oligonucleotide
aucagcgugaggacaacc

SEQ ID NO: 148639 - RNA, 18 nt, Artificial Sequence
  Description of Artificial Sequence: Synthetic oligonucleotide
ugaugaucagcgugagga

SEQ ID NO: 148640 - RNA, 18 nt, Artificial Sequence
  Description of Artificial Sequence: Synthetic oligonucleotide
cacgaugaugaucagcgu

SEQ ID NO: 148641 - RNA, 18 nt, Artificial Sequence
  Description of Artificial Sequence: Synthetic oligonucleotide
cacugcacgaugaugauc

SEQ ID NO: 148642 - RNA, 18 nt, Artificial Sequence
  Description of Artificial Sequence: Synthetic oligonucleotide
ggcagcacugcacgauga

SEQ ID NO: 148643 - RNA, 18 nt, Artificial Sequence
  Description of Artificial Sequence: Synthetic oligonucleotide
auacaggcagcacugcac

SEQ ID NO: 148644 - RNA, 18 nt, Artificial Sequence
  Description of Artificial Sequence: Synthetic oligonucleotide
gggccagggcuggucuca

SEQ ID NO: 148645 - RNA, 18 nt, Artificial Sequence
  Description of Artificial Sequence: Synthetic oligonucleotide
uggcggguguuggcuggg

SEQ ID NO: 148646 - RNA, 18 nt, Artificial Sequence
  Description of Artificial Sequence: Synthetic oligonucleotide
ggguggcggguguuggcu

SEQ ID NO: 148647 - RNA, 18 nt, Artificial Sequence
  Description of Artificial Sequence: Synthetic oligonucleotide
ugucaaaggugagguggg

SEQ ID NO: 148648 - RNA, 18 nt, Artificial Sequence
  Description of Artificial Sequence: Synthetic oligonucleotide
ucuucugucaaaggugag

SEQ ID NO: 148649 - RNA, 18 nt, Artificial Sequence
  Description of Artificial Sequence: Synthetic oligonucleotide
ccgugucuucugucaaag

SEQ ID NO: 148650 - RNA, 18 nt, Artificial Sequence
  Description of Artificial Sequence: Synthetic oligonucleotide
cucugccgugucuucugu

SEQ ID NO: 148651 - RNA, 18 nt, Artificial Sequence
  Description of Artificial Sequence: Synthetic oligonucleotide
ccaggcucugccgugucu

SEQ ID NO: 148652 - RNA, 18 nt, Artificial Sequence
  Description of Artificial Sequence: Synthetic oligonucleotide
cuuucccaggcucugccg

SEQ ID NO: 148653 - RNA, 18 nt, Artificial Sequence
  Description of Artificial Sequence: Synthetic oligonucleotide
ccuuccuuucccaggcuc

SEQ ID NO: 148654 - RNA, 18 nt, Artificial Sequence
  Description of Artificial Sequence: Synthetic oligonucleotide
cacacccuuccuuuccca

SEQ ID NO: 148655 - RNA, 18 nt, Artificial Sequence
  Description of Artificial Sequence: Synthetic oligonucleotide
gaacacacacccuuccuu

SEQ ID NO: 148656 - RNA, 18 nt, Artificial Sequence
  Description of Artificial Sequence: Synthetic oligonucleotide
ugaaugaacacacacccu

SEQ ID NO: 148657 - RNA, 18 nt, Artificial Sequence
  Description of Artificial Sequence: Synthetic oligonucleotide
cuggaugaaugaacacac

SEQ ID NO: 148658 - RNA, 18 nt, Artificial Sequence
  Description of Artificial Sequence: Synthetic oligonucleotide
aggaccuggaugaaugaa

SEQ ID NO: 148659 - RNA, 18 nt, Artificial Sequence
  Description of Artificial Sequence: Synthetic oligonucleotide
agcacaggaccuggauga

SEQ ID NO: 148660 - RNA, 18 nt, Artificial Sequence
  Description of Artificial Sequence: Synthetic oligonucleotide
ugcccagcacaggaccug

SEQ ID NO: 148661 - RNA, 18 nt, Artificial Sequence
  Description of Artificial Sequence: Synthetic oligonucleotide
uucuaugcccagcacagg

SEQ ID NO: 148662 - RNA, 18 nt, Artificial Sequence
  Description of Artificial Sequence: Synthetic oligonucleotide
gugucuucuaugcccagc

SEQ ID NO: 148663 - RNA, 18 nt, Artificial Sequence
  Description of Artificial Sequence: Synthetic oligonucleotide
caugggugucuucuaugc

SEQ ID NO: 148664 - RNA, 18 nt, Artificial Sequence
  Description of Artificial Sequence: Synthetic oligonucleotide
ggacucaugggugucuuc

SEQ ID NO: 148665 - RNA, 18 nt, Artificial Sequence
  Description of Artificial Sequence: Synthetic oligonucleotide
ggccuggacucaugggug

SEQ ID NO: 148666 - RNA, 18 nt, Artificial Sequence
  Description of Artificial Sequence: Synthetic oligonucleotide
cugagggccuggacucau

SEQ ID NO: 148667 - RNA, 18 nt, Artificial Sequence
  Description of Artificial Sequence: Synthetic oligonucleotide
gggcucugagggccugga

SEQ ID NO: 148668 - RNA, 18 nt, Artificial Sequence
  Description of Artificial Sequence: Synthetic oligonucleotide
ucccucaccccagacuug

SEQ ID NO: 148669 - RNA, 18 nt, Artificial Sequence
  Description of Artificial Sequence: Synthetic oligonucleotide
cugagucccucaccccag

SEQ ID NO: 148670 - RNA, 18 nt, Artificial Sequence
  Description of Artificial Sequence: Synthetic oligonucleotide
ucucccugagucccucac

SEQ ID NO: 148671 - RNA, 18 nt, Artificial Sequence
  Description of Artificial Sequence: Synthetic oligonucleotide
cugccucucccugagucc

SEQ ID NO: 148672 - RNA, 18 nt, Artificial Sequence
  Description of Artificial Sequence: Synthetic oligonucleotide
aggcacugccucucccug

SEQ ID NO: 148673 - RNA, 18 nt, Artificial Sequence
  Description of Artificial Sequence: Synthetic oligonucleotide
aguccaggcacugccucu

SEQ ID NO: 148674 - RNA, 18 nt, Artificial Sequence
  Description of Artificial Sequence: Synthetic oligonucleotide
gccugaguccaggcacug

SEQ ID NO: 148675 - RNA, 18 nt, Artificial Sequence
  Description of Artificial Sequence: Synthetic oligonucleotide
ucucagccugaguccagg

SEQ ID NO: 148676 - RNA, 18 nt, Artificial Sequence
  Description of Artificial Sequence: Synthetic oligonucleotide
acggcucucagccugagu

SEQ ID NO: 148677 - RNA, 18 nt, Artificial Sequence
  Description of Artificial Sequence: Synthetic oligonucleotide
ugugcacggcucucagcc

SEQ ID NO: 148678 - RNA, 18 nt, Artificial Sequence
  Description of Artificial Sequence: Synthetic oligonucleotide
uccucugugcacggcucu

SEQ ID NO: 148679 - RNA, 18 nt, Artificial Sequence
  Description of Artificial Sequence: Synthetic oligonucleotide
ugugcuccucugugcacg

SEQ ID NO: 148680 - RNA, 18 nt, Artificial Sequence
  Description of Artificial Sequence: Synthetic oligonucleotide
cugucugugcuccucugu

SEQ ID NO: 148681 - RNA, 18 nt, Artificial Sequence
  Description of Artificial Sequence: Synthetic oligonucleotide
augagcugucugugcucc

SEQ ID NO: 148682 - RNA, 18 nt, Artificial Sequence
  Description of Artificial Sequence: Synthetic oligonucleotide
ccuccaugagcugucugu

SEQ ID NO: 148683 - RNA, 18 nt, Artificial Sequence
  Description of Artificial Sequence: Synthetic oligonucleotide
gcacuccuccaugagcug

SEQ ID NO: 148684 - RNA, 18 nt, Artificial Sequence
  Description of Artificial Sequence: Synthetic oligonucleotide
gccuugcacuccuccaug

SEQ ID NO: 148685 - RNA, 18 nt, Artificial Sequence
  Description of Artificial Sequence: Synthetic oligonucleotide
ucagggccuugcacuccu

SEQ ID NO: 148686 - RNA, 18 nt, Artificial Sequence
  Description of Artificial Sequence: Synthetic oligonucleotide
agggcucagggccuugca

SEQ ID NO: 148687 - RNA, 18 nt, Artificial Sequence
  Description of Artificial Sequence: Synthetic oligonucleotide
cuggcagggcucagggcc

SEQ ID NO: 148688 - RNA, 18 nt, Artificial Sequence
  Description of Artificial Sequence: Synthetic oligonucleotide
ccucccuggcagggcuca

SEQ ID NO: 148689 - RNA, 18 nt, Artificial Sequence
  Description of Artificial Sequence: Synthetic oligonucleotide
ucccuccucccuggcagg

SEQ ID NO: 148690 - RNA, 18 nt, Artificial Sequence
  Description of Artificial Sequence: Synthetic oligonucleotide
ccuccucccuccucccug

SEQ ID NO: 148691 - RNA, 18 nt, Artificial Sequence
  Description of Artificial Sequence: Synthetic oligonucleotide
ugugcccuccucccuccu

SEQ ID NO: 148692 - RNA, 18 nt, Artificial Sequence
  Description of Artificial Sequence: Synthetic oligonucleotide
ccuucugugcccuccucc

SEQ ID NO: 148693 - RNA, 18 nt, Artificial Sequence
  Description of Artificial Sequence: Synthetic oligonucleotide
uccucccuucugugcccu

SEQ ID NO: 148694 - RNA, 18 nt, Artificial Sequence
  Description of Artificial Sequence: Synthetic oligonucleotide
cucccuccucccuucugu

SEQ ID NO: 148695 - RNA, 18 nt, Artificial Sequence
  Description of Artificial Sequence: Synthetic oligonucleotide
cccuccucccuccucccu

SEQ ID NO: 148696 - RNA, 18 nt, Artificial Sequence
  Description of Artificial Sequence: Synthetic oligonucleotide
cugugcccuccucccucc

SEQ ID NO: 148697 - RNA, 18 nt, Artificial Sequence
  Description of Artificial Sequence: Synthetic oligonucleotide
cccuucugugcccuccuc

SEQ ID NO: 148698 - RNA, 18 nt, Artificial Sequence
  Description of Artificial Sequence: Synthetic oligonucleotide
cuccucccuucugugccc

SEQ ID NO: 148699 - RNA, 18 nt, Artificial Sequence
  Description of Artificial Sequence: Synthetic oligonucleotide
cugcccuccucccuucug

SEQ ID NO: 148700 - RNA, 18 nt, Artificial Sequence
  Description of Artificial Sequence: Synthetic oligonucleotide
uuccucugcccuccuccc

SEQ ID NO: 148701 - RNA, 18 nt, Artificial Sequence
  Description of Artificial Sequence: Synthetic oligonucleotide
gcgucuuccucugcccuc

SEQ ID NO: 148702 - RNA, 18 nt, Artificial Sequence
  Description of Artificial Sequence: Synthetic oligonucleotide
accaagcgucuuccucug

SEQ ID NO: 148703 - RNA, 18 nt, Artificial Sequence
  Description of Artificial Sequence: Synthetic oligonucleotide
gcccaaccaagcgucuuc

SEQ ID NO: 148704 - RNA, 18 nt, Artificial Sequence
  Description of Artificial Sequence: Synthetic oligonucleotide
uuggagcccaaccaagcg

SEQ ID NO: 148705 - RNA, 18 nt, Artificial Sequence
  Description of Artificial Sequence: Synthetic oligonucleotide
cauccuuggagcccaacc

SEQ ID NO: 148706 - RNA, 18 nt, Artificial Sequence
  Description of Artificial Sequence: Synthetic oligonucleotide
ucacucauccuuggagcc

SEQ ID NO: 148707 - RNA, 18 nt, Artificial Sequence
  Description of Artificial Sequence: Synthetic oligonucleotide
gaacuucacucauccuug

SEQ ID NO: 148708 - RNA, 18 nt, Artificial Sequence
  Description of Artificial Sequence: Synthetic oligonucleotide
cauaggaacuucacucau

SEQ ID NO: 148709 - RNA, 18 nt, Artificial Sequence
  Description of Artificial Sequence: Synthetic oligonucleotide
uccuccauaggaacuuca

SEQ ID NO: 148710 - RNA, 18 nt, Artificial Sequence
  Description of Artificial Sequence: Synthetic oligonucleotide
uccccuccuccauaggaa

SEQ ID NO: 148711 - RNA, 18 nt, Artificial Sequence
  Description of Artificial Sequence: Synthetic oligonucleotide
gccccuccccuccuccau

SEQ ID NO: 148712 - RNA, 18 nt, Artificial Sequence
  Description of Artificial Sequence: Synthetic oligonucleotide
cccuggccccuccccucc

SEQ ID NO: 148713 - RNA, 18 nt, Artificial Sequence
  Description of Artificial Sequence: Synthetic oligonucleotide
gcccacccuggccccucc

SEQ ID NO: 148714 - RNA, 18 nt, Artificial Sequence
  Description of Artificial Sequence: Synthetic oligonucleotide
caggagcccacccuggcc

SEQ ID NO: 148715 - RNA, 18 nt, Artificial Sequence
  Description of Artificial Sequence: Synthetic oligonucleotide
cccuccaggagcccaccc

SEQ ID NO: 148716 - RNA, 18 nt, Artificial Sequence
  Description of Artificial Sequence: Synthetic oligonucleotide
cugaccccuccaggagcc

SEQ ID NO: 148717 - RNA, 18 nt, Artificial Sequence
  Description of Artificial Sequence: Synthetic oligonucleotide
gugaccugaccccuccag

SEQ ID NO: 148718 - RNA, 18 nt, Artificial Sequence
  Description of Artificial Sequence: Synthetic oligonucleotide
ccucugugaccugacccc

SEQ ID NO: 148719 - RNA, 18 nt, Artificial Sequence
  Description of Artificial Sequence: Synthetic oligonucleotide
cuuggccucugugaccug

SEQ ID NO: 148720 - RNA, 18 nt, Artificial Sequence
  Description of Artificial Sequence: Synthetic oligonucleotide
ugccccuuggccucugug

SEQ ID NO: 148721 - RNA, 18 nt, Artificial Sequence
  Description of Artificial Sequence: Synthetic oligonucleotide
ucaaaugccccuuggccu

SEQ ID NO: 148722 - RNA, 18 nt, Artificial Sequence
  Description of Artificial Sequence: Synthetic oligonucleotide
cccucucaaaugccccuu

SEQ ID NO: 148723 - RNA, 18 nt, Artificial Sequence
  Description of Artificial Sequence: Synthetic oligonucleotide
agggucccucucaaaugc

SEQ ID NO: 148724 - RNA, 18 nt, Artificial Sequence
  Description of Artificial Sequence: Synthetic oligonucleotide
ugcucagggucccucuca

SEQ ID NO: 148725 - RNA, 18 nt, Artificial Sequence
  Description of Artificial Sequence: Synthetic oligonucleotide
ccgccugcucaggguccc

SEQ ID NO: 148726 - RNA, 18 nt, Artificial Sequence
  Description of Artificial Sequence: Synthetic oligonucleotide
ugcacccgccugcucagg

SEQ ID NO: 148727 - RNA, 18 nt, Artificial Sequence
  Description of Artificial Sequence: Synthetic oligonucleotide
ccagcugcacccgccugc

SEQ ID NO: 148728 - RNA, 18 nt, Artificial Sequence
  Description of Artificial Sequence: Synthetic oligonucleotide
gaagcccagcugcacccg

SEQ ID NO: 148729 - RNA, 18 nt, Artificial Sequence
  Description of Artificial Sequence: Synthetic oligonucleotide
acccugaagcccagcugc

SEQ ID NO: 148730 - RNA, 18 nt, Artificial Sequence
  Description of Artificial Sequence: Synthetic oligonucleotide
cuggcacccugaagccca

SEQ ID NO: 148731 - RNA, 18 nt, Artificial Sequence
  Description of Artificial Sequence: Synthetic oligonucleotide
cccuccuggcacccugaa

SEQ ID NO: 148732 - RNA, 18 nt, Artificial Sequence
  Description of Artificial Sequence: Synthetic oligonucleotide
gggcccccuccuggcacc

SEQ ID NO: 148733 - RNA, 18 nt, Artificial Sequence
  Description of Artificial Sequence: Synthetic oligonucleotide
cacgcgggcccccuccug

SEQ ID NO: 148734 - RNA, 18 nt, Artificial Sequence
  Description of Artificial Sequence: Synthetic oligonucleotide
gcuaagaaagccuagaag

SEQ ID NO: 148735 - RNA, 18 nt, Artificial Sequence
  Description of Artificial Sequence: Synthetic oligonucleotide
caaaagcuaagaaagccu

SEQ ID NO: 148736 - RNA, 18 nt, Artificial Sequence
  Description of Artificial Sequence: Synthetic oligonucleotide
cacaccaaaagcuaagaa

SEQ ID NO: 148737 - RNA, 18 nt, Artificial Sequence
  Description of Artificial Sequence: Synthetic oligonucleotide
cgcuucacaccaaaagcu

SEQ ID NO: 148738 - RNA, 18 nt, Artificial Sequence
  Description of Artificial Sequence: Synthetic oligonucleotide
acucucgcuucacaccaa

SEQ ID NO: 148739 - RNA, 18 nt, Artificial Sequence
  Description of Artificial Sequence: Synthetic oligonucleotide
ccuucacucucgcuucac

SEQ ID NO: 148740 - RNA, 18 nt, Artificial Sequence
  Description of Artificial Sequence: Synthetic oligonucleotide
ggccaccuucacucucgc

SEQ ID NO: 148741 - RNA, 18 nt, Artificial Sequence
  Description of Artificial Sequence: Synthetic oligonucleotide
augugggccaccuucacu

SEQ ID NO: 148742 - RNA, 18 nt, Artificial Sequence
  Description of Artificial Sequence: Synthetic oligonucleotide
gcccaaugugggccaccu

SEQ ID NO: 148743 - RNA, 18 nt, Artificial Sequence
  Description of Artificial Sequence: Synthetic oligonucleotide
cacgggcccaaugugggc

SEQ ID NO: 148744 - RNA, 18 nt, Artificial Sequence
  Description of Artificial Sequence: Synthetic oligonucleotide
cugaacacgggcccaaug

SEQ ID NO: 148745 - RNA, 18 nt, Artificial Sequence
  Description of Artificial Sequence: Synthetic oligonucleotide
uuucccugaacacgggcc

SEQ ID NO: 148746 - RNA, 18 nt, Artificial Sequence
  Description of Artificial Sequence: Synthetic oligonucleotide
uugccuuucccugaacac

SEQ ID NO: 148747 - RNA, 18 nt, Artificial Sequence
  Description of Artificial Sequence: Synthetic oligonucleotide
ucgccuugccuuucccug

SEQ ID NO: 148748 - RNA, 18 nt, Artificial Sequence
  Description of Artificial Sequence: Synthetic oligonucleotide
uccccucgccuugccuuu

SEQ ID NO: 148749 - RNA, 18 nt, Artificial Sequence
  Description of Artificial Sequence: Synthetic oligonucleotide
aucuguccccucgccuug

SEQ ID NO: 148750 - RNA, 18 nt, Artificial Sequence
  Description of Artificial Sequence: Synthetic oligonucleotide
caggaaucuguccccucg

SEQ ID NO: 148751 - RNA, 18 nt, Artificial Sequence
  Description of Artificial Sequence: Synthetic oligonucleotide
gaucucaggaaucugucc

SEQ ID NO: 148752 - RNA, 18 nt, Artificial Sequence
  Description of Artificial Sequence: Synthetic oligonucleotide
cugaggaucucaggaauc

SEQ ID NO: 148753 - RNA, 18 nt, Artificial Sequence
  Description of Artificial Sequence: Synthetic oligonucleotide
gcagccugaggaucucag

SEQ ID NO: 148754 - RNA, 18 nt, Artificial Sequence
  Description of Artificial Sequence: Synthetic oligonucleotide
cggcagcagccugaggau

SEQ ID NO: 148755 - RNA, 18 nt, Artificial Sequence
  Description of Artificial Sequence: Synthetic oligonucleotide
cgacccggcagcagccug

SEQ ID NO: 148756 - RNA, 18 nt, Artificial Sequence
  Description of Artificial Sequence: Synthetic oligonucleotide
ucccacgacccggcagca

SEQ ID NO: 148757 - RNA, 18 nt, Artificial Sequence
  Description of Artificial Sequence: Synthetic oligonucleotide
acucgucccacgacccgg

SEQ ID NO: 148758 - RNA, 18 nt, Artificial Sequence
  Description of Artificial Sequence: Synthetic oligonucleotide
uacugacucgucccacga

SEQ ID NO: 148759 - RNA, 18 nt, Artificial Sequence
  Description of Artificial Sequence: Synthetic oligonucleotide
ccagguacugacucgucc

SEQ ID NO: 148760 - RNA, 18 nt, Artificial Sequence
  Description of Artificial Sequence: Synthetic oligonucleotide
cccagccagguacugacu

SEQ ID NO: 148761 - RNA, 18 nt, Artificial Sequence
  Description of Artificial Sequence: Synthetic oligonucleotide
ccucucccagccagguac

SEQ ID NO: 148762 - RNA, 18 nt, Artificial Sequence
  Description of Artificial Sequence: Synthetic oligonucleotide
uggugccucucccagcca

SEQ ID NO: 148763 - RNA, 18 nt, Artificial Sequence
  Description of Artificial Sequence: Synthetic oligonucleotide
uggccuggugccucuccc

SEQ ID NO: 148764 - RNA, 18 nt, Artificial Sequence
  Description of Artificial Sequence: Synthetic oligonucleotide
ucugguggccuggugccu

SEQ ID NO: 148765 - RNA, 18 nt, Artificial Sequence
  Description of Artificial Sequence: Synthetic oligonucleotide
ggaacucugguggccugg

SEQ ID NO: 148766 - RNA, 18 nt, Artificial Sequence
  Description of Artificial Sequence: Synthetic oligonucleotide
gggucggaacucuggugg

SEQ ID NO: 148767 - RNA, 18 nt, Artificial Sequence
  Description of Artificial Sequence: Synthetic oligonucleotide
cucacuuggagacguggg

SEQ ID NO: 148768 - RNA, 18 nt, Artificial Sequence
  Description of Artificial Sequence: Synthetic oligonucleotide
acucacuuggagacgugg

SEQ ID NO: 148769 - RNA, 18 nt, Artificial Sequence
  Description of Artificial Sequence: Synthetic oligonucleotide
ucagcacucacuuggaga

SEQ ID NO: 148770 - RNA, 18 nt, Artificial Sequence
  Description of Artificial Sequence: Synthetic oligonucleotide
gccucucagcacucacuu

SEQ ID NO: 148771 - RNA, 18 nt, Artificial Sequence
  Description of Artificial Sequence: Synthetic oligonucleotide
ugggcgccucucagcacu

SEQ ID NO: 148772 - RNA, 18 nt, Artificial Sequence
  Description of Artificial Sequence: Synthetic oligonucleotide
agaacugggcgccucuca

SEQ ID NO: 148773 - RNA, 18 nt, Artificial Sequence
  Description of Artificial Sequence: Synthetic oligonucleotide
uuggcagaacugggcgcc

SEQ ID NO: 148774 - RNA, 18 nt, Artificial Sequence
  Description of Artificial Sequence: Synthetic oligonucleotide
ccuacuuggcagaacugg

SEQ ID NO: 148775 - RNA, 18 nt, Artificial Sequence
  Description of Artificial Sequence: Synthetic oligonucleotide
uuguuccuacuuggcaga

SEQ ID NO: 148776 - RNA, 18 nt, Artificial Sequence
  Description of Artificial Sequence: Synthetic oligonucleotide
cugcuuuguuccuacuug

SEQ ID NO: 148777 - RNA, 18 nt, Artificial Sequence
  Description of Artificial Sequence: Synthetic oligonucleotide
ucugucugcuuuguuccu

SEQ ID NO: 148778 - RNA, 18 nt, Artificial Sequence
  Description of Artificial Sequence: Synthetic oligonucleotide
caagcucugucugcuuug

SEQ ID NO: 148779 - RNA, 18 nt, Artificial Sequence
  Description of Artificial Sequence: Synthetic oligonucleotide
acucucaagcucugucug

SEQ ID NO: 148780 - RNA, 18 nt, Artificial Sequence
  Description of Artificial Sequence: Synthetic oligonucleotide
cuuggacucucaagcucu

SEQ ID NO: 148781 - RNA, 18 nt, Artificial Sequence
  Description of Artificial Sequence: Synthetic oligonucleotide
ggcugcuuggacucucaa

SEQ ID NO: 148782 - RNA, 18 nt, Artificial Sequence
  Description of Artificial Sequence: Synthetic oligonucleotide
guucaggcugcuuggacu

SEQ ID NO: 148783 - RNA, 18 nt, Artificial Sequence
  Description of Artificial Sequence: Synthetic oligonucleotide
cuccuguucaggcugcuu

SEQ ID NO: 148784 - RNA, 18 nt, Artificial Sequence
  Description of Artificial Sequence: Synthetic oligonucleotide
agggccuccuguucaggc

SEQ ID NO: 148785 - RNA, 18 nt, Artificial Sequence
  Description of Artificial Sequence: Synthetic oligonucleotide
ucgccagggccuccuguu

SEQ ID NO: 148786 - RNA, 18 nt, Artificial Sequence
  Description of Artificial Sequence: Synthetic oligonucleotide
ucucaucgccagggccuc

SEQ ID NO: 148787 - RNA, 18 nt, Artificial Sequence
  Description of Artificial Sequence: Synthetic oligonucleotide
caccuucucaucgccagg

SEQ ID NO: 148788 - RNA, 18 nt, Artificial Sequence
  Description of Artificial Sequence: Synthetic oligonucleotide
aaccacaccuucucaucg

SEQ ID NO: 148789 - RNA, 18 nt, Artificial Sequence
  Description of Artificial Sequence: Synthetic oligonucleotide
gcaccaaccacaccuucu

SEQ ID NO: 148790 - RNA, 18 nt, Artificial Sequence
  Description of Artificial Sequence: Synthetic oligonucleotide
ccccagcaccaaccacac

SEQ ID NO: 148791 - RNA, 18 nt, Artificial Sequence
  Description of Artificial Sequence: Synthetic oligonucleotide
gacauccccagcaccaac

SEQ ID NO: 148792 - RNA, 18 nt, Artificial Sequence
  Description of Artificial Sequence: Synthetic oligonucleotide
ugcuggacauccccagca

SEQ ID NO: 148793 - RNA, 18 nt, Artificial Sequence
  Description of Artificial Sequence: Synthetic oligonucleotide
gcuggugcuggacauccc

SEQ ID NO: 148794 - RNA, 18 nt, Artificial Sequence
  Description of Artificial Sequence: Synthetic oligonucleotide
ccugggcuggugcuggac

SEQ ID NO: 148795 - RNA, 18 nt, Artificial Sequence
  Description of Artificial Sequence: Synthetic oligonucleotide
ucacaccugggcuggugc

SEQ ID NO: 148796 - RNA, 18 nt, Artificial Sequence
  Description of Artificial Sequence: Synthetic oligonucleotide
aagcaucacaccugggcu

SEQ ID NO: 148797 - RNA, 18 nt, Artificial Sequence
  Description of Artificial Sequence: Synthetic oligonucleotide
acagaaagcaucacaccu

SEQ ID NO: 148798 - RNA, 18 nt, Artificial Sequence
  Description of Artificial Sequence: Synthetic oligonucleotide
ggaccacagaaagcauca

SEQ ID NO: 148799 - RNA, 18 nt, Artificial Sequence
  Description of Artificial Sequence: Synthetic oligonucleotide
cauguggaccacagaaag

SEQ ID NO: 148800 - RNA, 18 nt, Artificial Sequence
  Description of Artificial Sequence: Synthetic oligonucleotide
gggaacauguggaccaca

SEQ ID NO: 148801 - RNA, 18 nt, Artificial Sequence
  Description of Artificial Sequence: Synthetic oligonucleotide
gagccccugcaagguggg

SEQ ID NO: 148802 - RNA, 18 nt, Artificial Sequence
  Description of Artificial Sequence: Synthetic oligonucleotide
ugaaggagccccugcaag

SEQ ID NO: 148803 - RNA, 18 nt, Artificial Sequence
  Description of Artificial Sequence: Synthetic oligonucleotide
ggccuugaaggagccccu

SEQ ID NO: 148804 - RNA, 18 nt, Artificial Sequence
  Description of Artificial Sequence: Synthetic oligonucleotide
acccuggccuugaaggag

SEQ ID NO: 148805 - RNA, 18 nt, Artificial Sequence
  Description of Artificial Sequence: Synthetic oligonucleotide
gcuggacccuggccuuga

SEQ ID NO: 148806 - RNA, 18 nt, Artificial Sequence
  Description of Artificial Sequence: Synthetic oligonucleotide
cggaggcuggacccuggc

SEQ ID NO: 148807 - RNA, 18 nt, Artificial Sequence
  Description of Artificial Sequence: Synthetic oligonucleotide
gggcacggaggcuggacc

SEQ ID NO: 148808 - RNA, 18 nt, Artificial Sequence
  Description of Artificial Sequence: Synthetic oligonucleotide
gggcgggcuuagagaggg

SEQ ID NO: 148809 - RNA, 18 nt, Artificial Sequence
  Description of Artificial Sequence: Synthetic oligonucleotide
agggcgggcuuagagagg

SEQ ID NO: 148810 - RNA, 18 nt, Artificial Sequence
  Description of Artificial Sequence: Synthetic oligonucleotide
cggauagggcgggcuuag

SEQ ID NO: 148811 - RNA, 18 nt, Artificial Sequence
  Description of Artificial Sequence: Synthetic oligonucleotide
ggccccggauagggcggg

SEQ ID NO: 148812 - RNA, 18 nt, Artificial Sequence
  Description of Artificial Sequence: Synthetic oligonucleotide
aggacggccccggauagg

SEQ ID NO: 148813 - RNA, 18 nt, Artificial Sequence
  Description of Artificial Sequence: Synthetic oligonucleotide
gagcaaggacggccccgg

SEQ ID NO: 148814 - RNA, 18 nt, Artificial Sequence
  Description of Artificial Sequence: Synthetic oligonucleotide
gggcugagcaaggacggc

SEQ ID NO: 148815 - RNA, 18 nt, Artificial Sequence
  Description of Artificial Sequence: Synthetic oligonucleotide
cacagaggccacgccggg

SEQ ID NO: 148816 - RNA, 18 nt, Artificial Sequence
  Description of Artificial Sequence: Synthetic oligonucleotide
cccacacagaggccacgc

SEQ ID NO: 148817 - RNA, 18 nt, Artificial Sequence
  Description of Artificial Sequence: Synthetic oligonucleotide
guggacccacacagaggc

SEQ ID NO: 148818 - RNA, 18 nt, Artificial Sequence
  Description of Artificial Sequence: Synthetic oligonucleotide
gagauguggacccacaca

SEQ ID NO: 148819 - RNA, 18 nt, Artificial Sequence
  Description of Artificial Sequence: Synthetic oligonucleotide
gggcagagauguggaccc

SEQ ID NO: 148820 - RNA, 18 nt, Artificial Sequence
  Description of Artificial Sequence: Synthetic oligonucleotide
acacgcgcuggccaccgc

SEQ ID NO: 148821 - RNA, 18 nt, Artificial Sequence
  Description of Artificial Sequence: Synthetic oligonucleotide
ccaggacacgcgcuggcc

SEQ ID NO: 148822 - RNA, 18 nt, Artificial Sequence
  Description of Artificial Sequence: Synthetic oligonucleotide
gcaggccaggacacgcgc

SEQ ID NO: 148823 - RNA, 18 nt, Artificial Sequence
  Description of Artificial Sequence: Synthetic oligonucleotide
cgauggcaggccaggaca

SEQ ID NO: 148824 - RNA, 18 nt, Artificial Sequence
  Description of Artificial Sequence: Synthetic oligonucleotide
gaagccgauggcaggcca

SEQ ID NO: 148825 - RNA, 18 nt, Artificial Sequence
  Description of Artificial Sequence: Synthetic oligonucleotide
accaggaagccgauggca

SEQ ID NO: 148826 - RNA, 18 nt, Artificial Sequence
  Description of Artificial Sequence: Synthetic oligonucleotide
cgagcaccaggaagccga

SEQ ID NO: 148827 - RNA, 18 nt, Artificial Sequence
  Description of Artificial Sequence: Synthetic oligonucleotide
ccacgcgagcaccaggaa

SEQ ID NO: 148828 - RNA, 18 nt, Artificial Sequence
  Description of Artificial Sequence: Synthetic oligonucleotide
aagagccacgcgagcacc

SEQ ID NO: 148829 - RNA, 18 nt, Artificial Sequence
  Description of Artificial Sequence: Synthetic oligonucleotide
augcgaagagccacgcga

SEQ ID NO: 148830 - RNA, 18 nt, Artificial Sequence
  Description of Artificial Sequence: Synthetic oligonucleotide
gacaaaugcgaagagcca

SEQ ID NO: 148831 - RNA, 18 nt, Artificial Sequence
  Description of Artificial Sequence: Synthetic oligonucleotide
auggugacaaaugcgaag

SEQ ID NO: 148832 - RNA, 18 nt, Artificial Sequence
  Description of Artificial Sequence: Synthetic oligonucleotide
cgaucauggugacaaaug

SEQ ID NO: 148833 - RNA, 18 nt, Artificial Sequence
  Description of Artificial Sequence: Synthetic oligonucleotide
agccacgaucauggugac

SEQ ID NO: 148834 - RNA, 18 nt, Artificial Sequence
  Description of Artificial Sequence: Synthetic oligonucleotide
acugcagccacgaucaug

SEQ ID NO: 148835 - RNA, 18 nt, Artificial Sequence
  Description of Artificial Sequence: Synthetic oligonucleotide
cucccacugcagccacga

SEQ ID NO: 148836 - RNA, 18 nt, Artificial Sequence
  Description of Artificial Sequence: Synthetic oligonucleotide
ggucacucccacugcagc

SEQ ID NO: 148837 - RNA, 18 nt, Artificial Sequence
  Description of Artificial Sequence: Synthetic oligonucleotide
cacguggucacucccacu

SEQ ID NO: 148838 - RNA, 18 nt, Artificial Sequence
  Description of Artificial Sequence: Synthetic oligonucleotide
gcagccacguggucacuc

SEQ ID NO: 148839 - RNA, 18 nt, Artificial Sequence
  Description of Artificial Sequence: Synthetic oligonucleotide
aaacugcagccacguggu

SEQ ID NO: 148840 - RNA, 18 nt, Artificial Sequence
  Description of Artificial Sequence: Synthetic oligonucleotide
aagagaaacugcagccac

SEQ ID NO: 148841 - RNA, 18 nt, Artificial Sequence
  Description of Artificial Sequence: Synthetic oligonucleotide
agcagaagagaaacugca

SEQ ID NO: 148842 - RNA, 18 nt, Artificial Sequence
  Description of Artificial Sequence: Synthetic oligonucleotide
ggagaagcagaagagaaa

SEQ ID NO: 148843 - RNA, 18 nt, Artificial Sequence
  Description of Artificial Sequence: Synthetic oligonucleotide
auguaggagaagcagaag

SEQ ID NO: 148844 - RNA, 18 nt, Artificial Sequence
  Description of Artificial Sequence: Synthetic oligonucleotide
gcuugauguaggagaagc

SEQ ID NO: 148845 - RNA, 18 nt, Artificial Sequence
  Description of Artificial Sequence: Synthetic oligonucleotide
ugcgagcuugauguagga

SEQ ID NO: 148846 - RNA, 18 nt, Artificial Sequence
  Description of Artificial Sequence: Synthetic oligonucleotide
gugacugcgagcuugaug

SEQ ID NO: 148847 - RNA, 18 nt, Artificial Sequence
  Description of Artificial Sequence: Synthetic oligonucleotide
ccagcgugacugcgagcu

SEQ ID NO: 148848 - RNA, 18 nt, Artificial Sequence
  Description of Artificial Sequence: Synthetic oligonucleotide
cuugaccagcgugacugc

SEQ ID NO: 148849 - RNA, 18 nt, Artificial Sequence
  Description of Artificial Sequence: Synthetic oligonucleotide
aaauacuugaccagcgug

SEQ ID NO: 148850 - RNA, 18 nt, Artificial Sequence
  Description of Artificial Sequence: Synthetic oligonucleotide
guggaaaauacuugacca

SEQ ID NO: 148851 - RNA, 18 nt, Artificial Sequence
  Description of Artificial Sequence: Synthetic oligonucleotide
cacgcgcuggccaccgcg

SEQ ID NO: 148852 - RNA, 18 nt, Artificial Sequence
  Description of Artificial Sequence: Synthetic oligonucleotide
caggacacgcgcuggcca

SEQ ID NO: 148853 - RNA, 18 nt, Artificial Sequence
  Description of Artificial Sequence: Synthetic oligonucleotide
caggccaggacacgcgcu

SEQ ID NO: 148854 - RNA, 18 nt, Artificial Sequence
  Description of Artificial Sequence: Synthetic oligonucleotide
gauggcaggccaggacac

SEQ ID NO: 148855 - RNA, 18 nt, Artificial Sequence
  Description of Artificial Sequence: Synthetic oligonucleotide
aagccgauggcaggccag

SEQ ID NO: 148856 - RNA, 18 nt, Artificial Sequence
  Description of Artificial Sequence: Synthetic oligonucleotide
ccaggaagccgauggcag

SEQ ID NO: 148857 - RNA, 18 nt, Artificial Sequence
  Description of Artificial Sequence: Synthetic oligonucleotide
gagcaccaggaagccgau

SEQ ID NO: 148858 - RNA, 18 nt, Artificial Sequence
  Description of Artificial Sequence: Synthetic oligonucleotide
cacgcgagcaccaggaag

SEQ ID NO: 148859 - RNA, 18 nt, Artificial Sequence
  Description of Artificial Sequence: Synthetic oligonucleotide
agagccacgcgagcacca

SEQ ID NO: 148860 - RNA, 18 nt, Artificial Sequence
  Description of Artificial Sequence: Synthetic oligonucleotide
ugcgaagagccacgcgag

SEQ ID NO: 148861 - RNA, 18 nt, Artificial Sequence
  Description of Artificial Sequence: Synthetic oligonucleotide
acaaaugcgaagagccac

SEQ ID NO: 148862 - RNA, 18 nt, Artificial Sequence
  Description of Artificial Sequence: Synthetic oligonucleotide
uggugacaaaugcgaaga

SEQ ID NO: 148863 - RNA, 18 nt, Artificial Sequence
  Description of Artificial Sequence: Synthetic oligonucleotide
gaucauggugacaaaugc

SEQ ID NO: 148864 - RNA, 18 nt, Artificial Sequence
  Description of Artificial Sequence: Synthetic oligonucleotide
gccacgaucauggugaca

SEQ ID NO: 148865 - RNA, 18 nt, Artificial Sequence
  Description of Artificial Sequence: Synthetic oligonucleotide
cugcagccacgaucaugg

SEQ ID NO: 148866 - RNA, 18 nt, Artificial Sequence
  Description of Artificial Sequence: Synthetic oligonucleotide
ucccacugcagccacgau

SEQ ID NO: 148867 - RNA, 18 nt, Artificial Sequence
  Description of Artificial Sequence: Synthetic oligonucleotide
gucacucccacugcagcc

SEQ ID NO: 148868 - RNA, 18 nt, Artificial Sequence
  Description of Artificial Sequence: Synthetic oligonucleotide
acguggucacucccacug

SEQ ID NO: 148869 - RNA, 18 nt, Artificial Sequence
  Description of Artificial Sequence: Synthetic oligonucleotide
cagccacguggucacucc

SEQ ID NO: 148870 - RNA, 18 nt, Artificial Sequence
  Description of Artificial Sequence: Synthetic oligonucleotide
aacugcagccacgugguc

SEQ ID NO: 148871 - RNA, 18 nt, Artificial Sequence
  Description of Artificial Sequence: Synthetic oligonucleotide
agagaaacugcagccacg

SEQ ID NO: 148872 - RNA, 18 nt, Artificial Sequence
  Description of Artificial Sequence: Synthetic oligonucleotide
gcagaagagaaacugcag

SEQ ID NO: 148873 - RNA, 18 nt, Artificial Sequence
  Description of Artificial Sequence: Synthetic oligonucleotide
gagaagcagaagagaaac

SEQ ID NO: 148874 - RNA, 18 nt, Artificial Sequence
  Description of Artificial Sequence: Synthetic oligonucleotide
uguaggagaagcagaaga

SEQ ID NO: 148875 - RNA, 18 nt, Artificial Sequence
  Description of Artificial Sequence: Synthetic oligonucleotide
cuugauguaggagaagca

SEQ ID NO: 148876 - RNA, 18 nt, Artificial Sequence
  Description of Artificial Sequence: Synthetic oligonucleotide
gcgagcuugauguaggag

SEQ ID NO: 148877 - RNA, 18 nt, Artificial Sequence
  Description of Artificial Sequence: Synthetic oligonucleotide
ugacugcgagcuugaugu

SEQ ID NO: 148878 - RNA, 18 nt, Artificial Sequence
  Description of Artificial Sequence: Synthetic oligonucleotide
cagcgugacugcgagcuu

SEQ ID NO: 148879 - RNA, 18 nt, Artificial Sequence
  Description of Artificial Sequence: Synthetic oligonucleotide
uugaccagcgugacugcg

SEQ ID NO: 148880 - RNA, 18 nt, Artificial Sequence
  Description of Artificial Sequence: Synthetic oligonucleotide
aauacuugaccagcguga

SEQ ID NO: 148881 - RNA, 18 nt, Artificial Sequence
  Description of Artificial Sequence: Synthetic oligonucleotide
uggaaaauacuugaccag

SEQ ID NO: 148882 - RNA, 18 nt, Artificial Sequence
  Description of Artificial Sequence: Synthetic oligonucleotide
ugugaacagggcccugga

SEQ ID NO: 148883 - RNA, 18 nt, Artificial Sequence
  Description of Artificial Sequence: Synthetic oligonucleotide
ggccaugugaacagggcc

SEQ ID NO: 148884 - RNA, 18 nt, Artificial Sequence
  Description of Artificial Sequence: Synthetic oligonucleotide
ccaccggccaugugaaca

SEQ ID NO: 148885 - RNA, 18 nt, Artificial Sequence
  Description of Artificial Sequence: Synthetic oligonucleotide
uccugccaccggccaugu

SEQ ID NO: 148886 - RNA, 18 nt, Artificial Sequence
  Description of Artificial Sequence: Synthetic oligonucleotide
accucuccugccaccggc

SEQ ID NO: 148887 - RNA, 18 nt, Artificial Sequence
  Description of Artificial Sequence: Synthetic oligonucleotide
cucucaccucuccugcca

SEQ ID NO: 148888 - RNA, 18 nt, Artificial Sequence
  Description of Artificial Sequence: Synthetic oligonucleotide
uguagcucucaccucucc

SEQ ID NO: 148889 - RNA, 18 nt, Artificial Sequence
  Description of Artificial Sequence: Synthetic oligonucleotide
ggccauguagcucucacc

SEQ ID NO: 148890 - RNA, 18 nt, Artificial Sequence
  Description of Artificial Sequence: Synthetic oligonucleotide
gccugggccauguagcuc

SEQ ID NO: 148891 - RNA, 18 nt, Artificial Sequence
  Description of Artificial Sequence: Synthetic oligonucleotide
gcagggccugggccaugu

SEQ ID NO: 148892 - RNA, 18 nt, Artificial Sequence
  Description of Artificial Sequence: Synthetic oligonucleotide
ccggagcagggccugggc

SEQ ID NO: 148893 - RNA, 18 nt, Artificial Sequence
  Description of Artificial Sequence: Synthetic oligonucleotide
ccccaccggagcagggcc

SEQ ID NO: 148894 - RNA, 18 nt, Artificial Sequence
  Description of Artificial Sequence: Synthetic oligonucleotide
agcugccccaccggagca

SEQ ID NO: 148895 - RNA, 18 nt, Artificial Sequence
  Description of Artificial Sequence: Synthetic oligonucleotide
gcaggagcugccccaccg

SEQ ID NO: 148896 - RNA, 18 nt, Artificial Sequence
  Description of Artificial Sequence: Synthetic oligonucleotide
cgccggcaggagcugccc

SEQ ID NO: 148897 - RNA, 18 nt, Artificial Sequence
  Description of Artificial Sequence: Synthetic oligonucleotide
ccucacgccggcaggagc

SEQ ID NO: 148898 - RNA, 18 nt, Artificial Sequence
  Description of Artificial Sequence: Synthetic oligonucleotide
uguuuccucacgccggca

SEQ ID NO: 148899 - RNA, 18 nt, Artificial Sequence
  Description of Artificial Sequence: Synthetic oligonucleotide
cguccuguuuccucacgc

SEQ ID NO: 148900 - RNA, 18 nt, Artificial Sequence
  Description of Artificial Sequence: Synthetic oligonucleotide
cuuuccguccuguuuccu

SEQ ID NO: 148901 - RNA, 18 nt, Artificial Sequence
  Description of Artificial Sequence: Synthetic oligonucleotide
uguggcuuuccguccugu

SEQ ID NO: 148902 - RNA, 18 nt, Artificial Sequence
  Description of Artificial Sequence: Synthetic oligonucleotide
cucccuguggcuuuccgu

SEQ ID NO: 148903 - RNA, 18 nt, Artificial Sequence
  Description of Artificial Sequence: Synthetic oligonucleotide
ccgggcucccuguggcuu

SEQ ID NO: 148904 - RNA, 18 nt, Artificial Sequence
  Description of Artificial Sequence: Synthetic oligonucleotide
ggcucccgggcucccugu

SEQ ID NO: 148905 - RNA, 18 nt, Artificial Sequence
  Description of Artificial Sequence: Synthetic oligonucleotide
cgcugggcucccgggcuc

SEQ ID NO: 148906 - RNA, 18 nt, Artificial Sequence
  Description of Artificial Sequence: Synthetic oligonucleotide
gcucccgcugggcucccg

SEQ ID NO: 148907 - RNA, 18 nt, Artificial Sequence
  Description of Artificial Sequence: Synthetic oligonucleotide
gccccgcucccgcugggc

SEQ ID NO: 148908 - RNA, 18 nt, Artificial Sequence
  Description of Artificial Sequence: Synthetic oligonucleotide
ccaccgccccgcucccgc

SEQ ID NO: 148909 - RNA, 18 nt, Artificial Sequence
  Description of Artificial Sequence: Synthetic oligonucleotide
ccuccccaccgccccgcu

SEQ ID NO: 148910 - RNA, 18 nt, Artificial Sequence
  Description of Artificial Sequence: Synthetic oligonucleotide
gcuggccuccccaccgcc

SEQ ID NO: 148911 - RNA, 18 nt, Artificial Sequence
  Description of Artificial Sequence: Synthetic oligonucleotide
ggcaggcuggccucccca

SEQ ID NO: 148912 - RNA, 18 nt, Artificial Sequence
  Description of Artificial Sequence: Synthetic oligonucleotide
agagcggcaggcuggccu

SEQ ID NO: 148913 - RNA, 18 nt, Artificial Sequence
  Description of Artificial Sequence: Synthetic oligonucleotide
gggaagagcggcaggcug

SEQ ID NO: 148914 - RNA, 18 nt, Artificial Sequence
  Description of Artificial Sequence: Synthetic oligonucleotide
ugugauuccagccccggg

SEQ ID NO: 148915 - RNA, 18 nt, Artificial Sequence
  Description of Artificial Sequence: Synthetic oligonucleotide
ucuccugugauuccagcc

SEQ ID NO: 148916 - RNA, 18 nt, Artificial Sequence
  Description of Artificial Sequence: Synthetic oligonucleotide
agcgaucuccugugauuc

SEQ ID NO: 148917 - RNA, 18 nt, Artificial Sequence
  Description of Artificial Sequence: Synthetic oligonucleotide
ccgcuagcgaucuccugu

SEQ ID NO: 148918 - RNA, 18 nt, Artificial Sequence
  Description of Artificial Sequence: Synthetic oligonucleotide
ggccuccgcuagcgaucu

SEQ ID NO: 148919 - RNA, 18 nt, Artificial Sequence
  Description of Artificial Sequence: Synthetic oligonucleotide
gggccuccgcuagcgauc

SEQ ID NO: 148920 - RNA, 18 nt, Artificial Sequence
  Description of Artificial Sequence: Synthetic oligonucleotide
cacaccugaugcuuaggg

SEQ ID NO: 148921 - RNA, 18 nt, Artificial Sequence
  Description of Artificial Sequence: Synthetic oligonucleotide
acccgcacaccugaugcu

SEQ ID NO: 148922 - RNA, 18 nt, Artificial Sequence
  Description of Artificial Sequence: Synthetic oligonucleotide
gaaccacccgcacaccug

SEQ ID NO: 148923 - RNA, 18 nt, Artificial Sequence
  Description of Artificial Sequence: Synthetic oligonucleotide
gggaaccacccgcacacc

SEQ ID NO: 148924 - RNA, 18 nt, Artificial Sequence
  Description of Artificial Sequence: Synthetic oligonucleotide
gcaucaggaaaggcuggg

SEQ ID NO: 148925 - RNA, 18 nt, Artificial Sequence
  Description of Artificial Sequence: Synthetic oligonucleotide
caaaggcaucaggaaagg

SEQ ID NO: 148926 - RNA, 18 nt, Artificial Sequence
  Description of Artificial Sequence: Synthetic oligonucleotide
agagccaaaggcaucagg

SEQ ID NO: 148927 - RNA, 18 nt, Artificial Sequence
  Description of Artificial Sequence: Synthetic oligonucleotide
agggcagagccaaaggca

SEQ ID NO: 148928 - RNA, 18 nt, Artificial Sequence
  Description of Artificial Sequence: Synthetic oligonucleotide
uggugagggcagagccaa

SEQ ID NO: 148929 - RNA, 18 nt, Artificial Sequence
  Description of Artificial Sequence: Synthetic oligonucleotide
ggcaguggugagggcaga

SEQ ID NO: 148930 - RNA, 18 nt, Artificial Sequence
  Description of Artificial Sequence: Synthetic oligonucleotide
auggaggcaguggugagg

SEQ ID NO: 148931 - RNA, 18 nt, Artificial Sequence
  Description of Artificial Sequence: Synthetic oligonucleotide
uggaaauggaggcagugg

SEQ ID NO: 148932 - RNA, 18 nt, Artificial Sequence
  Description of Artificial Sequence: Synthetic oligonucleotide
ugcuguggaaauggaggc

SEQ ID NO: 148933 - RNA, 18 nt, Artificial Sequence
  Description of Artificial Sequence: Synthetic oligonucleotide
uguccugcuguggaaaug

SEQ ID NO: 148934 - RNA, 18 nt, Artificial Sequence
  Description of Artificial Sequence: Synthetic oligonucleotide
cagaguguccugcugugg

SEQ ID NO: 148935 - RNA, 18 nt, Artificial Sequence
  Description of Artificial Sequence: Synthetic oligonucleotide
cucuccagaguguccugc

SEQ ID NO: 148936 - RNA, 18 nt, Artificial Sequence
  Description of Artificial Sequence: Synthetic oligonucleotide
cucaccucuccagagugu

SEQ ID NO: 148937 - RNA, 18 nt, Artificial Sequence
  Description of Artificial Sequence: Synthetic oligonucleotide
cccaccucaccucuccag

SEQ ID NO: 148938 - RNA, 18 nt, Artificial Sequence
  Description of Artificial Sequence: Synthetic oligonucleotide
cuccucccaccucaccuc

SEQ ID NO: 148939 - RNA, 18 nt, Artificial Sequence
  Description of Artificial Sequence: Synthetic oligonucleotide
gcucccuccucccaccuc

SEQ ID NO: 148940 - RNA, 18 nt, Artificial Sequence
  Description of Artificial Sequence: Synthetic oligonucleotide
gggcucccuccucccacc

SEQ ID NO: 148941 - RNA, 18 nt, Artificial Sequence
  Description of Artificial Sequence: Synthetic oligonucleotide
agcucugcgcgggaaggg

SEQ ID NO: 148942 - RNA, 18 nt, Artificial Sequence
  Description of Artificial Sequence: Synthetic oligonucleotide
ggcugagcucugcgcggg

SEQ ID NO: 148943 - RNA, 18 nt, Artificial Sequence
  Description of Artificial Sequence: Synthetic oligonucleotide
ggacgggcugagcucugc

SEQ ID NO: 148944 - RNA, 18 nt, Artificial Sequence
  Description of Artificial Sequence: Synthetic oligonucleotide
ucauaggacgggcugagc

SEQ ID NO: 148945 - RNA, 18 nt, Artificial Sequence
  Description of Artificial Sequence: Synthetic oligonucleotide
uaugcucauaggacgggc

SEQ ID NO: 148946 - RNA, 18 nt, Artificial Sequence
  Description of Artificial Sequence: Synthetic oligonucleotide
ccggcuaugcucauagga

SEQ ID NO: 148947 - RNA, 18 nt, Artificial Sequence
  Description of Artificial Sequence: Synthetic oligonucleotide
gaggaccggcuaugcuca

SEQ ID NO: 148948 - RNA, 18 nt, Artificial Sequence
  Description of Artificial Sequence: Synthetic oligonucleotide
cugaagaggaccggcuau

SEQ ID NO: 148949 - RNA, 18 nt, Artificial Sequence
  Description of Artificial Sequence: Synthetic oligonucleotide
cggaucugaagaggaccg

SEQ ID NO: 148950 - RNA, 18 nt, Artificial Sequence
  Description of Artificial Sequence: Synthetic oligonucleotide
guccccggaucugaagag

SEQ ID NO: 148951 - RNA, 18 nt, Artificial Sequence
  Description of Artificial Sequence: Synthetic oligonucleotide
ccugaguccccggaucug

SEQ ID NO: 148952 - RNA, 18 nt, Artificial Sequence
  Description of Artificial Sequence: Synthetic oligonucleotide
uggacccugaguccccgg

SEQ ID NO: 148953 - RNA, 18 nt, Artificial Sequence
  Description of Artificial Sequence: Synthetic oligonucleotide
ugugcuggacccugaguc

SEQ ID NO: 148954 - RNA, 18 nt, Artificial Sequence
  Description of Artificial Sequence: Synthetic oligonucleotide
caagaugugcuggacccu

SEQ ID NO: 148955 - RNA, 18 nt, Artificial Sequence
  Description of Artificial Sequence: Synthetic oligonucleotide
gggcaagaugugcuggac

SEQ ID NO: 148956 - RNA, 18 nt, Artificial Sequence
  Description of Artificial Sequence: Synthetic oligonucleotide
ccugucccaggcuguggg

SEQ ID NO: 148957 - RNA, 18 nt, Artificial Sequence
  Description of Artificial Sequence: Synthetic oligonucleotide
cugacccugucccaggcu

SEQ ID NO: 148958 - RNA, 18 nt, Artificial Sequence
  Description of Artificial Sequence: Synthetic oligonucleotide
cagcccugacccuguccc

SEQ ID NO: 148959 - RNA, 18 nt, Artificial Sequence
  Description of Artificial Sequence: Synthetic oligonucleotide
aacuucagcccugacccu

SEQ ID NO: 148960 - RNA, 18 nt, Artificial Sequence
  Description of Artificial Sequence: Synthetic oligonucleotide
gcagcaacuucagcccug

SEQ ID NO: 148961 - RNA, 18 nt, Artificial Sequence
  Description of Artificial Sequence: Synthetic oligonucleotide
cgggugcagcaacuucag

SEQ ID NO: 148962 - RNA, 18 nt, Artificial Sequence
  Description of Artificial Sequence: Synthetic oligonucleotide
guccccgggugcagcaac

SEQ ID NO: 148963 - RNA, 18 nt, Artificial Sequence
  Description of Artificial Sequence: Synthetic oligonucleotide
ccuagguccccgggugca

SEQ ID NO: 148964 - RNA, 18 nt, Artificial Sequence
  Description of Artificial Sequence: Synthetic oligonucleotide
gaggcccuagguccccgg

SEQ ID NO: 148965 - RNA, 18 nt, Artificial Sequence
  Description of Artificial Sequence: Synthetic oligonucleotide
uaaaugaggcccuagguc

SEQ ID NO: 148966 - RNA, 18 nt, Artificial Sequence
  Description of Artificial Sequence: Synthetic oligonucleotide
ugaguuaaaugaggcccu

SEQ ID NO: 148967 - RNA, 18 nt, Artificial Sequence
  Description of Artificial Sequence: Synthetic oligonucleotide
ccccgucuguagagcggg

SEQ ID NO: 148968 - RNA, 18 nt, Artificial Sequence
  Description of Artificial Sequence: Synthetic oligonucleotide
uuccccgucuguagagcg

SEQ ID NO: 148969 - RNA, 18 nt, Artificial Sequence
  Description of Artificial Sequence: Synthetic oligonucleotide
uugguuuccccgucugua

SEQ ID NO: 148970 - RNA, 18 nt, Artificial Sequence
  Description of Artificial Sequence: Synthetic oligonucleotide
uagccuugguuuccccgu

SEQ ID NO: 148971 - RNA, 18 nt, Artificial Sequence
  Description of Artificial Sequence: Synthetic oligonucleotide
ucuccuagccuugguuuc

SEQ ID NO: 148972 - RNA, 18 nt, Artificial Sequence
  Description of Artificial Sequence: Synthetic oligonucleotide
acaguucuccuagccuug

SEQ ID NO: 148973 - RNA, 18 nt, Artificial Sequence
  Description of Artificial Sequence: Synthetic oligonucleotide
aagugacaguucuccuag

SEQ ID NO: 148974 - RNA, 18 nt, Artificial Sequence
  Description of Artificial Sequence: Synthetic oligonucleotide
ugggcaagugacaguucu

SEQ ID NO: 148975 - RNA, 18 nt, Artificial Sequence
  Description of Artificial Sequence: Synthetic oligonucleotide
ugucuugggcaagugaca

SEQ ID NO: 148976 - RNA, 18 nt, Artificial Sequence
  Description of Artificial Sequence: Synthetic oligonucleotide
ccugcugucuugggcaag

SEQ ID NO: 148977 - RNA, 18 nt, Artificial Sequence
  Description of Artificial Sequence: Synthetic oligonucleotide
cggagccugcugucuugg

SEQ ID NO: 148978 - RNA, 18 nt, Artificial Sequence
  Description of Artificial Sequence: Synthetic oligonucleotide
aucaccggagccugcugu

SEQ ID NO: 148979 - RNA, 18 nt, Artificial Sequence
  Description of Artificial Sequence: Synthetic oligonucleotide
gcuccaucaccggagccu

SEQ ID NO: 148980 - RNA, 18 nt, Artificial Sequence
  Description of Artificial Sequence: Synthetic oligonucleotide
uccuggcuccaucaccgg

SEQ ID NO: 148981 - RNA, 18 nt, Artificial Sequence
  Description of Artificial Sequence: Synthetic oligonucleotide
uggaauccuggcuccauc

SEQ ID NO: 148982 - RNA, 18 nt, Artificial Sequence
  Description of Artificial Sequence: Synthetic oligonucleotide
ugguuuggaauccuggcu

SEQ ID NO: 148983 - RNA, 18 nt, Artificial Sequence
  Description of Artificial Sequence: Synthetic oligonucleotide
acuucugguuuggaaucc

SEQ ID NO: 148984 - RNA, 18 nt, Artificial Sequence
  Description of Artificial Sequence: Synthetic oligonucleotide
gugggacuucugguuugg

SEQ ID NO: 148985 - RNA, 18 nt, Artificial Sequence
  Description of Artificial Sequence: Synthetic oligonucleotide
ugggagugggacuucugg

SEQ ID NO: 148986 - RNA, 18 nt, Artificial Sequence
  Description of Artificial Sequence: Synthetic oligonucleotide
acuggugggagugggacu

SEQ ID NO: 148987 - RNA, 18 nt, Artificial Sequence
  Description of Artificial Sequence: Synthetic oligonucleotide
uagggacuggugggagug

SEQ ID NO: 148988 - RNA, 18 nt, Artificial Sequence
  Description of Artificial Sequence: Synthetic oligonucleotide
gugcuuagggacuggugg

SEQ ID NO: 148989 - RNA, 18 nt, Artificial Sequence
  Description of Artificial Sequence: Synthetic oligonucleotide
uucaugugcuuagggacu

SEQ ID NO: 148990 - RNA, 18 nt, Artificial Sequence
  Description of Artificial Sequence: Synthetic oligonucleotide
uggacuucaugugcuuag

SEQ ID NO: 148991 - RNA, 18 nt, Artificial Sequence
  Description of Artificial Sequence: Synthetic oligonucleotide
cagccuggacuucaugug

SEQ ID NO: 148992 - RNA, 18 nt, Artificial Sequence
  Description of Artificial Sequence: Synthetic oligonucleotide
aaacucagccuggacuuc

SEQ ID NO: 148993 - RNA, 18 nt, Artificial Sequence
  Description of Artificial Sequence: Synthetic oligonucleotide
uccccaaacucagccugg

SEQ ID NO: 148994 - RNA, 18 nt, Artificial Sequence
  Description of Artificial Sequence: Synthetic oligonucleotide
ggcuguccccaaacucag

SEQ ID NO: 148995 - RNA, 18 nt, Artificial Sequence
  Description of Artificial Sequence: Synthetic oligonucleotide
ggcaaggcuguccccaaa

SEQ ID NO: 148996 - RNA, 18 nt, Artificial Sequence
  Description of Artificial Sequence: Synthetic oligonucleotide
cuccaggcaaggcugucc

SEQ ID NO: 148997 - RNA, 18 nt, Artificial Sequence
  Description of Artificial Sequence: Synthetic oligonucleotide
cucaccuccaggcaaggc

SEQ ID NO: 148998 - RNA, 18 nt, Artificial Sequence
  Description of Artificial Sequence: Synthetic oligonucleotide
uucuucucaccuccaggc

SEQ ID NO: 148999 - RNA, 18 nt, Artificial Sequence
  Description of Artificial Sequence: Synthetic oligonucleotide
gauucuucuucucaccuc

SEQ ID NO: 149000 - RNA, 18 nt, Artificial Sequence
  Description of Artificial Sequence: Synthetic oligonucleotide
gcuaugauucuucuucuc

SEQ ID NO: 149001 - RNA, 18 nt, Artificial Sequence
  Description of Artificial Sequence: Synthetic oligonucleotide
cuguagcuaugauucuuc

SEQ ID NO: 149002 - RNA, 18 nt, Artificial Sequence
  Description of Artificial Sequence: Synthetic oligonucleotide
uuucccuguagcuaugau

SEQ ID NO: 149003 - RNA, 18 nt, Artificial Sequence
  Description of Artificial Sequence: Synthetic oligonucleotide
gcuaguuucccuguagcu

SEQ ID NO: 149004 - RNA, 18 nt, Artificial Sequence
  Description of Artificial Sequence: Synthetic oligonucleotide
ccugugcuaguuucccug

SEQ ID NO: 149005 - RNA, 18 nt, Artificial Sequence
  Description of Artificial Sequence: Synthetic oligonucleotide
aaggcccugugcuaguuu

SEQ ID NO: 149006 - RNA, 18 nt, Artificial Sequence
  Description of Artificial Sequence: Synthetic oligonucleotide
gggccaaggcccugugcu

SEQ ID NO: 149007 - RNA, 18 nt, Artificial Sequence
  Description of Artificial Sequence: Synthetic oligonucleotide
cuccuccacaucccuggg

SEQ ID NO: 149008 - RNA, 18 nt, Artificial Sequence
  Description of Artificial Sequence: Synthetic oligonucleotide
gucuccuccacaucccug

SEQ ID NO: 149009 - RNA, 18 nt, Artificial Sequence
  Description of Artificial Sequence: Synthetic oligonucleotide
uccccgucuccuccacau

SEQ ID NO: 149010 - RNA, 18 nt, Artificial Sequence
  Description of Artificial Sequence: Synthetic oligonucleotide
ggccuuccccgucuccuc

SEQ ID NO: 149011 - RNA, 18 nt, Artificial Sequence
  Description of Artificial Sequence: Synthetic oligonucleotide
gaugcggccuuccccguc

SEQ ID NO: 149012 - RNA, 18 nt, Artificial Sequence
  Description of Artificial Sequence: Synthetic oligonucleotide
gggccgaugcggccuucc

SEQ ID NO: 149013 - RNA, 18 nt, Artificial Sequence
  Description of Artificial Sequence: Synthetic oligonucleotide
agcuccagcagaggcggg

SEQ ID NO: 149014 - RNA, 18 nt, Artificial Sequence
  Description of Artificial Sequence: Synthetic oligonucleotide
ucacagcuccagcagagg

SEQ ID NO: 149015 - RNA, 18 nt, Artificial Sequence
  Description of Artificial Sequence: Synthetic oligonucleotide
acaccucacagcuccagc

SEQ ID NO: 149016 - RNA, 18 nt, Artificial Sequence
  Description of Artificial Sequence: Synthetic oligonucleotide
cccccacaccucacagcu

SEQ ID NO: 149017 - RNA, 18 nt, Artificial Sequence
  Description of Artificial Sequence: Synthetic oligonucleotide
cgcaccccccacaccuca

SEQ ID NO: 149018 - RNA, 18 nt, Artificial Sequence
  Description of Artificial Sequence: Synthetic oligonucleotide
ggccccgcaccccccaca

SEQ ID NO: 149019 - RNA, 18 nt, Artificial Sequence
  Description of Artificial Sequence: Synthetic oligonucleotide
gcaaaggccccgcacccc

SEQ ID NO: 149020 - RNA, 18 nt, Artificial Sequence
  Description of Artificial Sequence: Synthetic oligonucleotide
agcaagcaaaggccccgc

SEQ ID NO: 149021 - RNA, 18 nt, Artificial Sequence
  Description of Artificial Sequence: Synthetic oligonucleotide
uguacagcaagcaaaggc

SEQ ID NO: 149022 - RNA, 18 nt, Artificial Sequence
  Description of Artificial Sequence: Synthetic oligonucleotide
cugcauguacagcaagca

SEQ ID NO: 149023 - RNA, 18 nt, Artificial Sequence
  Description of Artificial Sequence: Synthetic oligonucleotide
cucaucugcauguacagc

SEQ ID NO: 149024 - RNA, 18 nt, Artificial Sequence
  Description of Artificial Sequence: Synthetic oligonucleotide
ggcgucucaucugcaugu

SEQ ID NO: 149025 - RNA, 18 nt, Artificial Sequence
  Description of Artificial Sequence: Synthetic oligonucleotide
ggguaggcgucucaucug

SEQ ID NO: 149026 - RNA, 18 nt, Artificial Sequence
  Description of Artificial Sequence: Synthetic oligonucleotide
aguuugggugguccuggg

SEQ ID NO: 149027 - RNA, 18 nt, Artificial Sequence
  Description of Artificial Sequence: Synthetic oligonucleotide
gaacaguuuggguggucc

SEQ ID NO: 149028 - RNA, 18 nt, Artificial Sequence
  Description of Artificial Sequence: Synthetic oligonucleotide
ccaaggaacaguuugggu

SEQ ID NO: 149029 - RNA, 18 nt, Artificial Sequence
  Description of Artificial Sequence: Synthetic oligonucleotide
cucagccaaggaacaguu

SEQ ID NO: 149030 - RNA, 18 nt, Artificial Sequence
  Description of Artificial Sequence: Synthetic oligonucleotide
caggccucagccaaggaa

SEQ ID NO: 149031 - RNA, 18 nt, Artificial Sequence
  Description of Artificial Sequence: Synthetic oligonucleotide
uaugacaggccucagcca

SEQ ID NO: 149032 - RNA, 18 nt, Artificial Sequence
  Description of Artificial Sequence: Synthetic oligonucleotide
ugggcuaugacaggccuc

SEQ ID NO: 149033 - RNA, 18 nt, Artificial Sequence
  Description of Artificial Sequence: Synthetic oligonucleotide
accuuugggcuaugacag

SEQ ID NO: 149034 - RNA, 18 nt, Artificial Sequence
  Description of Artificial Sequence: Synthetic oligonucleotide
cggugaccuuugggcuau

SEQ ID NO: 149035 - RNA, 18 nt, Artificial Sequence
  Description of Artificial Sequence: Synthetic oligonucleotide
ggacacggugaccuuugg

SEQ ID NO: 149036 - RNA, 18 nt, Artificial Sequence
  Description of Artificial Sequence: Synthetic oligonucleotide
uccaaggacacggugacc

SEQ ID NO: 149037 - RNA, 18 nt, Artificial Sequence
  Description of Artificial Sequence: Synthetic oligonucleotide
uuggcuccaaggacacgg

SEQ ID NO: 149038 - RNA, 18 nt, Artificial Sequence
  Description of Artificial Sequence: Synthetic oligonucleotide
gggccuuggcuccaagga

SEQ ID NO: 149039 - RNA, 18 nt, Artificial Sequence
  Description of Artificial Sequence: Synthetic oligonucleotide
cucauuccucccacuggg

SEQ ID NO: 149040 - RNA, 18 nt, Artificial Sequence
  Description of Artificial Sequence: Synthetic oligonucleotide
gguucucauuccucccac

SEQ ID NO: 149041 - RNA, 18 nt, Artificial Sequence
  Description of Artificial Sequence: Synthetic oligonucleotide
aaagcgguucucauuccu

SEQ ID NO: 149042 - RNA, 18 nt, Artificial Sequence
  Description of Artificial Sequence: Synthetic oligonucleotide
aaacaaaagcgguucuca

SEQ ID NO: 149043 - RNA, 18 nt, Artificial Sequence
  Description of Artificial Sequence: Synthetic oligonucleotide
ccuccaaacaaaagcggu

SEQ ID NO: 149044 - RNA, 18 nt, Artificial Sequence
  Description of Artificial Sequence: Synthetic oligonucleotide
cugccccuccaaacaaaa

SEQ ID NO: 149045 - RNA, 18 nt, Artificial Sequence
  Description of Artificial Sequence: Synthetic oligonucleotide
cgugacugccccuccaaa

SEQ ID NO: 149046 - RNA, 18 nt, Artificial Sequence
  Description of Artificial Sequence: Synthetic oligonucleotide
cgccucgugacugccccu

SEQ ID NO: 149047 - RNA, 18 nt, Artificial Sequence
  Description of Artificial Sequence: Synthetic oligonucleotide
ucaugcgccucgugacug

SEQ ID NO: 149048 - RNA, 18 nt, Artificial Sequence
  Description of Artificial Sequence: Synthetic oligonucleotide
cugccucaugcgccucgu

SEQ ID NO: 149049 - RNA, 18 nt, Artificial Sequence
  Description of Artificial Sequence: Synthetic oligonucleotide
ggcggcugccucaugcgc

SEQ ID NO: 149050 - RNA, 18 nt, Artificial Sequence
  Description of Artificial Sequence: Synthetic oligonucleotide
ggcugggcggcugccuca

SEQ ID NO: 149051 - RNA, 18 nt, Artificial Sequence
  Description of Artificial Sequence: Synthetic oligonucleotide
gugagggcugggcggcug

SEQ ID NO: 149052 - RNA, 18 nt, Artificial Sequence
  Description of Artificial Sequence: Synthetic oligonucleotide
gggcggugagggcugggc

SEQ ID NO: 149053 - RNA, 18 nt, Artificial Sequence
  Description of Artificial Sequence: Synthetic oligonucleotide
acggagggcggugagggc

SEQ ID NO: 149054 - RNA, 18 nt, Artificial Sequence
  Description of Artificial Sequence: Synthetic oligonucleotide
gacagacggagggcggug

SEQ ID NO: 149055 - RNA, 18 nt, Artificial Sequence
  Description of Artificial Sequence: Synthetic oligonucleotide
ggacagacagacggaggg

SEQ ID NO: 149056 - RNA, 18 nt, Artificial Sequence
  Description of Artificial Sequence: Synthetic oligonucleotide
aguaaaaguucauguagg

SEQ ID NO: 149057 - RNA, 18 nt, Artificial Sequence
  Description of Artificial Sequence: Synthetic oligonucleotide
uuuguaguaaaaguucau

SEQ ID NO: 149058 - RNA, 18 nt, Artificial Sequence
  Description of Artificial Sequence: Synthetic oligonucleotide
gugcuuuuguaguaaaag

SEQ ID NO: 149059 - RNA, 18 nt, Artificial Sequence
  Description of Artificial Sequence: Synthetic oligonucleotide
ccucagugcuuuuguagu

SEQ ID NO: 149060 - RNA, 18 nt, Artificial Sequence
  Description of Artificial Sequence: Synthetic oligonucleotide
ccagcccucagugcuuuu

SEQ ID NO: 149061 - RNA, 18 nt, Artificial Sequence
  Description of Artificial Sequence: Synthetic oligonucleotide
augcuccagcccucagug

SEQ ID NO: 149062 - RNA, 18 nt, Artificial Sequence
  Description of Artificial Sequence: Synthetic oligonucleotide
ugccaaugcuccagcccu

SEQ ID NO: 149063 - RNA, 18 nt, Artificial Sequence
  Description of Artificial Sequence: Synthetic oligonucleotide
cacguugccaaugcucca

SEQ ID NO: 149064 - RNA, 18 nt, Artificial Sequence
  Description of Artificial Sequence: Synthetic oligonucleotide
aggagcacguugccaaug

SEQ ID NO: 149065 - RNA, 18 nt, Artificial Sequence
  Description of Artificial Sequence: Synthetic oligonucleotide
aguccaggagcacguugc

SEQ ID NO: 149066 - RNA, 18 nt, Artificial Sequence
  Description of Artificial Sequence: Synthetic oligonucleotide
ggugaaguccaggagcac

SEQ ID NO: 149067 - RNA, 18 nt, Artificial Sequence
  Description of Artificial Sequence: Synthetic oligonucleotide
cccccggugaaguccagg

SEQ ID NO: 149068 - RNA, 18 nt, Artificial Sequence
  Description of Artificial Sequence: Synthetic oligonucleotide
agcugcccccggugaagu

SEQ ID NO: 149069 - RNA, 18 nt, Artificial Sequence
  Description of Artificial Sequence: Synthetic oligonucleotide
gcugaagcugcccccggu

SEQ ID NO: 149070 - RNA, 18 nt, Artificial Sequence
  Description of Artificial Sequence: Synthetic oligonucleotide
aggaggcugaagcugccc

SEQ ID NO: 149071 - RNA, 18 nt, Artificial Sequence
  Description of Artificial Sequence: Synthetic oligonucleotide
ucugcaggaggcugaagc

SEQ ID NO: 149072 - RNA, 18 nt, Artificial Sequence
  Description of Artificial Sequence: Synthetic oligonucleotide
gaacaucugcaggaggcu

SEQ ID NO: 149073 - RNA, 18 nt, Artificial Sequence
  Description of Artificial Sequence: Synthetic oligonucleotide
uggaggaacaucugcagg

SEQ ID NO: 149074 - RNA, 18 nt, Artificial Sequence
  Description of Artificial Sequence: Synthetic oligonucleotide
aggacuggaggaacaucu

SEQ ID NO: 149075 - RNA, 18 nt, Artificial Sequence
  Description of Artificial Sequence: Synthetic oligonucleotide
guuguaggacuggaggaa

SEQ ID NO: 149076 - RNA, 18 nt, Artificial Sequence
  Description of Artificial Sequence: Synthetic oligonucleotide
uuugaggagaaacugcuc

SEQ ID NO: 149077 - RNA, 18 nt, Artificial Sequence
  Description of Artificial Sequence: Synthetic oligonucleotide
ggguauuugaggagaaac

SEQ ID NO: 149078 - RNA, 18 nt, Artificial Sequence
  Description of Artificial Sequence: Synthetic oligonucleotide
gucguugcuguucacggg

SEQ ID NO: 149079 - RNA, 18 nt, Artificial Sequence
  Description of Artificial Sequence: Synthetic oligonucleotide
gacgucguugcuguucac

SEQ ID NO: 149080 - RNA, 18 nt, Artificial Sequence
  Description of Artificial Sequence: Synthetic oligonucleotide
aagaagacgucguugcug

SEQ ID NO: 149081 - RNA, 18 nt, Artificial Sequence
  Description of Artificial Sequence: Synthetic oligonucleotide
ggcugaagaagacgucgu

SEQ ID NO: 149082 - RNA, 18 nt, Artificial Sequence
  Description of Artificial Sequence: Synthetic oligonucleotide
gugcaggcugaagaagac

SEQ ID NO: 149083 - RNA, 18 nt, Artificial Sequence
  Description of Artificial Sequence: Synthetic oligonucleotide
accgcgugcaggcugaag

SEQ ID NO: 149084 - RNA, 18 nt, Artificial Sequence
  Description of Artificial Sequence: Synthetic oligonucleotide
ggacaaccgcgugcaggc

SEQ ID NO: 149085 - RNA, 18 nt, Artificial Sequence
  Description of Artificial Sequence: Synthetic oligonucleotide
cgugaggacaaccgcgug

SEQ ID NO: 149086 - RNA, 18 nt, Artificial Sequence
  Description of Artificial Sequence: Synthetic oligonucleotide
aucagcgugaggacaacc

SEQ ID NO: 149087 - RNA, 18 nt, Artificial Sequence
  Description of Artificial Sequence: Synthetic oligonucleotide
ugaugaucagcgugagga

SEQ ID NO: 149088 - RNA, 18 nt, Artificial Sequence
  Description of Artificial Sequence: Synthetic oligonucleotide
cacgaugaugaucagcgu

SEQ ID NO: 149089 - RNA, 18 nt, Artificial Sequence
  Description of Artificial Sequence: Synthetic oligonucleotide
cacugcacgaugaugauc

SEQ ID NO: 149090 - RNA, 18 nt, Artificial Sequence
  Description of Artificial Sequence: Synthetic oligonucleotide
ggcagcacugcacgauga

SEQ ID NO: 149091 - RNA, 18 nt, Artificial Sequence
  Description of Artificial Sequence: Synthetic oligonucleotide
auacaggcagcacugcac

SEQ ID NO: 149092 - RNA, 18 nt, Artificial Sequence
  Description of Artificial Sequence: Synthetic oligonucleotide
gggccagggcuggucuca

SEQ ID NO: 149093 - RNA, 18 nt, Artificial Sequence
  Description of Artificial Sequence: Synthetic oligonucleotide
uggcggguguuggcuggg

SEQ ID NO: 149094 - RNA, 18 nt, Artificial Sequence
  Description of Artificial Sequence: Synthetic oligonucleotide
ggguggcggguguuggcu

SEQ ID NO: 149095 - RNA, 18 nt, Artificial Sequence
  Description of Artificial Sequence: Synthetic oligonucleotide
ugucaaaggugagguggg

SEQ ID NO: 149096 - RNA, 18 nt, Artificial Sequence
  Description of Artificial Sequence: Synthetic oligonucleotide
ucuucugucaaaggugag

SEQ ID NO: 149097 - RNA, 18 nt, Artificial Sequence
  Description of Artificial Sequence: Synthetic oligonucleotide
ccgugucuucugucaaag

SEQ ID NO: 149098 - RNA, 18 nt, Artificial Sequence
  Description of Artificial Sequence: Synthetic oligonucleotide
cucugccgugucuucugu

SEQ ID NO: 149099 - RNA, 18 nt, Artificial Sequence
  Description of Artificial Sequence: Synthetic oligonucleotide
ccaggcucugccgugucu

SEQ ID NO: 149100 - RNA, 18 nt, Artificial Sequence
  Description of Artificial Sequence: Synthetic oligonucleotide
cuuucccaggcucugccg

SEQ ID NO: 149101 - RNA, 18 nt, Artificial Sequence
  Description of Artificial Sequence: Synthetic oligonucleotide
ccuuccuuucccaggcuc

SEQ ID NO: 149102 - RNA, 18 nt, Artificial Sequence
  Description of Artificial Sequence: Synthetic oligonucleotide
cacacccuuccuuuccca

SEQ ID NO: 149103 - RNA, 18 nt, Artificial Sequence
  Description of Artificial Sequence: Synthetic oligonucleotide
gaacacacacccuuccuu

SEQ ID NO: 149104 - RNA, 18 nt, Artificial Sequence
  Description of Artificial Sequence: Synthetic oligonucleotide
ugaaugaacacacacccu

SEQ ID NO: 149105 - RNA, 18 nt, Artificial Sequence
  Description of Artificial Sequence: Synthetic oligonucleotide
cuggaugaaugaacacac

SEQ ID NO: 149106 - RNA, 18 nt, Artificial Sequence
  Description of Artificial Sequence: Synthetic oligonucleotide
aggaccuggaugaaugaa

SEQ ID NO: 149107 - RNA, 18 nt, Artificial Sequence
  Description of Artificial Sequence: Synthetic oligonucleotide
agcacaggaccuggauga

SEQ ID NO: 149108 - RNA, 18 nt, Artificial Sequence
  Description of Artificial Sequence: Synthetic oligonucleotide
ugcccagcacaggaccug

SEQ ID NO: 149109 - RNA, 18 nt, Artificial Sequence
  Description of Artificial Sequence: Synthetic oligonucleotide
uucuaugcccagcacagg

SEQ ID NO: 149110 - RNA, 18 nt, Artificial Sequence
  Description of Artificial Sequence: Synthetic oligonucleotide
gugucuucuaugcccagc

SEQ ID NO: 149111 - RNA, 18 nt, Artificial Sequence
  Description of Artificial Sequence: Synthetic oligonucleotide
caugggugucuucuaugc

SEQ ID NO: 149112 - RNA, 18 nt, Artificial Sequence
  Description of Artificial Sequence: Synthetic oligonucleotide
ggacucaugggugucuuc

SEQ ID NO: 149113 - RNA, 18 nt, Artificial Sequence
  Description of Artificial Sequence: Synthetic oligonucleotide
ggccuggacucaugggug

SEQ ID NO: 149114 - RNA, 18 nt, Artificial Sequence
  Description of Artificial Sequence: Synthetic oligonucleotide
cugagggccuggacucau

SEQ ID NO: 149115 - RNA, 18 nt, Artificial Sequence
  Description of Artificial Sequence: Synthetic oligonucleotide
gggcucugagggccugga

SEQ ID NO: 149116 - RNA, 18 nt, Artificial Sequence
  Description of Artificial Sequence: Synthetic oligonucleotide
ucccucaccccagacuug

SEQ ID NO: 149117 - RNA, 18 nt, Artificial Sequence
  Description of Artificial Sequence: Synthetic oligonucleotide
cugagucccucaccccag

SEQ ID NO: 149118 - RNA, 18 nt, Artificial Sequence
  Description of Artificial Sequence: Synthetic oligonucleotide
ucucccugagucccucac

SEQ ID NO: 149119 - RNA, 18 nt, Artificial Sequence
  Description of Artificial Sequence: Synthetic oligonucleotide
cugccucucccugagucc

SEQ ID NO: 149120 - RNA, 18 nt, Artificial Sequence
  Description of Artificial Sequence: Synthetic oligonucleotide
aggcacugccucucccug

SEQ ID NO: 149121 - RNA, 18 nt, Artificial Sequence
  Description of Artificial Sequence: Synthetic oligonucleotide
aguccaggcacugccucu

SEQ ID NO: 149122 - RNA, 18 nt, Artificial Sequence
  Description of Artificial Sequence: Synthetic oligonucleotide
gccugaguccaggcacug

SEQ ID NO: 149123 - RNA, 18 nt, Artificial Sequence
  Description of Artificial Sequence: Synthetic oligonucleotide
ucucagccugaguccagg

SEQ ID NO: 149124 - RNA, 18 nt, Artificial Sequence
  Description of Artificial Sequence: Synthetic oligonucleotide
acggcucucagccugagu

SEQ ID NO: 149125 - RNA, 18 nt, Artificial Sequence
  Description of Artificial Sequence: Synthetic oligonucleotide
ugugcacggcucucagcc

SEQ ID NO: 149126 - RNA, 18 nt, Artificial Sequence
  Description of Artificial Sequence: Synthetic oligonucleotide
uccucugugcacggcucu

SEQ ID NO: 149127 - RNA, 18 nt, Artificial Sequence
  Description of Artificial Sequence: Synthetic oligonucleotide
ugugcuccucugugcacg

SEQ ID NO: 149128 - RNA, 18 nt, Artificial Sequence
  Description of Artificial Sequence: Synthetic oligonucleotide
cugucugugcuccucugu

SEQ ID NO: 149129 - RNA, 18 nt, Artificial Sequence
  Description of Artificial Sequence: Synthetic oligonucleotide
augagcugucugugcucc

SEQ ID NO: 149130 - RNA, 18 nt, Artificial Sequence
  Description of Artificial Sequence: Synthetic oligonucleotide
ccuccaugagcugucugu

SEQ ID NO: 149131 - RNA, 18 nt, Artificial Sequence
  Description of Artificial Sequence: Synthetic oligonucleotide
gcacuccuccaugagcug

SEQ ID NO: 149132 - RNA, 18 nt, Artificial Sequence
  Description of Artificial Sequence: Synthetic oligonucleotide
gccuugcacuccuccaug

SEQ ID NO: 149133 - RNA, 18 nt, Artificial Sequence
  Description of Artificial Sequence: Synthetic oligonucleotide
ucagggccuugcacuccu

SEQ ID NO: 149134 - RNA, 18 nt, Artificial Sequence
  Description of Artificial Sequence: Synthetic oligonucleotide
agggcucagggccuugca

SEQ ID NO: 149135 - RNA, 18 nt, Artificial Sequence
  Description of Artificial Sequence: Synthetic oligonucleotide
cuggcagggcucagggcc

SEQ ID NO: 149136 - RNA, 18 nt, Artificial Sequence
  Description of Artificial Sequence: Synthetic oligonucleotide
ccucccuggcagggcuca

SEQ ID NO: 149137 - RNA, 18 nt, Artificial Sequence
  Description of Artificial Sequence: Synthetic oligonucleotide
ucccuccucccuggcagg

SEQ ID NO: 149138 - RNA, 18 nt, Artificial Sequence
  Description of Artificial Sequence: Synthetic oligonucleotide
ccuccucccuccucccug

SEQ ID NO: 149139 - RNA, 18 nt, Artificial Sequence
  Description of Artificial Sequence: Synthetic oligonucleotide
ugugcccuccucccuccu

SEQ ID NO: 149140 - RNA, 18 nt, Artificial Sequence
  Description of Artificial Sequence: Synthetic oligonucleotide
ccuucugugcccuccucc

SEQ ID NO: 149141 - RNA, 18 nt, Artificial Sequence
  Description of Artificial Sequence: Synthetic oligonucleotide
uccucccuucugugcccu

SEQ ID NO: 149142 - RNA, 18 nt, Artificial Sequence
  Description of Artificial Sequence: Synthetic oligonucleotide
cucccuccucccuucugu

SEQ ID NO: 149143 - RNA, 18 nt, Artificial Sequence
  Description of Artificial Sequence: Synthetic oligonucleotide
cccuccucccuccucccu

SEQ ID NO: 149144 - RNA, 18 nt, Artificial Sequence
  Description of Artificial Sequence: Synthetic oligonucleotide
cugugcccuccucccucc

SEQ ID NO: 149145 - RNA, 18 nt, Artificial Sequence
  Description of Artificial Sequence: Synthetic oligonucleotide
cccuucugugcccuccuc

SEQ ID NO: 149146 - RNA, 18 nt, Artificial Sequence
  Description of Artificial Sequence: Synthetic oligonucleotide
cuccucccuucugugccc

SEQ ID NO: 149147 - RNA, 18 nt, Artificial Sequence
  Description of Artificial Sequence: Synthetic oligonucleotide
cugcccuccucccuucug

SEQ ID NO: 149148 - RNA, 18 nt, Artificial Sequence
  Description of Artificial Sequence: Synthetic oligonucleotide
uuccucugcccuccuccc

SEQ ID NO: 149149 - RNA, 18 nt, Artificial Sequence
  Description of Artificial Sequence: Synthetic oligonucleotide
gcgucuuccucugcccuc

SEQ ID NO: 149150 - RNA, 18 nt, Artificial Sequence
  Description of Artificial Sequence: Synthetic oligonucleotide
accaagcgucuuccucug

SEQ ID NO: 149151 - RNA, 18 nt, Artificial Sequence
  Description of Artificial Sequence: Synthetic oligonucleotide
gcccaaccaagcgucuuc

SEQ ID NO: 149152 - RNA, 18 nt, Artificial Sequence
  Description of Artificial Sequence: Synthetic oligonucleotide
uuggagcccaaccaagcg

SEQ ID NO: 149153 - RNA, 18 nt, Artificial Sequence
  Description of Artificial Sequence: Synthetic oligonucleotide
cauccuuggagcccaacc

SEQ ID NO: 149154 - RNA, 18 nt, Artificial Sequence
  Description of Artificial Sequence: Synthetic oligonucleotide
ucacucauccuuggagcc

SEQ ID NO: 149155 - RNA, 18 nt, Artificial Sequence
  Description of Artificial Sequence: Synthetic oligonucleotide
gaacuucacucauccuug

SEQ ID NO: 149156 - RNA, 18 nt, Artificial Sequence
  Description of Artificial Sequence: Synthetic oligonucleotide
cauaggaacuucacucau

SEQ ID NO: 149157 - RNA, 18 nt, Artificial Sequence
  Description of Artificial Sequence: Synthetic oligonucleotide
uccuccauaggaacuuca

SEQ ID NO: 149158 - RNA, 18 nt, Artificial Sequence
  Description of Artificial Sequence: Synthetic oligonucleotide
uccccuccuccauaggaa

SEQ ID NO: 149159 - RNA, 18 nt, Artificial Sequence
  Description of Artificial Sequence: Synthetic oligonucleotide
gccccuccccuccuccau

SEQ ID NO: 149160 - RNA, 18 nt, Artificial Sequence
  Description of Artificial Sequence: Synthetic oligonucleotide
cccuggccccuccccucc

SEQ ID NO: 149161 - RNA, 18 nt, Artificial Sequence
  Description of Artificial Sequence: Synthetic oligonucleotide
gcccacccuggccccucc

SEQ ID NO: 149162 - RNA, 18 nt, Artificial Sequence
  Description of Artificial Sequence: Synthetic oligonucleotide
caggagcccacccuggcc

SEQ ID NO: 149163 - RNA, 18 nt, Artificial Sequence
  Description of Artificial Sequence: Synthetic oligonucleotide
cccuccaggagcccaccc

SEQ ID NO: 149164 - RNA, 18 nt, Artificial Sequence
  Description of Artificial Sequence: Synthetic oligonucleotide
cugaccccuccaggagcc

SEQ ID NO: 149165 - RNA, 18 nt, Artificial Sequence
  Description of Artificial Sequence: Synthetic oligonucleotide
gugaccugaccccuccag

SEQ ID NO: 149166 - RNA, 18 nt, Artificial Sequence
  Description of Artificial Sequence: Synthetic oligonucleotide
ccucugugaccugacccc

SEQ ID NO: 149167 - RNA, 18 nt, Artificial Sequence
  Description of Artificial Sequence: Synthetic oligonucleotide
cuuggccucugugaccug

SEQ ID NO: 149168 - RNA, 18 nt, Artificial Sequence
  Description of Artificial Sequence: Synthetic oligonucleotide
ugccccuuggccucugug

SEQ ID NO: 149169 - RNA, 18 nt, Artificial Sequence
  Description of Artificial Sequence: Synthetic oligonucleotide
ucaaaugccccuuggccu

SEQ ID NO: 149170 - RNA, 18 nt, Artificial Sequence
  Description of Artificial Sequence: Synthetic oligonucleotide
cccucucaaaugccccuu

SEQ ID NO: 149171 - RNA, 18 nt, Artificial Sequence
  Description of Artificial Sequence: Synthetic oligonucleotide
agggucccucucaaaugc

SEQ ID NO: 149172 - RNA, 18 nt, Artificial Sequence
  Description of Artificial Sequence: Synthetic oligonucleotide
ugcucagggucccucuca

SEQ ID NO: 149173 - RNA, 18 nt, Artificial Sequence
  Description of Artificial Sequence: Synthetic oligonucleotide
ccgccugcucaggguccc

SEQ ID NO: 149174 - RNA, 18 nt, Artificial Sequence
  Description of Artificial Sequence: Synthetic oligonucleotide
ugcacccgccugcucagg

SEQ ID NO: 149175 - RNA, 18 nt, Artificial Sequence
  Description of Artificial Sequence: Synthetic oligonucleotide
ccagcugcacccgccugc

SEQ ID NO: 149176 - RNA, 18 nt, Artificial Sequence
  Description of Artificial Sequence: Synthetic oligonucleotide
gaagcccagcugcacccg

SEQ ID NO: 149177 - RNA, 18 nt, Artificial Sequence
  Description of Artificial Sequence: Synthetic oligonucleotide
acccugaagcccagcugc

SEQ ID NO: 149178 - RNA, 18 nt, Artificial Sequence
  Description of Artificial Sequence: Synthetic oligonucleotide
cuggcacccugaagccca

SEQ ID NO: 149179 - RNA, 18 nt, Artificial Sequence
  Description of Artificial Sequence: Synthetic oligonucleotide
cccuccuggcacccugaa

SEQ ID NO: 149180 - RNA, 18 nt, Artificial Sequence
  Description of Artificial Sequence: Synthetic oligonucleotide
gggcccccuccuggcacc

SEQ ID NO: 149181 - RNA, 18 nt, Artificial Sequence
  Description of Artificial Sequence: Synthetic oligonucleotide
cacgcgggcccccuccug

SEQ ID NO: 149182 - RNA, 18 nt, Artificial Sequence
  Description of Artificial Sequence: Synthetic oligonucleotide
gcuaagaaagccuagaag

SEQ ID NO: 149183 - RNA, 18 nt, Artificial Sequence
  Description of Artificial Sequence: Synthetic oligonucleotide
caaaagcuaagaaagccu

SEQ ID NO: 149184 - RNA, 18 nt, Artificial Sequence
  Description of Artificial Sequence: Synthetic oligonucleotide
cacaccaaaagcuaagaa

SEQ ID NO: 149185 - RNA, 18 nt, Artificial Sequence
  Description of Artificial Sequence: Synthetic oligonucleotide
cgcuucacaccaaaagcu

SEQ ID NO: 149186 - RNA, 18 nt, Artificial Sequence
  Description of Artificial Sequence: Synthetic oligonucleotide
acucucgcuucacaccaa

SEQ ID NO: 149187 - RNA, 18 nt, Artificial Sequence
  Description of Artificial Sequence: Synthetic oligonucleotide
ccuucacucucgcuucac

SEQ ID NO: 149188 - RNA, 18 nt, Artificial Sequence
  Description of Artificial Sequence: Synthetic oligonucleotide
ggccaccuucacucucgc

SEQ ID NO: 149189 - RNA, 18 nt, Artificial Sequence
  Description of Artificial Sequence: Synthetic oligonucleotide
augugggccaccuucacu

SEQ ID NO: 149190 - RNA, 18 nt, Artificial Sequence
  Description of Artificial Sequence: Synthetic oligonucleotide
gcccaaugugggccaccu

SEQ ID NO: 149191 - RNA, 18 nt, Artificial Sequence
  Description of Artificial Sequence: Synthetic oligonucleotide
cacgggcccaaugugggc

SEQ ID NO: 149192 - RNA, 18 nt, Artificial Sequence
  Description of Artificial Sequence: Synthetic oligonucleotide
cugaacacgggcccaaug

SEQ ID NO: 149193 - RNA, 18 nt, Artificial Sequence
  Description of Artificial Sequence: Synthetic oligonucleotide
uuucccugaacacgggcc

SEQ ID NO: 149194 - RNA, 18 nt, Artificial Sequence
  Description of Artificial Sequence: Synthetic oligonucleotide
uugccuuucccugaacac

SEQ ID NO: 149195 - RNA, 18 nt, Artificial Sequence
  Description of Artificial Sequence: Synthetic oligonucleotide
ucgccuugccuuucccug

SEQ ID NO: 149196 - RNA, 18 nt, Artificial Sequence
  Description of Artificial Sequence: Synthetic oligonucleotide
uccccucgccuugccuuu

SEQ ID NO: 149197 - RNA, 18 nt, Artificial Sequence
  Description of Artificial Sequence: Synthetic oligonucleotide
aucuguccccucgccuug

SEQ ID NO: 149198 - RNA, 18 nt, Artificial Sequence
  Description of Artificial Sequence: Synthetic oligonucleotide
caggaaucuguccccucg

SEQ ID NO: 149199 - RNA, 18 nt, Artificial Sequence
  Description of Artificial Sequence: Synthetic oligonucleotide
gaucucaggaaucugucc

SEQ ID NO: 149200 - RNA, 18 nt, Artificial Sequence
  Description of Artificial Sequence: Synthetic oligonucleotide
cugaggaucucaggaauc

SEQ ID NO: 149201 - RNA, 18 nt, Artificial Sequence
  Description of Artificial Sequence: Synthetic oligonucleotide
gcagccugaggaucucag

SEQ ID NO: 149202 - RNA, 18 nt, Artificial Sequence
  Description of Artificial Sequence: Synthetic oligonucleotide
cggcagcagccugaggau

SEQ ID NO: 149203 - RNA, 18 nt, Artificial Sequence
  Description of Artificial Sequence: Synthetic oligonucleotide
cgacccggcagcagccug

SEQ ID NO: 149204 - RNA, 18 nt, Artificial Sequence
  Description of Artificial Sequence: Synthetic oligonucleotide
ucccacgacccggcagca

SEQ ID NO: 149205 - RNA, 18 nt, Artificial Sequence
  Description of Artificial Sequence: Synthetic oligonucleotide
acucgucccacgacccgg

SEQ ID NO: 149206 - RNA, 18 nt, Artificial Sequence
  Description of Artificial Sequence: Synthetic oligonucleotide
uacugacucgucccacga

SEQ ID NO: 149207 - RNA, 18 nt, Artificial Sequence
  Description of Artificial Sequence: Synthetic oligonucleotide
ccagguacugacucgucc

SEQ ID NO: 149208 - RNA, 18 nt, Artificial Sequence
  Description of Artificial Sequence: Synthetic oligonucleotide
cccagccagguacugacu

SEQ ID NO: 149209 - RNA, 18 nt, Artificial Sequence
  Description of Artificial Sequence: Synthetic oligonucleotide
ccucucccagccagguac

SEQ ID NO: 149210 - RNA, 18 nt, Artificial Sequence
  Description of Artificial Sequence: Synthetic oligonucleotide
uggugccucucccagcca

SEQ ID NO: 149211 - RNA, 18 nt, Artificial Sequence
  Description of Artificial Sequence: Synthetic oligonucleotide
uggccuggugccucuccc

SEQ ID NO: 149212 - RNA, 18 nt, Artificial Sequence
  Description of Artificial Sequence: Synthetic oligonucleotide
ucugguggccuggugccu

SEQ ID NO: 149213 - RNA, 18 nt, Artificial Sequence
  Description of Artificial Sequence: Synthetic oligonucleotide
ggaacucugguggccugg

SEQ ID NO: 149214 - RNA, 18 nt, Artificial Sequence
  Description of Artificial Sequence: Synthetic oligonucleotide
gggucggaacucuggugg

SEQ ID NO: 149215 - RNA, 18 nt, Artificial Sequence
  Description of Artificial Sequence: Synthetic oligonucleotide
cucacuuggagacguggg

SEQ ID NO: 149216 - RNA, 18 nt, Artificial Sequence
  Description of Artificial Sequence: Synthetic oligonucleotide
acucacuuggagacgugg

SEQ ID NO: 149217 - RNA, 18 nt, Artificial Sequence
  Description of Artificial Sequence: Synthetic oligonucleotide
ucagcacucacuuggaga

SEQ ID NO: 149218 - RNA, 18 nt, Artificial Sequence
  Description of Artificial Sequence: Synthetic oligonucleotide
gccucucagcacucacuu

SEQ ID NO: 149219 - RNA, 18 nt, Artificial Sequence
  Description of Artificial Sequence: Synthetic oligonucleotide
ugggcgccucucagcacu

SEQ ID NO: 149220 - RNA, 18 nt, Artificial Sequence
  Description of Artificial Sequence: Synthetic oligonucleotide
agaacugggcgccucuca

SEQ ID NO: 149221 - RNA, 18 nt, Artificial Sequence
  Description of Artificial Sequence: Synthetic oligonucleotide
uuggcagaacugggcgcc

SEQ ID NO: 149222 - RNA, 18 nt, Artificial Sequence
  Description of Artificial Sequence: Synthetic oligonucleotide
ccuacuuggcagaacugg

SEQ ID NO: 149223 - RNA, 18 nt, Artificial Sequence
  Description of Artificial Sequence: Synthetic oligonucleotide
uuguuccuacuuggcaga

SEQ ID NO: 149224 - RNA, 18 nt, Artificial Sequence
  Description of Artificial Sequence: Synthetic oligonucleotide
cugcuuuguuccuacuug

SEQ ID NO: 149225 - RNA, 18 nt, Artificial Sequence
  Description of Artificial Sequence: Synthetic oligonucleotide
ucugucugcuuuguuccu

SEQ ID NO: 149226 - RNA, 18 nt, Artificial Sequence
  Description of Artificial Sequence: Synthetic oligonucleotide
caagcucugucugcuuug

SEQ ID NO: 149227 - RNA, 18 nt, Artificial Sequence
  Description of Artificial Sequence: Synthetic oligonucleotide
acucucaagcucugucug

SEQ ID NO: 149228 - RNA, 18 nt, Artificial Sequence
  Description of Artificial Sequence: Synthetic oligonucleotide
cuuggacucucaagcucu

SEQ ID NO: 149229 - RNA, 18 nt, Artificial Sequence
  Description of Artificial Sequence: Synthetic oligonucleotide
ggcugcuuggacucucaa

SEQ ID NO: 149230 - RNA, 18 nt, Artificial Sequence
  Description of Artificial Sequence: Synthetic oligonucleotide
guucaggcugcuuggacu

SEQ ID NO: 149231 - RNA, 18 nt, Artificial Sequence
  Description of Artificial Sequence: Synthetic oligonucleotide
cuccuguucaggcugcuu

SEQ ID NO: 149232 - RNA, 18 nt, Artificial Sequence
  Description of Artificial Sequence: Synthetic oligonucleotide
agggccuccuguucaggc

SEQ ID NO: 149233 - RNA, 18 nt, Artificial Sequence
  Description of Artificial Sequence: Synthetic oligonucleotide
ucgccagggccuccuguu

SEQ ID NO: 149234 - RNA, 18 nt, Artificial Sequence
  Description of Artificial Sequence: Synthetic oligonucleotide
ucucaucgccagggccuc

SEQ ID NO: 149235 - RNA, 18 nt, Artificial Sequence
  Description of Artificial Sequence: Synthetic oligonucleotide
caccuucucaucgccagg

SEQ ID NO: 149236 - RNA, 18 nt, Artificial Sequence
  Description of Artificial Sequence: Synthetic oligonucleotide
aaccacaccuucucaucg

SEQ ID NO: 149237 - RNA, 18 nt, Artificial Sequence
  Description of Artificial Sequence: Synthetic oligonucleotide
gcaccaaccacaccuucu

SEQ ID NO: 149238 - RNA, 18 nt, Artificial Sequence
  Description of Artificial Sequence: Synthetic oligonucleotide
ccccagcaccaaccacac

SEQ ID NO: 149239 - RNA, 18 nt, Artificial Sequence
  Description of Artificial Sequence: Synthetic oligonucleotide
gacauccccagcaccaac

SEQ ID NO: 149240 - RNA, 18 nt, Artificial Sequence
  Description of Artificial Sequence: Synthetic oligonucleotide
ugcuggacauccccagca

SEQ ID NO: 149241 - RNA, 18 nt, Artificial Sequence
  Description of Artificial Sequence: Synthetic oligonucleotide
gcuggugcuggacauccc

SEQ ID NO: 149242 - RNA, 18 nt, Artificial Sequence
  Description of Artificial Sequence: Synthetic oligonucleotide
ccugggcuggugcuggac

SEQ ID NO: 149243 - RNA, 18 nt, Artificial Sequence
  Description of Artificial Sequence: Synthetic oligonucleotide
ucacaccugggcuggugc

SEQ ID NO: 149244 - RNA, 18 nt, Artificial Sequence
  Description of Artificial Sequence: Synthetic oligonucleotide
aagcaucacaccugggcu

SEQ ID NO: 149245 - RNA, 18 nt, Artificial Sequence
  Description of Artificial Sequence: Synthetic oligonucleotide
acagaaagcaucacaccu

SEQ ID NO: 149246 - RNA, 18 nt, Artificial Sequence
  Description of Artificial Sequence: Synthetic oligonucleotide
ggaccacagaaagcauca

SEQ ID NO: 149247 - RNA, 18 nt, Artificial Sequence
  Description of Artificial Sequence: Synthetic oligonucleotide
cauguggaccacagaaag

SEQ ID NO: 149248 - RNA, 18 nt, Artificial Sequence
  Description of Artificial Sequence: Synthetic oligonucleotide
gggaacauguggaccaca

SEQ ID NO: 149249 - RNA, 18 nt, Artificial Sequence
  Description of Artificial Sequence: Synthetic oligonucleotide
gagccccugcaagguggg

SEQ ID NO: 149250 - RNA, 18 nt, Artificial Sequence
  Description of Artificial Sequence: Synthetic oligonucleotide
ugaaggagccccugcaag

SEQ ID NO: 149251 - RNA, 18 nt, Artificial Sequence
  Description of Artificial Sequence: Synthetic oligonucleotide
ggccuugaaggagccccu

SEQ ID NO: 149252 - RNA, 18 nt, Artificial Sequence
  Description of Artificial Sequence: Synthetic oligonucleotide
acccuggccuugaaggag

SEQ ID NO: 149253 - RNA, 18 nt, Artificial Sequence
  Description of Artificial Sequence: Synthetic oligonucleotide
gcuggacccuggccuuga

SEQ ID NO: 149254 - RNA, 18 nt, Artificial Sequence
  Description of Artificial Sequence: Synthetic oligonucleotide
cggaggcuggacccuggc

SEQ ID NO: 149255 - RNA, 18 nt, Artificial Sequence
  Description of Artificial Sequence: Synthetic oligonucleotide
gggcacggaggcuggacc

SEQ ID NO: 149256 - RNA, 18 nt, Artificial Sequence
  Description of Artificial Sequence: Synthetic oligonucleotide
gggcgggcuuagagaggg

SEQ ID NO: 149257 - RNA, 18 nt, Artificial Sequence
  Description of Artificial Sequence: Synthetic oligonucleotide
agggcgggcuuagagagg

SEQ ID NO: 149258 - RNA, 18 nt, Artificial Sequence
  Description of Artificial Sequence: Synthetic oligonucleotide
cggauagggcgggcuuag

SEQ ID NO: 149259 - RNA, 18 nt, Artificial Sequence
  Description of Artificial Sequence: Synthetic oligonucleotide
ggccccggauagggcggg

SEQ ID NO: 149260 - RNA, 18 nt, Artificial Sequence
  Description of Artificial Sequence: Synthetic oligonucleotide
aggacggccccggauagg

SEQ ID NO: 149261 - RNA, 18 nt, Artificial Sequence
  Description of Artificial Sequence: Synthetic oligonucleotide
gagcaaggacggccccgg

SEQ ID NO: 149262 - RNA, 18 nt, Artificial Sequence
  Description of Artificial Sequence: Synthetic oligonucleotide
gggcugagcaaggacggc

SEQ ID NO: 149263 - RNA, 18 nt, Artificial Sequence
  Description of Artificial Sequence: Synthetic oligonucleotide
cacagaggccacgccggg

SEQ ID NO: 149264 - RNA, 18 nt, Artificial Sequence
  Description of Artificial Sequence: Synthetic oligonucleotide
cccacacagaggccacgc

SEQ ID NO: 149265 - RNA, 18 nt, Artificial Sequence
  Description of Artificial Sequence: Synthetic oligonucleotide
guggacccacacagaggc

SEQ ID NO: 149266 - RNA, 18 nt, Artificial Sequence
  Description of Artificial Sequence: Synthetic oligonucleotide
gagauguggacccacaca

SEQ ID NO: 149267 - RNA, 18 nt, Artificial Sequence
  Description of Artificial Sequence: Synthetic oligonucleotide
gggcagagauguggaccc

SEQ ID NO: 149268 - RNA, 18 nt, Artificial Sequence
  Description of Artificial Sequence: Synthetic oligonucleotide
acacgcgcuggccaccgc

SEQ ID NO: 149269 - RNA, 18 nt, Artificial Sequence
  Description of Artificial Sequence: Synthetic oligonucleotide
ccaggacacgcgcuggcc

SEQ ID NO: 149270 - RNA, 18 nt, Artificial Sequence
  Description of Artificial Sequence: Synthetic oligonucleotide
gcaggccaggacacgcgc

SEQ ID NO: 149271 - RNA, 18 nt, Artificial Sequence
  Description of Artificial Sequence: Synthetic oligonucleotide
cgauggcaggccaggaca

SEQ ID NO: 149272 - RNA, 18 nt, Artificial Sequence
  Description of Artificial Sequence: Synthetic oligonucleotide
gaagccgauggcaggcca

SEQ ID NO: 149273 - RNA, 18 nt, Artificial Sequence
  Description of Artificial Sequence: Synthetic oligonucleotide
accaggaagccgauggca

SEQ ID NO: 149274 - RNA, 18 nt, Artificial Sequence
  Description of Artificial Sequence: Synthetic oligonucleotide
cgagcaccaggaagccga

SEQ ID NO: 149275 - RNA, 18 nt, Artificial Sequence
  Description of Artificial Sequence: Synthetic oligonucleotide
ccacgcgagcaccaggaa

SEQ ID NO: 149276 - RNA, 18 nt, Artificial Sequence
  Description of Artificial Sequence: Synthetic oligonucleotide
aagagccacgcgagcacc

SEQ ID NO: 149277 - RNA, 18 nt, Artificial Sequence
  Description of Artificial Sequence: Synthetic oligonucleotide
augcgaagagccacgcga

SEQ ID NO: 149278 - RNA, 18 nt, Artificial Sequence
  Description of Artificial Sequence: Synthetic oligonucleotide
gacaaaugcgaagagcca

SEQ ID NO: 149279 - RNA, 18 nt, Artificial Sequence
  Description of Artificial Sequence: Synthetic oligonucleotide
auggugacaaaugcgaag

SEQ ID NO: 149280 - RNA, 18 nt, Artificial Sequence
  Description of Artificial Sequence: Synthetic oligonucleotide
cgaucauggugacaaaug

SEQ ID NO: 149281 - RNA, 18 nt, Artificial Sequence
  Description of Artificial Sequence: Synthetic oligonucleotide
agccacgaucauggugac

SEQ ID NO: 149282 - RNA, 18 nt, Artificial Sequence
  Description of Artificial Sequence: Synthetic oligonucleotide
acugcagccacgaucaug

SEQ ID NO: 149283 - RNA, 18 nt, Artificial Sequence
  Description of Artificial Sequence: Synthetic oligonucleotide
cucccacugcagccacga

SEQ ID NO: 149284 - RNA, 18 nt, Artificial Sequence
  Description of Artificial Sequence: Synthetic oligonucleotide
ggucacucccacugcagc

SEQ ID NO: 149285 - RNA, 18 nt, Artificial Sequence
  Description of Artificial Sequence: Synthetic oligonucleotide
cacguggucacucccacu

SEQ ID NO: 149286 - RNA, 18 nt, Artificial Sequence
  Description of Artificial Sequence: Synthetic oligonucleotide
gcagccacguggucacuc

SEQ ID NO: 149287 - RNA, 18 nt, Artificial Sequence
  Description of Artificial Sequence: Synthetic oligonucleotide
aaacugcagccacguggu

SEQ ID NO: 149288 - RNA, 18 nt, Artificial Sequence
  Description of Artificial Sequence: Synthetic oligonucleotide
aagagaaacugcagccac

SEQ ID NO: 149289 - RNA, 18 nt, Artificial Sequence
  Description of Artificial Sequence: Synthetic oligonucleotide
agcagaagagaaacugca

SEQ ID NO: 149290 - RNA, 18 nt, Artificial Sequence
  Description of Artificial Sequence: Synthetic oligonucleotide
ggagaagcagaagagaaa

SEQ ID NO: 149291 - RNA, 18 nt, Artificial Sequence
  Description of Artificial Sequence: Synthetic oligonucleotide
auguaggagaagcagaag

SEQ ID NO: 149292 - RNA, 18 nt, Artificial Sequence
  Description of Artificial Sequence: Synthetic oligonucleotide
gcuugauguaggagaagc

SEQ ID NO: 149293 - RNA, 18 nt, Artificial Sequence
  Description of Artificial Sequence: Synthetic oligonucleotide
ugcgagcuugauguagga

SEQ ID NO: 149294 - RNA, 18 nt, Artificial Sequence
  Description of Artificial Sequence: Synthetic oligonucleotide
gugacugcgagcuugaug

SEQ ID NO: 149295 - RNA, 18 nt, Artificial Sequence
  Description of Artificial Sequence: Synthetic oligonucleotide
ccagcgugacugcgagcu

SEQ ID NO: 149296 - RNA, 18 nt, Artificial Sequence
  Description of Artificial Sequence: Synthetic oligonucleotide
cuugaccagcgugacugc

SEQ ID NO: 149297 - RNA, 18 nt, Artificial Sequence
  Description of Artificial Sequence: Synthetic oligonucleotide
aaauacuugaccagcgug

SEQ ID NO: 149298 - RNA, 18 nt, Artificial Sequence
  Description of Artificial Sequence: Synthetic oligonucleotide
guggaaaauacuugacca

SEQ ID NO: 149299 - RNA, 18 nt, Artificial Sequence
  Description of Artificial Sequence: Synthetic oligonucleotide
cacgcgcuggccaccgcg

SEQ ID NO: 149300 - RNA, 18 nt, Artificial Sequence
  Description of Artificial Sequence: Synthetic oligonucleotide
caggacacgcgcuggcca

SEQ ID NO: 149301 - RNA, 18 nt, Artificial Sequence
  Description of Artificial Sequence: Synthetic oligonucleotide
caggccaggacacgcgcu

SEQ ID NO: 149302 - RNA, 18 nt, Artificial Sequence
  Description of Artificial Sequence: Synthetic oligonucleotide
gauggcaggccaggacac

SEQ ID NO: 149303 - RNA, 18 nt, Artificial Sequence
  Description of Artificial Sequence: Synthetic oligonucleotide
aagccgauggcaggccag

SEQ ID NO: 149304 - RNA, 18 nt, Artificial Sequence
  Description of Artificial Sequence: Synthetic oligonucleotide
ccaggaagccgauggcag

SEQ ID NO: 149305 - RNA, 18 nt, Artificial Sequence
  Description of Artificial Sequence: Synthetic oligonucleotide
gagcaccaggaagccgau

SEQ ID NO: 149306 - RNA, 18 nt, Artificial Sequence
  Description of Artificial Sequence: Synthetic oligonucleotide
cacgcgagcaccaggaag

SEQ ID NO: 149307 - RNA, 18 nt, Artificial Sequence
  Description of Artificial Sequence: Synthetic oligonucleotide
agagccacgcgagcacca

SEQ ID NO: 149308 - RNA, 18 nt, Artificial Sequence
  Description of Artificial Sequence: Synthetic oligonucleotide
ugcgaagagccacgcgag

SEQ ID NO: 149309 - RNA, 18 nt, Artificial Sequence
  Description of Artificial Sequence: Synthetic oligonucleotide
acaaaugcgaagagccac

SEQ ID NO: 149310 - RNA, 18 nt, Artificial Sequence
  Description of Artificial Sequence: Synthetic oligonucleotide
uggugacaaaugcgaaga

SEQ ID NO: 149311 - RNA, 18 nt, Artificial Sequence
  Description of Artificial Sequence: Synthetic oligonucleotide
gaucauggugacaaaugc

SEQ ID NO: 149312 - RNA, 18 nt, Artificial Sequence
  Description of Artificial Sequence: Synthetic oligonucleotide
gccacgaucauggugaca

SEQ ID NO: 149313 - RNA, 18 nt, Artificial Sequence
  Description of Artificial Sequence: Synthetic oligonucleotide
cugcagccacgaucaugg

SEQ ID NO: 149314 - RNA, 18 nt, Artificial Sequence
  Description of Artificial Sequence: Synthetic oligonucleotide
ucccacugcagccacgau

SEQ ID NO: 149315 - RNA, 18 nt, Artificial Sequence
  Description of Artificial Sequence: Synthetic oligonucleotide
gucacucccacugcagcc

SEQ ID NO: 149316 - RNA, 18 nt, Artificial Sequence
  Description of Artificial Sequence: Synthetic oligonucleotide
acguggucacucccacug

SEQ ID NO: 149317 - RNA, 18 nt, Artificial Sequence
  Description of Artificial Sequence: Synthetic oligonucleotide
cagccacguggucacucc

SEQ ID NO: 149318 - RNA, 18 nt, Artificial Sequence
  Description of Artificial Sequence: Synthetic oligonucleotide
aacugcagccacgugguc

SEQ ID NO: 149319 - RNA, 18 nt, Artificial Sequence
  Description of Artificial Sequence: Synthetic oligonucleotide
agagaaacugcagccacg

SEQ ID NO: 149320 - RNA, 18 nt, Artificial Sequence
  Description of Artificial Sequence: Synthetic oligonucleotide
gcagaagagaaacugcag

SEQ ID NO: 149321 - RNA, 18 nt, Artificial Sequence
  Description of Artificial Sequence: Synthetic oligonucleotide
gagaagcagaagagaaac

SEQ ID NO: 149322 - RNA, 18 nt, Artificial Sequence
  Description of Artificial Sequence: Synthetic oligonucleotide
uguaggagaagcagaaga

SEQ ID NO: 149323 - RNA, 18 nt, Artificial Sequence
  Description of Artificial Sequence: Synthetic oligonucleotide
cuugauguaggagaagca

SEQ ID NO: 149324 - RNA, 18 nt, Artificial Sequence
  Description of Artificial Sequence: Synthetic oligonucleotide
gcgagcuugauguaggag

SEQ ID NO: 149325 - RNA, 18 nt, Artificial Sequence
  Description of Artificial Sequence: Synthetic oligonucleotide
ugacugcgagcuugaugu

SEQ ID NO: 149326 - RNA, 18 nt, Artificial Sequence
  Description of Artificial Sequence: Synthetic oligonucleotide
cagcgugacugcgagcuu

SEQ ID NO: 149327 - RNA, 18 nt, Artificial Sequence
  Description of Artificial Sequence: Synthetic oligonucleotide
uugaccagcgugacugcg

SEQ ID NO: 149328 - RNA, 18 nt, Artificial Sequence
  Description of Artificial Sequence: Synthetic oligonucleotide
aauacuugaccagcguga

SEQ ID NO: 149329 - RNA, 18 nt, Artificial Sequence
  Description of Artificial Sequence: Synthetic oligonucleotide
uggaaaauacuugaccag

SEQ ID NO: 149330 - RNA, 18 nt, Artificial Sequence
  Description of Artificial Sequence: Synthetic oligonucleotide
ugugaacagggcccugga

SEQ ID NO: 149331 - RNA, 18 nt, Artificial Sequence
  Description of Artificial Sequence: Synthetic oligonucleotide
ggccaugugaacagggcc

SEQ ID NO: 149332 - RNA, 18 nt, Artificial Sequence
  Description of Artificial Sequence: Synthetic oligonucleotide
ccaccggccaugugaaca

SEQ ID NO: 149333 - RNA, 18 nt, Artificial Sequence
  Description of Artificial Sequence: Synthetic oligonucleotide
uccugccaccggccaugu

SEQ ID NO: 149334 - RNA, 18 nt, Artificial Sequence
  Description of Artificial Sequence: Synthetic oligonucleotide
accucuccugccaccggc

SEQ ID NO: 149335 - RNA, 18 nt, Artificial Sequence
  Description of Artificial Sequence: Synthetic oligonucleotide
cucucaccucuccugcca

SEQ ID NO: 149336 - RNA, 18 nt, Artificial Sequence
  Description of Artificial Sequence: Synthetic oligonucleotide
uguagcucucaccucucc

SEQ ID NO: 149337 - RNA, 18 nt, Artificial Sequence
  Description of Artificial Sequence: Synthetic oligonucleotide
ggccauguagcucucacc

SEQ ID NO: 149338 - RNA, 18 nt, Artificial Sequence
  Description of Artificial Sequence: Synthetic oligonucleotide
gccugggccauguagcuc

SEQ ID NO: 149339 - RNA, 18 nt, Artificial Sequence
  Description of Artificial Sequence: Synthetic oligonucleotide
gcagggccugggccaugu

SEQ ID NO: 149340 - RNA, 18 nt, Artificial Sequence
  Description of Artificial Sequence: Synthetic oligonucleotide
ccggagcagggccugggc

SEQ ID NO: 149341 - RNA, 18 nt, Artificial Sequence
  Description of Artificial Sequence: Synthetic oligonucleotide
ccccaccggagcagggcc

SEQ ID NO: 149342 - RNA, 18 nt, Artificial Sequence
  Description of Artificial Sequence: Synthetic oligonucleotide
agcugccccaccggagca

SEQ ID NO: 149343 - RNA, 18 nt, Artificial Sequence
  Description of Artificial Sequence: Synthetic oligonucleotide
gcaggagcugccccaccg

SEQ ID NO: 149344 - RNA, 18 nt, Artificial Sequence
  Description of Artificial Sequence: Synthetic oligonucleotide
cgccggcaggagcugccc

SEQ ID NO: 149345 - RNA, 18 nt, Artificial Sequence
  Description of Artificial Sequence: Synthetic oligonucleotide
ccucacgccggcaggagc

SEQ ID NO: 149346 - RNA, 18 nt, Artificial Sequence
  Description of Artificial Sequence: Synthetic oligonucleotide
uguuuccucacgccggca

SEQ ID NO: 149347 - RNA, 18 nt, Artificial Sequence
  Description of Artificial Sequence: Synthetic oligonucleotide
cguccuguuuccucacgc

SEQ ID NO: 149348 - RNA, 18 nt, Artificial Sequence
  Description of Artificial Sequence: Synthetic oligonucleotide
cuuuccguccuguuuccu

SEQ ID NO: 149349 - RNA, 18 nt, Artificial Sequence
  Description of Artificial Sequence: Synthetic oligonucleotide
uguggcuuuccguccugu

SEQ ID NO: 149350 - RNA, 18 nt, Artificial Sequence
  Description of Artificial Sequence: Synthetic oligonucleotide
cucccuguggcuuuccgu

SEQ ID NO: 149351 - RNA, 18 nt, Artificial Sequence
  Description of Artificial Sequence: Synthetic oligonucleotide
ccgggcucccuguggcuu

SEQ ID NO: 149352 - RNA, 18 nt, Artificial Sequence
  Description of Artificial Sequence: Synthetic oligonucleotide
ggcucccgggcucccugu

SEQ ID NO: 149353 - RNA, 18 nt, Artificial Sequence
  Description of Artificial Sequence: Synthetic oligonucleotide
cgcugggcucccgggcuc

SEQ ID NO: 149354 - RNA, 18 nt, Artificial Sequence
  Description of Artificial Sequence: Synthetic oligonucleotide
gcucccgcugggcucccg

SEQ ID NO: 149355 - RNA, 18 nt, Artificial Sequence
  Description of Artificial Sequence: Synthetic oligonucleotide
gccccgcucccgcugggc

SEQ ID NO: 149356 - RNA, 18 nt, Artificial Sequence
  Description of Artificial Sequence: Synthetic oligonucleotide
ccaccgccccgcucccgc

SEQ ID NO: 149357 - RNA, 18 nt, Artificial Sequence
  Description of Artificial Sequence: Synthetic oligonucleotide
ccuccccaccgccccgcu

SEQ ID NO: 149358 - RNA, 18 nt, Artificial Sequence
  Description of Artificial Sequence: Synthetic oligonucleotide
gcuggccuccccaccgcc

SEQ ID NO: 149359 - RNA, 18 nt, Artificial Sequence
  Description of Artificial Sequence: Synthetic oligonucleotide
ggcaggcuggccucccca

SEQ ID NO: 149360 - RNA, 18 nt, Artificial Sequence
  Description of Artificial Sequence: Synthetic oligonucleotide
agagcggcaggcuggccu

SEQ ID NO: 149361 - RNA, 18 nt, Artificial Sequence
  Description of Artificial Sequence: Synthetic oligonucleotide
gggaagagcggcaggcug

SEQ ID NO: 149362 - RNA, 18 nt, Artificial Sequence
  Description of Artificial Sequence: Synthetic oligonucleotide
ugugauuccagccccggg

SEQ ID NO: 149363 - RNA, 18 nt, Artificial Sequence
  Description of Artificial Sequence: Synthetic oligonucleotide
ucuccugugauuccagcc

SEQ ID NO: 149364 - RNA, 18 nt, Artificial Sequence
  Description of Artificial Sequence: Synthetic oligonucleotide
agcgaucuccugugauuc

SEQ ID NO: 149365 - RNA, 18 nt, Artificial Sequence
  Description of Artificial Sequence: Synthetic oligonucleotide
ccgcuagcgaucuccugu

SEQ ID NO: 149366 - RNA, 18 nt, Artificial Sequence
  Description of Artificial Sequence: Synthetic oligonucleotide
ggccuccgcuagcgaucu

SEQ ID NO: 149367 - RNA, 18 nt, Artificial Sequence
  Description of Artificial Sequence: Synthetic oligonucleotide
gggccuccgcuagcgauc

SEQ ID NO: 149368 - RNA, 18 nt, Artificial Sequence
  Description of Artificial Sequence: Synthetic oligonucleotide
cacaccugaugcuuaggg

SEQ ID NO: 149369 - RNA, 18 nt, Artificial Sequence
  Description of Artificial Sequence: Synthetic oligonucleotide
acccgcacaccugaugcu

SEQ ID NO: 149370 - RNA, 18 nt, Artificial Sequence
  Description of Artificial Sequence: Synthetic oligonucleotide
gaaccacccgcacaccug

SEQ ID NO: 149371 - RNA, 18 nt, Artificial Sequence
  Description of Artificial Sequence: Synthetic oligonucleotide
gggaaccacccgcacacc

SEQ ID NO: 149372 - RNA, 18 nt, Artificial Sequence
  Description of Artificial Sequence: Synthetic oligonucleotide
gcaucaggaaaggcuggg

SEQ ID NO: 149373 - RNA, 18 nt, Artificial Sequence
  Description of Artificial Sequence: Synthetic oligonucleotide
caaaggcaucaggaaagg

SEQ ID NO: 149374 - RNA, 18 nt, Artificial Sequence
  Description of Artificial Sequence: Synthetic oligonucleotide
agagccaaaggcaucagg

SEQ ID NO: 149375 - RNA, 18 nt, Artificial Sequence
  Description of Artificial Sequence: Synthetic oligonucleotide
agggcagagccaaaggca

SEQ ID NO: 149376 - RNA, 18 nt, Artificial Sequence
  Description of Artificial Sequence: Synthetic oligonucleotide
uggugagggcagagccaa

SEQ ID NO: 149377 - RNA, 18 nt, Artificial Sequence
  Description of Artificial Sequence: Synthetic oligonucleotide
ggcaguggugagggcaga

SEQ ID NO: 149378 - RNA, 18 nt, Artificial Sequence
  Description of Artificial Sequence: Synthetic oligonucleotide
auggaggcaguggugagg

SEQ ID NO: 149379 - RNA, 18 nt, Artificial Sequence
  Description of Artificial Sequence: Synthetic oligonucleotide
uggaaauggaggcagugg

SEQ ID NO: 149380 - RNA, 18 nt, Artificial Sequence
  Description of Artificial Sequence: Synthetic oligonucleotide
ugcuguggaaauggaggc

SEQ ID NO: 149381 - RNA, 18 nt, Artificial Sequence
  Description of Artificial Sequence: Synthetic oligonucleotide
uguccugcuguggaaaug

SEQ ID NO: 149382 - RNA, 18 nt, Artificial Sequence
  Description of Artificial Sequence: Synthetic oligonucleotide
cagaguguccugcugugg

SEQ ID NO: 149383 - RNA, 18 nt, Artificial Sequence
  Description of Artificial Sequence: Synthetic oligonucleotide
cucuccagaguguccugc

SEQ ID NO: 149384 - RNA, 18 nt, Artificial Sequence
  Description of Artificial Sequence: Synthetic oligonucleotide
cucaccucuccagagugu

SEQ ID NO: 149385 - RNA, 18 nt, Artificial Sequence
  Description of Artificial Sequence: Synthetic oligonucleotide
cccaccucaccucuccag

SEQ ID NO: 149386 - RNA, 18 nt, Artificial Sequence
  Description of Artificial Sequence: Synthetic oligonucleotide
cuccucccaccucaccuc

SEQ ID NO: 149387 - RNA, 18 nt, Artificial Sequence
  Description of Artificial Sequence: Synthetic oligonucleotide
gcucccuccucccaccuc

SEQ ID NO: 149388 - RNA, 18 nt, Artificial Sequence
  Description of Artificial Sequence: Synthetic oligonucleotide
gggcucccuccucccacc

SEQ ID NO: 149389 - RNA, 18 nt, Artificial Sequence
  Description of Artificial Sequence: Synthetic oligonucleotide
agcucugcgcgggaaggg

SEQ ID NO: 149390 - RNA, 18 nt, Artificial Sequence
  Description of Artificial Sequence: Synthetic oligonucleotide
ggcugagcucugcgcggg

SEQ ID NO: 149391 - RNA, 18 nt, Artificial Sequence
  Description of Artificial Sequence: Synthetic oligonucleotide
ggacgggcugagcucugc

SEQ ID NO: 149392 - RNA, 18 nt, Artificial Sequence
  Description of Artificial Sequence: Synthetic oligonucleotide
ucauaggacgggcugagc

SEQ ID NO: 149393 - RNA, 18 nt, Artificial Sequence
  Description of Artificial Sequence: Synthetic oligonucleotide
uaugcucauaggacgggc

SEQ ID NO: 149394 - RNA, 18 nt, Artificial Sequence
  Description of Artificial Sequence: Synthetic oligonucleotide
ccggcuaugcucauagga

SEQ ID NO: 149395 - RNA, 18 nt, Artificial Sequence
  Description of Artificial Sequence: Synthetic oligonucleotide
gaggaccggcuaugcuca

SEQ ID NO: 149396 - RNA, 18 nt, Artificial Sequence
  Description of Artificial Sequence: Synthetic oligonucleotide
cugaagaggaccggcuau

SEQ ID NO: 149397 - RNA, 18 nt, Artificial Sequence
  Description of Artificial Sequence: Synthetic oligonucleotide
cggaucugaagaggaccg

SEQ ID NO: 149398 - RNA, 18 nt, Artificial Sequence
  Description of Artificial Sequence: Synthetic oligonucleotide
guccccggaucugaagag

SEQ ID NO: 149399 - RNA, 18 nt, Artificial Sequence
  Description of Artificial Sequence: Synthetic oligonucleotide
ccugaguccccggaucug

SEQ ID NO: 149400 - RNA, 18 nt, Artificial Sequence
  Description of Artificial Sequence: Synthetic oligonucleotide
uggacccugaguccccgg

SEQ ID NO: 149401 - RNA, 18 nt, Artificial Sequence
  Description of Artificial Sequence: Synthetic oligonucleotide
ugugcuggacccugaguc

SEQ ID NO: 149402 - RNA, 18 nt, Artificial Sequence
  Description of Artificial Sequence: Synthetic oligonucleotide
caagaugugcuggacccu

SEQ ID NO: 149403 - RNA, 18 nt, Artificial Sequence
  Description of Artificial Sequence: Synthetic oligonucleotide
gggcaagaugugcuggac

SEQ ID NO: 149404 - RNA, 18 nt, Artificial Sequence
  Description of Artificial Sequence: Synthetic oligonucleotide
ccugucccaggcuguggg

SEQ ID NO: 149405 - RNA, 18 nt, Artificial Sequence
  Description of Artificial Sequence: Synthetic oligonucleotide
cugacccugucccaggcu

SEQ ID NO: 149406 - RNA, 18 nt, Artificial Sequence
  Description of Artificial Sequence: Synthetic oligonucleotide
cagcccugacccuguccc

SEQ ID NO: 149407 - RNA, 18 nt, Artificial Sequence
  Description of Artificial Sequence: Synthetic oligonucleotide
aacuucagcccugacccu

SEQ ID NO: 149408 - RNA, 18 nt, Artificial Sequence
  Description of Artificial Sequence: Synthetic oligonucleotide
gcagcaacuucagcccug

SEQ ID NO: 149409 - RNA, 18 nt, Artificial Sequence
  Description of Artificial Sequence: Synthetic oligonucleotide
cgggugcagcaacuucag

SEQ ID NO: 149410 - RNA, 18 nt, Artificial Sequence
  Description of Artificial Sequence: Synthetic oligonucleotide
guccccgggugcagcaac

SEQ ID NO: 149411 - RNA, 18 nt, Artificial Sequence
  Description of Artificial Sequence: Synthetic oligonucleotide
ccuagguccccgggugca

SEQ ID NO: 149412 - RNA, 18 nt, Artificial Sequence
  Description of Artificial Sequence: Synthetic oligonucleotide
gaggcccuagguccccgg

SEQ ID NO: 149413 - RNA, 18 nt, Artificial Sequence
  Description of Artificial Sequence: Synthetic oligonucleotide
uaaaugaggcccuagguc

SEQ ID NO: 149414 - RNA, 18 nt, Artificial Sequence
  Description of Artificial Sequence: Synthetic oligonucleotide
ugaguuaaaugaggcccu

SEQ ID NO: 149415 - RNA, 18 nt, Artificial Sequence
  Description of Artificial Sequence: Synthetic oligonucleotide
ccccgucuguagagcggg

SEQ ID NO: 149416 - RNA, 18 nt, Artificial Sequence
  Description of Artificial Sequence: Synthetic oligonucleotide
uuccccgucuguagagcg

SEQ ID NO: 149417 - RNA, 18 nt, Artificial Sequence
  Description of Artificial Sequence: Synthetic oligonucleotide
uugguuuccccgucugua

SEQ ID NO: 149418 - RNA, 18 nt, Artificial Sequence
  Description of Artificial Sequence: Synthetic oligonucleotide
uagccuugguuuccccgu

SEQ ID NO: 149419 - RNA, 18 nt, Artificial Sequence
  Description of Artificial Sequence: Synthetic oligonucleotide
ucuccuagccuugguuuc

SEQ ID NO: 149420 - RNA, 18 nt, Artificial Sequence
  Description of Artificial Sequence: Synthetic oligonucleotide
acaguucuccuagccuug

SEQ ID NO: 149421 - RNA, 18 nt, Artificial Sequence
  Description of Artificial Sequence: Synthetic oligonucleotide
aagugacaguucuccuag

SEQ ID NO: 149422 - RNA, 18 nt, Artificial Sequence
  Description of Artificial Sequence: Synthetic oligonucleotide
ugggcaagugacaguucu

SEQ ID NO: 149423 - RNA, 18 nt, Artificial Sequence
  Description of Artificial Sequence: Synthetic oligonucleotide
ugucuugggcaagugaca

SEQ ID NO: 149424 - RNA, 18 nt, Artificial Sequence
  Description of Artificial Sequence: Synthetic oligonucleotide
ccugcugucuugggcaag

SEQ ID NO: 149425 - RNA, 18 nt, Artificial Sequence
  Description of Artificial Sequence: Synthetic oligonucleotide
cggagccugcugucuugg

SEQ ID NO: 149426 - RNA, 18 nt, Artificial Sequence
  Description of Artificial Sequence: Synthetic oligonucleotide
aucaccggagccugcugu

SEQ ID NO: 149427 - RNA, 18 nt, Artificial Sequence
  Description of Artificial Sequence: Synthetic oligonucleotide
gcuccaucaccggagccu

SEQ ID NO: 149428 - RNA, 18 nt, Artificial Sequence
  Description of Artificial Sequence: Synthetic oligonucleotide
uccuggcuccaucaccgg

SEQ ID NO: 149429 - RNA, 18 nt, Artificial Sequence
  Description of Artificial Sequence: Synthetic oligonucleotide
uggaauccuggcuccauc

SEQ ID NO: 149430 - RNA, 18 nt, Artificial Sequence
  Description of Artificial Sequence: Synthetic oligonucleotide
ugguuuggaauccuggcu

SEQ ID NO: 149431 - RNA, 18 nt, Artificial Sequence
  Description of Artificial Sequence: Synthetic oligonucleotide
acuucugguuuggaaucc

SEQ ID NO: 149432 - RNA, 18 nt, Artificial Sequence
  Description of Artificial Sequence: Synthetic oligonucleotide
gugggacuucugguuugg

SEQ ID NO: 149433 - RNA, 18 nt, Artificial Sequence
  Description of Artificial Sequence: Synthetic oligonucleotide
ugggagugggacuucugg

SEQ ID NO: 149434 - RNA, 18 nt, Artificial Sequence
  Description of Artificial Sequence: Synthetic oligonucleotide
acuggugggagugggacu

SEQ ID NO: 149435 - RNA, 18 nt, Artificial Sequence
  Description of Artificial Sequence: Synthetic oligonucleotide
uagggacuggugggagug

SEQ ID NO: 149436 - RNA, 18 nt, Artificial Sequence
  Description of Artificial Sequence: Synthetic oligonucleotide
gugcuuagggacuggugg

SEQ ID NO: 149437 - RNA, 18 nt, Artificial Sequence
  Description of Artificial Sequence: Synthetic oligonucleotide
uucaugugcuuagggacu

SEQ ID NO: 149438 - RNA, 18 nt, Artificial Sequence
  Description of Artificial Sequence: Synthetic oligonucleotide
uggacuucaugugcuuag

SEQ ID NO: 149439 - RNA, 18 nt, Artificial Sequence
  Description of Artificial Sequence: Synthetic oligonucleotide
cagccuggacuucaugug

SEQ ID NO: 149440 - RNA, 18 nt, Artificial Sequence
  Description of Artificial Sequence: Synthetic oligonucleotide
aaacucagccuggacuuc

SEQ ID NO: 149441 - RNA, 18 nt, Artificial Sequence
  Description of Artificial Sequence: Synthetic oligonucleotide
uccccaaacucagccugg

SEQ ID NO: 149442 - RNA, 18 nt, Artificial Sequence
  Description of Artificial Sequence: Synthetic oligonucleotide
ggcuguccccaaacucag

SEQ ID NO: 149443 - RNA, 18 nt, Artificial Sequence
  Description of Artificial Sequence: Synthetic oligonucleotide
ggcaaggcuguccccaaa

SEQ ID NO: 149444 - RNA, 18 nt, Artificial Sequence
  Description of Artificial Sequence: Synthetic oligonucleotide
cuccaggcaaggcugucc

SEQ ID NO: 149445 - RNA, 18 nt, Artificial Sequence
  Description of Artificial Sequence: Synthetic oligonucleotide
cucaccuccaggcaaggc

SEQ ID NO: 149446 - RNA, 18 nt, Artificial Sequence
  Description of Artificial Sequence: Synthetic oligonucleotide
uucuucucaccuccaggc

SEQ ID NO: 149447 - RNA, 18 nt, Artificial Sequence
  Description of Artificial Sequence: Synthetic oligonucleotide
gauucuucuucucaccuc

SEQ ID NO: 149448 - RNA, 18 nt, Artificial Sequence
  Description of Artificial Sequence: Synthetic oligonucleotide
gcuaugauucuucuucuc

SEQ ID NO: 149449 - RNA, 18 nt, Artificial Sequence
  Description of Artificial Sequence: Synthetic oligonucleotide
cuguagcuaugauucuuc

SEQ ID NO: 149450 - RNA, 18 nt, Artificial Sequence
  Description of Artificial Sequence: Synthetic oligonucleotide
uuucccuguagcuaugau

SEQ ID NO: 149451 - RNA, 18 nt, Artificial Sequence
  Description of Artificial Sequence: Synthetic oligonucleotide
gcuaguuucccuguagcu

SEQ ID NO: 149452 - RNA, 18 nt, Artificial Sequence
  Description of Artificial Sequence: Synthetic oligonucleotide
ccugugcuaguuucccug

SEQ ID NO: 149453 - RNA, 18 nt, Artificial Sequence
  Description of Artificial Sequence: Synthetic oligonucleotide
aaggcccugugcuaguuu

SEQ ID NO: 149454 - RNA, 18 nt, Artificial Sequence
  Description of Artificial Sequence: Synthetic oligonucleotide
gggccaaggcccugugcu

SEQ ID NO: 149455 - RNA, 18 nt, Artificial Sequence
  Description of Artificial Sequence: Synthetic oligonucleotide
cuccuccacaucccuggg

SEQ ID NO: 149456 - RNA, 18 nt, Artificial Sequence
  Description of Artificial Sequence: Synthetic oligonucleotide
gucuccuccacaucccug

SEQ ID NO: 149457 - RNA, 18 nt, Artificial Sequence
  Description of Artificial Sequence: Synthetic oligonucleotide
uccccgucuccuccacau

SEQ ID NO: 149458 - RNA, 18 nt, Artificial Sequence
  Description of Artificial Sequence: Synthetic oligonucleotide
ggccuuccccgucuccuc

SEQ ID NO: 149459 - RNA, 18 nt, Artificial Sequence
  Description of Artificial Sequence: Synthetic oligonucleotide
gaugcggccuuccccguc

SEQ ID NO: 149460 - RNA, 18 nt, Artificial Sequence
  Description of Artificial Sequence: Synthetic oligonucleotide
gggccgaugcggccuucc

SEQ ID NO: 149461 - RNA, 18 nt, Artificial Sequence
  Description of Artificial Sequence: Synthetic oligonucleotide
agcuccagcagaggcggg

SEQ ID NO: 149462 - RNA, 18 nt, Artificial Sequence
  Description of Artificial Sequence: Synthetic oligonucleotide
ucacagcuccagcagagg

SEQ ID NO: 149463 - RNA, 18 nt, Artificial Sequence
  Description of Artificial Sequence: Synthetic oligonucleotide
acaccucacagcuccagc

SEQ ID NO: 149464 - RNA, 18 nt, Artificial Sequence
  Description of Artificial Sequence: Synthetic oligonucleotide
cccccacaccucacagcu

SEQ ID NO: 149465 - RNA, 18 nt, Artificial Sequence
  Description of Artificial Sequence: Synthetic oligonucleotide
cgcaccccccacaccuca

SEQ ID NO: 149466 - RNA, 18 nt, Artificial Sequence
  Description of Artificial Sequence: Synthetic oligonucleotide
ggccccgcaccccccaca

SEQ ID NO: 149467 - RNA, 18 nt, Artificial Sequence
  Description of Artificial Sequence: Synthetic oligonucleotide
gcaaaggccccgcacccc

SEQ ID NO: 149468 - RNA, 18 nt, Artificial Sequence
  Description of Artificial Sequence: Synthetic oligonucleotide
agcaagcaaaggccccgc

SEQ ID NO: 149469 - RNA, 18 nt, Artificial Sequence
  Description of Artificial Sequence: Synthetic oligonucleotide
uguacagcaagcaaaggc

SEQ ID NO: 149470 - RNA, 18 nt, Artificial Sequence
  Description of Artificial Sequence: Synthetic oligonucleotide
cugcauguacagcaagca

SEQ ID NO: 149471 - RNA, 18 nt, Artificial Sequence
  Description of Artificial Sequence: Synthetic oligonucleotide
cucaucugcauguacagc

SEQ ID NO: 149472 - RNA, 18 nt, Artificial Sequence
  Description of Artificial Sequence: Synthetic oligonucleotide
ggcgucucaucugcaugu

SEQ ID NO: 149473 - RNA, 18 nt, Artificial Sequence
  Description of Artificial Sequence: Synthetic oligonucleotide
ggguaggcgucucaucug

SEQ ID NO: 149474 - RNA, 18 nt, Artificial Sequence
  Description of Artificial Sequence: Synthetic oligonucleotide
aguuugggugguccuggg

SEQ ID NO: 149475 - RNA, 18 nt, Artificial Sequence
  Description of Artificial Sequence: Synthetic oligonucleotide
gaacaguuuggguggucc

SEQ ID NO: 149476 - RNA, 18 nt, Artificial Sequence
  Description of Artificial Sequence: Synthetic oligonucleotide
ccaaggaacaguuugggu

SEQ ID NO: 149477 - RNA, 18 nt, Artificial Sequence
  Description of Artificial Sequence: Synthetic oligonucleotide
cucagccaaggaacaguu

SEQ ID NO: 149478 - RNA, 18 nt, Artificial Sequence
  Description of Artificial Sequence: Synthetic oligonucleotide
caggccucagccaaggaa

SEQ ID NO: 149479 - RNA, 18 nt, Artificial Sequence
  Description of Artificial Sequence: Synthetic oligonucleotide
uaugacaggccucagcca

SEQ ID NO: 149480 - RNA, 18 nt, Artificial Sequence
  Description of Artificial Sequence: Synthetic oligonucleotide
ugggcuaugacaggccuc

SEQ ID NO: 149481 - RNA, 18 nt, Artificial Sequence
  Description of Artificial Sequence: Synthetic oligonucleotide
accuuugggcuaugacag

SEQ ID NO: 149482 - RNA, 18 nt, Artificial Sequence
  Description of Artificial Sequence: Synthetic oligonucleotide
cggugaccuuugggcuau

SEQ ID NO: 149483 - RNA, 18 nt, Artificial Sequence
  Description of Artificial Sequence: Synthetic oligonucleotide
ggacacggugaccuuugg

SEQ ID NO: 149484 - RNA, 18 nt, Artificial Sequence
  Description of Artificial Sequence: Synthetic oligonucleotide
uccaaggacacggugacc

SEQ ID NO: 149485 - RNA, 18 nt, Artificial Sequence
  Description of Artificial Sequence: Synthetic oligonucleotide
uuggcuccaaggacacgg

SEQ ID NO: 149486 - RNA, 18 nt, Artificial Sequence
  Description of Artificial Sequence: Synthetic oligonucleotide
gggccuuggcuccaagga

SEQ ID NO: 149487 - RNA, 18 nt, Artificial Sequence
  Description of Artificial Sequence: Synthetic oligonucleotide
cucauuccucccacuggg

SEQ ID NO: 149488 - RNA, 18 nt, Artificial Sequence
  Description of Artificial Sequence: Synthetic oligonucleotide
gguucucauuccucccac

SEQ ID NO: 149489 - RNA, 18 nt, Artificial Sequence
  Description of Artificial Sequence: Synthetic oligonucleotide
aaagcgguucucauuccu

SEQ ID NO: 149490 - RNA, 18 nt, Artificial Sequence
  Description of Artificial Sequence: Synthetic oligonucleotide
aaacaaaagcgguucuca

SEQ ID NO: 149491 - RNA, 18 nt, Artificial Sequence
  Description of Artificial Sequence: Synthetic oligonucleotide
ccuccaaacaaaagcggu

SEQ ID NO: 149492 - RNA, 18 nt, Artificial Sequence
  Description of Artificial Sequence: Synthetic oligonucleotide
cugccccuccaaacaaaa

SEQ ID NO: 149493 - RNA, 18 nt, Artificial Sequence
  Description of Artificial Sequence: Synthetic oligonucleotide
cgugacugccccuccaaa

SEQ ID NO: 149494 - RNA, 18 nt, Artificial Sequence
  Description of Artificial Sequence: Synthetic oligonucleotide
cgccucgugacugccccu

SEQ ID NO: 149495 - RNA, 18 nt, Artificial Sequence
  Description of Artificial Sequence: Synthetic oligonucleotide
ucaugcgccucgugacug

SEQ ID NO: 149496 - RNA, 18 nt, Artificial Sequence
  Description of Artificial Sequence: Synthetic oligonucleotide
cugccucaugcgccucgu

SEQ ID NO: 149497 - RNA, 18 nt, Artificial Sequence
  Description of Artificial Sequence: Synthetic oligonucleotide
ggcggcugccucaugcgc

SEQ ID NO: 149498 - RNA, 18 nt, Artificial Sequence
  Description of Artificial Sequence: Synthetic oligonucleotide
ggcugggcggcugccuca

SEQ ID NO: 149499 - RNA, 18 nt, Artificial Sequence
  Description of Artificial Sequence: Synthetic oligonucleotide
gugagggcugggcggcug

SEQ ID NO: 149500 - RNA, 18 nt, Artificial Sequence
  Description of Artificial Sequence: Synthetic oligonucleotide
gggcggugagggcugggc

SEQ ID NO: 149501 - RNA, 18 nt, Artificial Sequence
  Description of Artificial Sequence: Synthetic oligonucleotide
acggagggcggugagggc

SEQ ID NO: 149502 - RNA, 18 nt, Artificial Sequence
  Description of Artificial Sequence: Synthetic oligonucleotide
gacagacggagggcggug

SEQ ID NO: 149503 - RNA, 18 nt, Artificial Sequence
  Description of Artificial Sequence: Synthetic oligonucleotide
ggacagacagacggaggg

SEQ ID NO: 149504 - RNA, 18 nt, Artificial Sequence
  Description of Artificial Sequence: Synthetic oligonucleotide
aguaaaaguucauguagg

SEQ ID NO: 149505 - RNA, 18 nt, Artificial Sequence
  Description of Artificial Sequence: Synthetic oligonucleotide
uuuguaguaaaaguucau

SEQ ID NO: 149506 - RNA, 18 nt, Artificial Sequence
  Description of Artificial Sequence: Synthetic oligonucleotide
gugcuuuuguaguaaaag

SEQ ID NO: 149507 - RNA, 18 nt, Artificial Sequence
  Description of Artificial Sequence: Synthetic oligonucleotide
ccucagugcuuuuguagu

SEQ ID NO: 149508 - RNA, 18 nt, Artificial Sequence
  Description of Artificial Sequence: Synthetic oligonucleotide
ccagcccucagugcuuuu

SEQ ID NO: 149509 - RNA, 18 nt, Artificial Sequence
  Description of Artificial Sequence: Synthetic oligonucleotide
augcuccagcccucagug

SEQ ID NO: 149510 - RNA, 18 nt, Artificial Sequence
  Description of Artificial Sequence: Synthetic oligonucleotide
ugccaaugcuccagcccu

SEQ ID NO: 149511 - RNA, 18 nt, Artificial Sequence
  Description of Artificial Sequence: Synthetic oligonucleotide
cacguugccaaugcucca

SEQ ID NO: 149512 - RNA, 18 nt, Artificial Sequence
  Description of Artificial Sequence: Synthetic oligonucleotide
aggagcacguugccaaug

SEQ ID NO: 149513 - RNA, 18 nt, Artificial Sequence
  Description of Artificial Sequence: Synthetic oligonucleotide
aguccaggagcacguugc

SEQ ID NO: 149514 - RNA, 18 nt, Artificial Sequence
  Description of Artificial Sequence: Synthetic oligonucleotide
ggugaaguccaggagcac

SEQ ID NO: 149515 - RNA, 18 nt, Artificial Sequence
  Description of Artificial Sequence: Synthetic oligonucleotide
cccccggugaaguccagg

SEQ ID NO: 149516 - RNA, 18 nt, Artificial Sequence
  Description of Artificial Sequence: Synthetic oligonucleotide
agcugcccccggugaagu

SEQ ID NO: 149517 - RNA, 18 nt, Artificial Sequence
  Description of Artificial Sequence: Synthetic oligonucleotide
gcugaagcugcccccggu

SEQ ID NO: 149518 - RNA, 18 nt, Artificial Sequence
  Description of Artificial Sequence: Synthetic oligonucleotide
aggaggcugaagcugccc

SEQ ID NO: 149519 - RNA, 18 nt, Artificial Sequence
  Description of Artificial Sequence: Synthetic oligonucleotide
ucugcaggaggcugaagc

SEQ ID NO: 149520 - RNA, 18 nt, Artificial Sequence
  Description of Artificial Sequence: Synthetic oligonucleotide
gaacaucugcaggaggcu

SEQ ID NO: 149521 - RNA, 18 nt, Artificial Sequence
  Description of Artificial Sequence: Synthetic oligonucleotide
uggaggaacaucugcagg

SEQ ID NO: 149522 - RNA, 18 nt, Artificial Sequence
  Description of Artificial Sequence: Synthetic oligonucleotide
aggacuggaggaacaucu

SEQ ID NO: 149523 - RNA, 18 nt, Artificial Sequence
  Description of Artificial Sequence: Synthetic oligonucleotide
guuguaggacuggaggaa

SEQ ID NO: 149524 - RNA, 18 nt, Artificial Sequence
  Description of Artificial Sequence: Synthetic oligonucleotide
guauuuagcaugagcacu

SEQ ID NO: 149525 - RNA, 18 nt, Artificial Sequence
  Description of Artificial Sequence: Synthetic oligonucleotide
ccuggguauuuagcauga

SEQ ID NO: 149526 - RNA, 18 nt, Artificial Sequence
  Description of Artificial Sequence: Synthetic oligonucleotide
caacaccuggguauuuag

SEQ ID NO: 149527 - RNA, 18 nt, Artificial Sequence
  Description of Artificial Sequence: Synthetic oligonucleotide
gaucccaacaccugggua

SEQ ID NO: 149528 - RNA, 18 nt, Artificial Sequence
  Description of Artificial Sequence: Synthetic oligonucleotide
cacuggaucccaacaccu

SEQ ID NO: 149529 - RNA, 18 nt, Artificial Sequence
  Description of Artificial Sequence: Synthetic oligonucleotide
gucuucacuggaucccaa

SEQ ID NO: 149530 - RNA, 18 nt, Artificial Sequence
  Description of Artificial Sequence: Synthetic oligonucleotide
aaauugucuucacuggau

SEQ ID NO: 149531 - RNA, 18 nt, Artificial Sequence
  Description of Artificial Sequence: Synthetic oligonucleotide
cuucaaaauugucuucac

SEQ ID NO: 149532 - RNA, 18 nt, Artificial Sequence
  Description of Artificial Sequence: Synthetic oligonucleotide
ugaaucuucaaaauuguc

SEQ ID NO: 149533 - RNA, 18 nt, Artificial Sequence
  Description of Artificial Sequence: Synthetic oligonucleotide
ugacuugaaucuucaaaa

SEQ ID NO: 149534 - RNA, 18 nt, Artificial Sequence
  Description of Artificial Sequence: Synthetic oligonucleotide
uaaacugacuugaaucuu

SEQ ID NO: 149535 - RNA, 18 nt, Artificial Sequence
  Description of Artificial Sequence: Synthetic oligonucleotide
aggucuaaacugacuuga

SEQ ID NO: 149536 - RNA, 18 nt, Artificial Sequence
  Description of Artificial Sequence: Synthetic oligonucleotide
cguucaggucuaaacuga

SEQ ID NO: 149537 - RNA, 18 nt, Artificial Sequence
  Description of Artificial Sequence: Synthetic oligonucleotide
gccaacguucaggucuaa

SEQ ID NO: 149538 - RNA, 18 nt, Artificial Sequence
  Description of Artificial Sequence: Synthetic oligonucleotide
cugaagccaacguucagg

SEQ ID NO: 149539 - RNA, 18 nt, Artificial Sequence
  Description of Artificial Sequence: Synthetic oligonucleotide
uucuccugaagccaacgu

SEQ ID NO: 149540 - RNA, 18 nt, Artificial Sequence
  Description of Artificial Sequence: Synthetic oligonucleotide
uuuccuucuccugaagcc

SEQ ID NO: 149541 - RNA, 18 nt, Artificial Sequence
  Description of Artificial Sequence: Synthetic oligonucleotide
aauuuuuuccuucuccug

SEQ ID NO: 149542 - RNA, 18 nt, Artificial Sequence
  Description of Artificial Sequence: Synthetic oligonucleotide
ggauuaauuuuuuccuuc

SEQ ID NO: 149543 - RNA, 18 nt, Artificial Sequence
  Description of Artificial Sequence: Synthetic oligonucleotide
caaaaggauuaauuuuuu

SEQ ID NO: 149544 - RNA, 18 nt, Artificial Sequence
  Description of Artificial Sequence: Synthetic oligonucleotide
augcgcaaaaggauuaau

SEQ ID NO: 149545 - RNA, 18 nt, Artificial Sequence
  Description of Artificial Sequence: Synthetic oligonucleotide
ggaagaugcgcaaaagga

SEQ ID NO: 149546 - RNA, 18 nt, Artificial Sequence
  Description of Artificial Sequence: Synthetic oligonucleotide
caaauggaagaugcgcaa

SEQ ID NO: 149547 - RNA, 18 nt, Artificial Sequence
  Description of Artificial Sequence: Synthetic oligonucleotide
aacgccaaauggaagaug

SEQ ID NO: 149548 - RNA, 18 nt, Artificial Sequence
  Description of Artificial Sequence: Synthetic oligonucleotide
uuuccaacgccaaaugga

SEQ ID NO: 149549 - RNA, 18 nt, Artificial Sequence
  Description of Artificial Sequence: Synthetic oligonucleotide
uucuuuuuccaacgccaa

SEQ ID NO: 149550 - RNA, 18 nt, Artificial Sequence
  Description of Artificial Sequence: Synthetic oligonucleotide
gcacauucuuuuuccaac

SEQ ID NO: 149551 - RNA, 18 nt, Artificial Sequence
  Description of Artificial Sequence: Synthetic oligonucleotide
ccaaugcacauucuuuuu

SEQ ID NO: 149552 - RNA, 18 nt, Artificial Sequence
  Description of Artificial Sequence: Synthetic oligonucleotide
ggcgaccaaugcacauuc

SEQ ID NO: 149553 - RNA, 18 nt, Artificial Sequence
  Description of Artificial Sequence: Synthetic oligonucleotide
uaaucggcgaccaaugca

SEQ ID NO: 149554 - RNA, 18 nt, Artificial Sequence
  Description of Artificial Sequence: Synthetic oligonucleotide
ucugcuaaucggcgacca

SEQ ID NO: 149555 - RNA, 18 nt, Artificial Sequence
  Description of Artificial Sequence: Synthetic oligonucleotide
gaagcucugcuaaucggc

SEQ ID NO: 149556 - RNA, 18 nt, Artificial Sequence
  Description of Artificial Sequence: Synthetic oligonucleotide
caguugaagcucugcuaa

SEQ ID NO: 149557 - RNA, 18 nt, Artificial Sequence
  Description of Artificial Sequence: Synthetic oligonucleotide
aaaugcaguugaagcucu

SEQ ID NO: 149558 - RNA, 18 nt, Artificial Sequence
  Description of Artificial Sequence: Synthetic oligonucleotide
gagccaaaugcaguugaa

SEQ ID NO: 149559 - RNA, 18 nt, Artificial Sequence
  Description of Artificial Sequence: Synthetic oligonucleotide
acaaagagccaaaugcag

SEQ ID NO: 149560 - RNA, 18 nt, Artificial Sequence
  Description of Artificial Sequence: Synthetic oligonucleotide
gcagaaaccgguaaaggu

SEQ ID NO: 149561 - RNA, 18 nt, Artificial Sequence
  Description of Artificial Sequence: Synthetic oligonucleotide
uaauugcagaaaccggua

SEQ ID NO: 149562 - RNA, 18 nt, Artificial Sequence
  Description of Artificial Sequence: Synthetic oligonucleotide
gaacauaauugcagaaac

SEQ ID NO: 149563 - RNA, 18 nt, Artificial Sequence
  Description of Artificial Sequence: Synthetic oligonucleotide
gcacagaacauaauugca

SEQ ID NO: 149564 - RNA, 18 nt, Artificial Sequence
  Description of Artificial Sequence: Synthetic oligonucleotide
aaacagcacagaacauaa

SEQ ID NO: 149565 - RNA, 18 nt, Artificial Sequence
  Description of Artificial Sequence: Synthetic oligonucleotide
uugugaaacagcacagaa

SEQ ID NO: 149566 - RNA, 18 nt, Artificial Sequence
  Description of Artificial Sequence: Synthetic oligonucleotide
cugccuugugaaacagca

SEQ ID NO: 149567 - RNA, 18 nt, Artificial Sequence
  Description of Artificial Sequence: Synthetic oligonucleotide
uucuucugccuugugaaa

SEQ ID NO: 149568 - RNA, 18 nt, Artificial Sequence
  Description of Artificial Sequence: Synthetic oligonucleotide
cucucuucuucugccuug

SEQ ID NO: 149569 - RNA, 18 nt, Artificial Sequence
  Description of Artificial Sequence: Synthetic oligonucleotide
uaccccucucuucuucug

SEQ ID NO: 149570 - RNA, 18 nt, Artificial Sequence
  Description of Artificial Sequence: Synthetic oligonucleotide
agaauuaccccucucuuc

SEQ ID NO: 149571 - RNA, 18 nt, Artificial Sequence
  Description of Artificial Sequence: Synthetic oligonucleotide
aaaacagaauuaccccuc

SEQ ID NO: 149572 - RNA, 18 nt, Artificial Sequence
  Description of Artificial Sequence: Synthetic oligonucleotide
gcacagaacauaauugca

SEQ ID NO: 149573 - RNA, 18 nt, Artificial Sequence
  Description of Artificial Sequence: Synthetic oligonucleotide
aaacagcacagaacauaa

SEQ ID NO: 149574 - RNA, 18 nt, Artificial Sequence
  Description of Artificial Sequence: Synthetic oligonucleotide
uugugaaacagcacagaa

SEQ ID NO: 149575 - RNA, 18 nt, Artificial Sequence
  Description of Artificial Sequence: Synthetic oligonucleotide
cugccuugugaaacagca

SEQ ID NO: 149576 - RNA, 18 nt, Artificial Sequence
  Description of Artificial Sequence: Synthetic oligonucleotide
uucuucugccuugugaaa

SEQ ID NO: 149577 - RNA, 18 nt, Artificial Sequence
  Description of Artificial Sequence: Synthetic oligonucleotide
cucucuucuucugccuug

SEQ ID NO: 149578 - RNA, 18 nt, Artificial Sequence
  Description of Artificial Sequence: Synthetic oligonucleotide
uaccccucucuucuucug

SEQ ID NO: 149579 - RNA, 18 nt, Artificial Sequence
  Description of Artificial Sequence: Synthetic oligonucleotide
agaauuaccccucucuuc

SEQ ID NO: 149580 - RNA, 18 nt, Artificial Sequence
  Description of Artificial Sequence: Synthetic oligonucleotide
aaaacagaauuaccccuc

SEQ ID NO: 149581 - RNA, 18 nt, Artificial Sequence
  Description of Artificial Sequence: Synthetic oligonucleotide
acacaaaaacagaauuac

SEQ ID NO: 149582 - RNA, 18 nt, Artificial Sequence
  Description of Artificial Sequence: Synthetic oligonucleotide
ugucguauuugcggacaa

SEQ ID NO: 149583 - RNA, 18 nt, Artificial Sequence
  Description of Artificial Sequence: Synthetic oligonucleotide
cuggaugucguauuugcg

SEQ ID NO: 149584 - RNA, 18 nt, Artificial Sequence
  Description of Artificial Sequence: Synthetic oligonucleotide
guggccuggaugucguau

SEQ ID NO: 149585 - RNA, 18 nt, Artificial Sequence
  Description of Artificial Sequence: Synthetic oligonucleotide
ugucuguggccuggaugu

SEQ ID NO: 149586 - RNA, 18 nt, Artificial Sequence
  Description of Artificial Sequence: Synthetic oligonucleotide
cucauugucuguggccug

SEQ ID NO: 149587 - RNA, 18 nt, Artificial Sequence
  Description of Artificial Sequence: Synthetic oligonucleotide
acaggcucauugucugug

SEQ ID NO: 149588 - RNA, 18 nt, Artificial Sequence
  Description of Artificial Sequence: Synthetic oligonucleotide
ucucaacaggcucauugu

SEQ ID NO: 149589 - RNA, 18 nt, Artificial Sequence
  Description of Artificial Sequence: Synthetic oligonucleotide
uagcaucucaacaggcuc

SEQ ID NO: 149590 - RNA, 18 nt, Artificial Sequence
  Description of Artificial Sequence: Synthetic oligonucleotide
gaguguagcaucucaaca

SEQ ID NO: 149591 - RNA, 18 nt, Artificial Sequence
  Description of Artificial Sequence: Synthetic oligonucleotide
ugccugaguguagcaucu

SEQ ID NO: 149592 - RNA, 18 nt, Artificial Sequence
  Description of Artificial Sequence: Synthetic oligonucleotide
cagggugccugaguguag

SEQ ID NO: 149593 - RNA, 18 nt, Artificial Sequence
  Description of Artificial Sequence: Synthetic oligonucleotide
ggcaccagggugccugag

SEQ ID NO: 149594 - RNA, 18 nt, Artificial Sequence
  Description of Artificial Sequence: Synthetic oligonucleotide
ggcugggcaccagggugc

SEQ ID NO: 149595 - RNA, 18 nt, Artificial Sequence
  Description of Artificial Sequence: Synthetic oligonucleotide
uucccggcugggcaccag

SEQ ID NO: 149596 - RNA, 18 nt, Artificial Sequence
  Description of Artificial Sequence: Synthetic oligonucleotide
gggaguucccggcugggc

SEQ ID NO: 149597 - RNA, 18 nt, Artificial Sequence
  Description of Artificial Sequence: Synthetic oligonucleotide
aucgcuggcaaaacgcga

SEQ ID NO: 149598 - RNA, 18 nt, Artificial Sequence
  Description of Artificial Sequence: Synthetic oligonucleotide
guauuaucgcuggcaaaa

SEQ ID NO: 149599 - RNA, 18 nt, Artificial Sequence
  Description of Artificial Sequence: Synthetic oligonucleotide
gaggcguauuaucgcugg

SEQ ID NO: 149600 - RNA, 18 nt, Artificial Sequence
  Description of Artificial Sequence: Synthetic oligonucleotide
ugucguauuugcggacaa

SEQ ID NO: 149601 - RNA, 18 nt, Artificial Sequence
  Description of Artificial Sequence: Synthetic oligonucleotide
cuggaugucguauuugcg

SEQ ID NO: 149602 - RNA, 18 nt, Artificial Sequence
  Description of Artificial Sequence: Synthetic oligonucleotide
guggccuggaugucguau

SEQ ID NO: 149603 - RNA, 18 nt, Artificial Sequence
  Description of Artificial Sequence: Synthetic oligonucleotide
ugucuguggccuggaugu

SEQ ID NO: 149604 - RNA, 18 nt, Artificial Sequence
  Description of Artificial Sequence: Synthetic oligonucleotide
cucauugucuguggccug

SEQ ID NO: 149605 - RNA, 18 nt, Artificial Sequence
  Description of Artificial Sequence: Synthetic oligonucleotide
acaggcucauugucugug

SEQ ID NO: 149606 - RNA, 18 nt, Artificial Sequence
  Description of Artificial Sequence: Synthetic oligonucleotide
ucucaacaggcucauugu

SEQ ID NO: 149607 - RNA, 18 nt, Artificial Sequence
  Description of Artificial Sequence: Synthetic oligonucleotide
uagcaucucaacaggcuc

SEQ ID NO: 149608 - RNA, 18 nt, Artificial Sequence
  Description of Artificial Sequence: Synthetic oligonucleotide
gaguguagcaucucaaca

SEQ ID NO: 149609 - RNA, 18 nt, Artificial Sequence
  Description of Artificial Sequence: Synthetic oligonucleotide
ugccugaguguagcaucu

SEQ ID NO: 149610 - RNA, 18 nt, Artificial Sequence
  Description of Artificial Sequence: Synthetic oligonucleotide
cagggugccugaguguag

SEQ ID NO: 149611 - RNA, 18 nt, Artificial Sequence
  Description of Artificial Sequence: Synthetic oligonucleotide
ggcaccagggugccugag

SEQ ID NO: 149612 - RNA, 18 nt, Artificial Sequence
  Description of Artificial Sequence: Synthetic oligonucleotide
ggcugggcaccagggugc

SEQ ID NO: 149613 - RNA, 18 nt, Artificial Sequence
  Description of Artificial Sequence: Synthetic oligonucleotide
uucccggcugggcaccag

SEQ ID NO: 149614 - RNA, 18 nt, Artificial Sequence
  Description of Artificial Sequence: Synthetic oligonucleotide
gggaguucccggcugggc

SEQ ID NO: 149615 - RNA, 18 nt, Artificial Sequence
  Description of Artificial Sequence: Synthetic oligonucleotide
cuggcaaaacgcgauggg

SEQ ID NO: 149616 - RNA, 18 nt, Artificial Sequence
  Description of Artificial Sequence: Synthetic oligonucleotide
ucgcuggcaaaacgcgau

SEQ ID NO: 149617 - RNA, 18 nt, Artificial Sequence
  Description of Artificial Sequence: Synthetic oligonucleotide
uauuaucgcuggcaaaac

SEQ ID NO: 149618 - RNA, 18 nt, Artificial Sequence
  Description of Artificial Sequence: Synthetic oligonucleotide
aggcguauuaucgcuggc

SEQ ID NO: 149619 - RNA, 18 nt, Artificial Sequence
  Description of Artificial Sequence: Synthetic oligonucleotide
uaaugaaccgccuagaug

SEQ ID NO: 149620 - RNA, 18 nt, Artificial Sequence
  Description of Artificial Sequence: Synthetic oligonucleotide
gaggauaaugaaccgccu

SEQ ID NO: 149621 - RNA, 18 nt, Artificial Sequence
  Description of Artificial Sequence: Synthetic oligonucleotide
uugcagaggauaaugaac

SEQ ID NO: 149622 - RNA, 18 nt, Artificial Sequence
  Description of Artificial Sequence: Synthetic oligonucleotide
cuaccuugcagaggauaa

SEQ ID NO: 149623 - RNA, 18 nt, Artificial Sequence
  Description of Artificial Sequence: Synthetic oligonucleotide
ucucacuaccuugcagag

SEQ ID NO: 149624 - RNA, 18 nt, Artificial Sequence
  Description of Artificial Sequence: Synthetic oligonucleotide
gucauucucacuaccuug

SEQ ID NO: 149625 - RNA, 18 nt, Artificial Sequence
  Description of Artificial Sequence: Synthetic oligonucleotide
cccucgucauucucacua

SEQ ID NO: 149626 - RNA, 18 nt, Artificial Sequence
  Description of Artificial Sequence: Synthetic oligonucleotide
cucaucccucgucauucu

SEQ ID NO: 149627 - RNA, 18 nt, Artificial Sequence
  Description of Artificial Sequence: Synthetic oligonucleotide
cauagcucaucccucguc

SEQ ID NO: 149628 - RNA, 18 nt, Artificial Sequence
  Description of Artificial Sequence: Synthetic oligonucleotide
cccagcauagcucauccc

SEQ ID NO: 149629 - RNA, 18 nt, Artificial Sequence
  Description of Artificial Sequence: Synthetic oligonucleotide
gacuucccagcauagcuc

SEQ ID NO: 149630 - RNA, 18 nt, Artificial Sequence
  Description of Artificial Sequence: Synthetic oligonucleotide
uggcugacuucccagcau

SEQ ID NO: 149631 - RNA, 18 nt, Artificial Sequence
  Description of Artificial Sequence: Synthetic oligonucleotide
cagucuggcugacuuccc

SEQ ID NO: 149632 - RNA, 18 nt, Artificial Sequence
  Description of Artificial Sequence: Synthetic oligonucleotide
aaccccagucuggcugac

SEQ ID NO: 149633 - RNA, 18 nt, Artificial Sequence
  Description of Artificial Sequence: Synthetic oligonucleotide
auucaaaccccagucugg

SEQ ID NO: 149634 - RNA, 18 nt, Artificial Sequence
  Description of Artificial Sequence: Synthetic oligonucleotide
cugggauucaaaccccag

SEQ ID NO: 149635 - RNA, 18 nt, Artificial Sequence
  Description of Artificial Sequence: Synthetic oligonucleotide
gugagcugggauucaaac

SEQ ID NO: 149636 - RNA, 18 nt, Artificial Sequence
  Description of Artificial Sequence: Synthetic oligonucleotide
uagaggugagcugggauu

SEQ ID NO: 149637 - RNA, 18 nt, Artificial Sequence
  Description of Artificial Sequence: Synthetic oligonucleotide
caaguuagaggugagcug

SEQ ID NO: 149638 - RNA, 18 nt, Artificial Sequence
  Description of Artificial Sequence: Synthetic oligonucleotide
cccagcaaguuagaggug

SEQ ID NO: 149639 - RNA, 18 nt, Artificial Sequence
  Description of Artificial Sequence: Synthetic oligonucleotide
ggucacccagcaaguuag

SEQ ID NO: 149640 - RNA, 18 nt, Artificial Sequence
  Description of Artificial Sequence: Synthetic oligonucleotide
cucaaggucacccagcaa

SEQ ID NO: 149641 - RNA, 18 nt, Artificial Sequence
  Description of Artificial Sequence: Synthetic oligonucleotide
aacugcucaaggucaccc

SEQ ID NO: 149642 - RNA, 18 nt, Artificial Sequence
  Description of Artificial Sequence: Synthetic oligonucleotide
uagggaacugcucaaggu

SEQ ID NO: 149643 - RNA, 18 nt, Artificial Sequence
  Description of Artificial Sequence: Synthetic oligonucleotide
gaguuuagggaacugcuc

SEQ ID NO: 149644 - RNA, 18 nt, Artificial Sequence
  Description of Artificial Sequence: Synthetic oligonucleotide
guagagaguuuagggaac

SEQ ID NO: 149645 - RNA, 18 nt, Artificial Sequence
  Description of Artificial Sequence: Synthetic oligonucleotide
aggaaguagagaguuuag

SEQ ID NO: 149646 - RNA, 18 nt, Artificial Sequence
  Description of Artificial Sequence: Synthetic oligonucleotide
aaaaaaggaaguagagag

SEQ ID NO: 149647 - RNA, 18 nt, Artificial Sequence
  Description of Artificial Sequence: Synthetic oligonucleotide
aaaaaaaaaaaggaagua

SEQ ID NO: 149648 - RNA, 18 nt, Artificial Sequence
  Description of Artificial Sequence: Synthetic oligonucleotide
aaaugaaaaaaaaaaagg

SEQ ID NO: 149649 - RNA, 18 nt, Artificial Sequence
  Description of Artificial Sequence: Synthetic oligonucleotide
uuuacaaaugaaaaaaaa

SEQ ID NO: 149650 - RNA, 18 nt, Artificial Sequence
  Description of Artificial Sequence: Synthetic oligonucleotide
aucauuuuacaaaugaaa

SEQ ID NO: 149651 - RNA, 18 nt, Artificial Sequence
  Description of Artificial Sequence: Synthetic oligonucleotide
gggucaucauuuuacaaa

SEQ ID NO: 149652 - RNA, 18 nt, Artificial Sequence
  Description of Artificial Sequence: Synthetic oligonucleotide
ucuuugggucaucauuuu

SEQ ID NO: 149653 - RNA, 18 nt, Artificial Sequence
  Description of Artificial Sequence: Synthetic oligonucleotide
cacucucuuugggucauc

SEQ ID NO: 149654 - RNA, 18 nt, Artificial Sequence
  Description of Artificial Sequence: Synthetic oligonucleotide
ugauacacucucuuuggg

SEQ ID NO: 149655 - RNA, 18 nt, Artificial Sequence
  Description of Artificial Sequence: Synthetic oligonucleotide
uuuugugauacacucucu

SEQ ID NO: 149656 - RNA, 18 nt, Artificial Sequence
  Description of Artificial Sequence: Synthetic oligonucleotide
uaaauuuuugugauacac

SEQ ID NO: 149657 - RNA, 18 nt, Artificial Sequence
  Description of Artificial Sequence: Synthetic oligonucleotide
cauauuaaauuuuuguga

SEQ ID NO: 149658 - RNA, 18 nt, Artificial Sequence
  Description of Artificial Sequence: Synthetic oligonucleotide
guauucauauuaaauuuu

SEQ ID NO: 149659 - RNA, 18 nt, Artificial Sequence
  Description of Artificial Sequence: Synthetic oligonucleotide
acuugguauucauauuaa

SEQ ID NO: 149660 - RNA, 18 nt, Artificial Sequence
  Description of Artificial Sequence: Synthetic oligonucleotide
uaacuacuugguauucau

SEQ ID NO: 149661 - RNA, 18 nt, Artificial Sequence
  Description of Artificial Sequence: Synthetic oligonucleotide
aggaauaacuacuuggua

SEQ ID NO: 149662 - RNA, 18 nt, Artificial Sequence
  Description of Artificial Sequence: Synthetic oligonucleotide
ggcucaggaauaacuacu

SEQ ID NO: 149663 - RNA, 18 nt, Artificial Sequence
  Description of Artificial Sequence: Synthetic oligonucleotide
ugccaggcucaggaauaa

SEQ ID NO: 149664 - RNA, 18 nt, Artificial Sequence
  Description of Artificial Sequence: Synthetic oligonucleotide
auugaugccaggcucagg

SEQ ID NO: 149665 - RNA, 18 nt, Artificial Sequence
  Description of Artificial Sequence: Synthetic oligonucleotide
acuuaauugaugccaggc

SEQ ID NO: 149666 - RNA, 18 nt, Artificial Sequence
  Description of Artificial Sequence: Synthetic oligonucleotide
ugaacacuuaauugaugc

SEQ ID NO: 149667 - RNA, 18 nt, Artificial Sequence
  Description of Artificial Sequence: Synthetic oligonucleotide
uuuacugaacacuuaauu

SEQ ID NO: 149668 - RNA, 18 nt, Artificial Sequence
  Description of Artificial Sequence: Synthetic oligonucleotide
uagcauuuacugaacacu

SEQ ID NO: 149669 - RNA, 18 nt, Artificial Sequence
  Description of Artificial Sequence: Synthetic oligonucleotide
gcugcuagcauuuacuga

SEQ ID NO: 149670 - RNA, 18 nt, Artificial Sequence
  Description of Artificial Sequence: Synthetic oligonucleotide
gaacagcugcuagcauuu

SEQ ID NO: 149671 - RNA, 18 nt, Artificial Sequence
  Description of Artificial Sequence: Synthetic oligonucleotide
accaugaacagcugcuag

SEQ ID NO: 149672 - RNA, 18 nt, Artificial Sequence
  Description of Artificial Sequence: Synthetic oligonucleotide
caaaaaccaugaacagcu

SEQ ID NO: 149673 - RNA, 18 nt, Artificial Sequence
  Description of Artificial Sequence: Synthetic oligonucleotide
acaugcaaaaaccaugaa

SEQ ID NO: 149674 - RNA, 18 nt, Artificial Sequence
  Description of Artificial Sequence: Synthetic oligonucleotide
uauucacaugcaaaaacc

SEQ ID NO: 149675 - RNA, 18 nt, Artificial Sequence
  Description of Artificial Sequence: Synthetic oligonucleotide
cuuacuauucacaugcaa

SEQ ID NO: 149676 - RNA, 18 nt, Artificial Sequence
  Description of Artificial Sequence: Synthetic oligonucleotide
caacccuuacuauucaca

SEQ ID NO: 149677 - RNA, 18 nt, Artificial Sequence
  Description of Artificial Sequence: Synthetic oligonucleotide
uuugccaacccuuacuau

SEQ ID NO: 149678 - RNA, 18 nt, Artificial Sequence
  Description of Artificial Sequence: Synthetic oligonucleotide
aaaaguuugccaacccuu

SEQ ID NO: 149679 - RNA, 18 nt, Artificial Sequence
  Description of Artificial Sequence: Synthetic oligonucleotide
acggaaaaaguuugccaa

SEQ ID NO: 149680 - RNA, 18 nt, Artificial Sequence
  Description of Artificial Sequence: Synthetic oligonucleotide
ccuuuacggaaaaaguuu

SEQ ID NO: 149681 - RNA, 18 nt, Artificial Sequence
  Description of Artificial Sequence: Synthetic oligonucleotide
cuggcccuuuacggaaaa

SEQ ID NO: 149682 - RNA, 18 nt, Artificial Sequence
  Description of Artificial Sequence: Synthetic oligonucleotide
gccaacuggcccuuuacg

SEQ ID NO: 149683 - RNA, 18 nt, Artificial Sequence
  Description of Artificial Sequence: Synthetic oligonucleotide
uauuugccaacuggcccu

SEQ ID NO: 149684 - RNA, 18 nt, Artificial Sequence
  Description of Artificial Sequence: Synthetic oligonucleotide
uaaaauauuugccaacug

SEQ ID NO: 149685 - RNA, 18 nt, Artificial Sequence
  Description of Artificial Sequence: Synthetic oligonucleotide
aaaccuaaaauauuugcc

SEQ ID NO: 149686 - RNA, 18 nt, Artificial Sequence
  Description of Artificial Sequence: Synthetic oligonucleotide
ccauaaaaccuaaaauau

SEQ ID NO: 149687 - RNA, 18 nt, Artificial Sequence
  Description of Artificial Sequence: Synthetic oligonucleotide
augguccauaaaaccuaa

SEQ ID NO: 149688 - RNA, 18 nt, Artificial Sequence
  Description of Artificial Sequence: Synthetic oligonucleotide
acuguaugguccauaaaa

SEQ ID NO: 149689 - RNA, 18 nt, Artificial Sequence
  Description of Artificial Sequence: Synthetic oligonucleotide
caaagacuguauggucca

SEQ ID NO: 149690 - RNA, 18 nt, Artificial Sequence
  Description of Artificial Sequence: Synthetic oligonucleotide
ugugacaaagacuguaug

SEQ ID NO: 149691 - RNA, 18 nt, Artificial Sequence
  Description of Artificial Sequence: Synthetic oligonucleotide
gaggaugugacaaagacu

SEQ ID NO: 149692 - RNA, 18 nt, Artificial Sequence
  Description of Artificial Sequence: Synthetic oligonucleotide
auuaagaggaugugacaa

SEQ ID NO: 149693 - RNA, 18 nt, Artificial Sequence
  Description of Artificial Sequence: Synthetic oligonucleotide
guaguauuaagaggaugu

SEQ ID NO: 149694 - RNA, 18 nt, Artificial Sequence
  Description of Artificial Sequence: Synthetic oligonucleotide
ccaagguaguauuaagag

SEQ ID NO: 149695 - RNA, 18 nt, Artificial Sequence
  Description of Artificial Sequence: Synthetic oligonucleotide
auguuccaagguaguauu

SEQ ID NO: 149696 - RNA, 18 nt, Artificial Sequence
  Description of Artificial Sequence: Synthetic oligonucleotide
cuuucauguuccaaggua

SEQ ID NO: 149697 - RNA, 18 nt, Artificial Sequence
  Description of Artificial Sequence: Synthetic oligonucleotide
ggcugcuuucauguucca

SEQ ID NO: 149698 - RNA, 18 nt, Artificial Sequence
  Description of Artificial Sequence: Synthetic oligonucleotide
ccuguggcugcuuucaug

SEQ ID NO: 149699 - RNA, 18 nt, Artificial Sequence
  Description of Artificial Sequence: Synthetic oligonucleotide
aauugccuguggcugcuu

SEQ ID NO: 149700 - RNA, 18 nt, Artificial Sequence
  Description of Artificial Sequence: Synthetic oligonucleotide
uuacaaauugccuguggc

SEQ ID NO: 149701 - RNA, 18 nt, Artificial Sequence
  Description of Artificial Sequence: Synthetic oligonucleotide
uuaguuuacaaauugccu

SEQ ID NO: 149702 - RNA, 18 nt, Artificial Sequence
  Description of Artificial Sequence: Synthetic oligonucleotide
acucauuaguuuacaaau

SEQ ID NO: 149703 - RNA, 18 nt, Artificial Sequence
  Description of Artificial Sequence: Synthetic oligonucleotide
agcucacucauuaguuua

SEQ ID NO: 149704 - RNA, 18 nt, Artificial Sequence
  Description of Artificial Sequence: Synthetic oligonucleotide
acaucagcucacucauua

SEQ ID NO: 149705 - RNA, 18 nt, Artificial Sequence
  Description of Artificial Sequence: Synthetic oligonucleotide
cuaggacaucagcucacu

SEQ ID NO: 149706 - RNA, 18 nt, Artificial Sequence
  Description of Artificial Sequence: Synthetic oligonucleotide
gaaagcuaggacaucagc

SEQ ID NO: 149707 - RNA, 18 nt, Artificial Sequence
  Description of Artificial Sequence: Synthetic oligonucleotide
caauagaaagcuaggaca

SEQ ID NO: 149708 - RNA, 18 nt, Artificial Sequence
  Description of Artificial Sequence: Synthetic oligonucleotide
ggcagcaauagaaagcua

SEQ ID NO: 149709 - RNA, 18 nt, Artificial Sequence
  Description of Artificial Sequence: Synthetic oligonucleotide
gcgguggcagcaauagaa

SEQ ID NO: 149710 - RNA, 18 nt, Artificial Sequence
  Description of Artificial Sequence: Synthetic oligonucleotide
aauuugcgguggcagcaa

SEQ ID NO: 149711 - RNA, 18 nt, Artificial Sequence
  Description of Artificial Sequence: Synthetic oligonucleotide
uuaguaauuugcgguggc

SEQ ID NO: 149712 - RNA, 18 nt, Artificial Sequence
  Description of Artificial Sequence: Synthetic oligonucleotide
aaguuuuaguaauuugcg

SEQ ID NO: 149713 - RNA, 18 nt, Artificial Sequence
  Description of Artificial Sequence: Synthetic oligonucleotide
ucacuaaguuuuaguaau

SEQ ID NO: 149714 - RNA, 18 nt, Artificial Sequence
  Description of Artificial Sequence: Synthetic oligonucleotide
guaacucacuaaguuuua

SEQ ID NO: 149715 - RNA, 18 nt, Artificial Sequence
  Description of Artificial Sequence: Synthetic oligonucleotide
gucguguaacucacuaag

SEQ ID NO: 149716 - RNA, 18 nt, Artificial Sequence
  Description of Artificial Sequence: Synthetic oligonucleotide
ugugugucguguaacuca

SEQ ID NO: 149717 - RNA, 18 nt, Artificial Sequence
  Description of Artificial Sequence: Synthetic oligonucleotide
auagaugugugucgugua

SEQ ID NO: 149718 - RNA, 18 nt, Artificial Sequence
  Description of Artificial Sequence: Synthetic oligonucleotide
caucuguaauugcauguu

SEQ ID NO: 149719 - RNA, 18 nt, Artificial Sequence
  Description of Artificial Sequence: Synthetic oligonucleotide
aauuucaucuguaauugc

SEQ ID NO: 149720 - RNA, 18 nt, Artificial Sequence
  Description of Artificial Sequence: Synthetic oligonucleotide
ucagaaauuucaucugua

SEQ ID NO: 149721 - RNA, 18 nt, Artificial Sequence
  Description of Artificial Sequence: Synthetic oligonucleotide
cuuguucagaaauuucau

SEQ ID NO: 149722 - RNA, 18 nt, Artificial Sequence
  Description of Artificial Sequence: Synthetic oligonucleotide
ugggccuuguucagaaau

SEQ ID NO: 149723 - RNA, 18 nt, Artificial Sequence
  Description of Artificial Sequence: Synthetic oligonucleotide
ucauuugggccuuguuca

SEQ ID NO: 149724 - RNA, 18 nt, Artificial Sequence
  Description of Artificial Sequence: Synthetic oligonucleotide
uguauucauuugggccuu

SEQ ID NO: 149725 - RNA, 18 nt, Artificial Sequence
  Description of Artificial Sequence: Synthetic oligonucleotide
aauaauguauucauuugg

SEQ ID NO: 149726 - RNA, 18 nt, Artificial Sequence
  Description of Artificial Sequence: Synthetic oligonucleotide
ggaauaauaauguauuca

SEQ ID NO: 149727 - RNA, 18 nt, Artificial Sequence
  Description of Artificial Sequence: Synthetic oligonucleotide
guggaggaauaauaaugu

SEQ ID NO: 149728 - RNA, 18 nt, Artificial Sequence
  Description of Artificial Sequence: Synthetic oligonucleotide
acuugguggaggaauaau

SEQ ID NO: 149729 - RNA, 18 nt, Artificial Sequence
  Description of Artificial Sequence: Synthetic oligonucleotide
cagacacuugguggagga

SEQ ID NO: 149730 - RNA, 18 nt, Artificial Sequence
  Description of Artificial Sequence: Synthetic oligonucleotide
agcaucagacacuuggug

SEQ ID NO: 149731 - RNA, 18 nt, Artificial Sequence
  Description of Artificial Sequence: Synthetic oligonucleotide
auaauagcaucagacacu

SEQ ID NO: 149732 - RNA, 18 nt, Artificial Sequence
  Description of Artificial Sequence: Synthetic oligonucleotide
auuucauaauagcaucag

SEQ ID NO: 149733 - RNA, 18 nt, Artificial Sequence
  Description of Artificial Sequence: Synthetic oligonucleotide
gacaaauuucauaauagc

SEQ ID NO: 149734 - RNA, 18 nt, Artificial Sequence
  Description of Artificial Sequence: Synthetic oligonucleotide
aauuugacaaauuucaua

SEQ ID NO: 149735 - RNA, 18 nt, Artificial Sequence
  Description of Artificial Sequence: Synthetic oligonucleotide
cucagaauuugacaaauu

SEQ ID NO: 149736 - RNA, 18 nt, Artificial Sequence
  Description of Artificial Sequence: Synthetic oligonucleotide
ggaugcucagaauuugac

SEQ ID NO: 149737 - RNA, 18 nt, Artificial Sequence
  Description of Artificial Sequence: Synthetic oligonucleotide
gguugggaugcucagaau

SEQ ID NO: 149738 - RNA, 18 nt, Artificial Sequence
  Description of Artificial Sequence: Synthetic oligonucleotide
cuguugguugggaugcuc

SEQ ID NO: 149739 - RNA, 18 nt, Artificial Sequence
  Description of Artificial Sequence: Synthetic oligonucleotide
caguucuguugguuggga

SEQ ID NO: 149740 - RNA, 18 nt, Artificial Sequence
  Description of Artificial Sequence: Synthetic oligonucleotide
ugauucaguucuguuggu

SEQ ID NO: 149741 - RNA, 18 nt, Artificial Sequence
  Description of Artificial Sequence: Synthetic oligonucleotide
cuacuugauucaguucug

SEQ ID NO: 149742 - RNA, 18 nt, Artificial Sequence
  Description of Artificial Sequence: Synthetic oligonucleotide
uuacccuacuugauucag

SEQ ID NO: 149743 - RNA, 18 nt, Artificial Sequence
  Description of Artificial Sequence: Synthetic oligonucleotide
uuuccuuacccuacuuga

SEQ ID NO: 149744 - RNA, 18 nt, Artificial Sequence
  Description of Artificial Sequence: Synthetic oligonucleotide
aauacuuuccuuacccua

SEQ ID NO: 149745 - RNA, 18 nt, Artificial Sequence
  Description of Artificial Sequence: Synthetic oligonucleotide
gcuagaauacuuuccuua

SEQ ID NO: 149746 - RNA, 18 nt, Artificial Sequence
  Description of Artificial Sequence: Synthetic oligonucleotide
augcagcuagaauacuuu

SEQ ID NO: 149747 - RNA, 18 nt, Artificial Sequence
  Description of Artificial Sequence: Synthetic oligonucleotide
ucacaaugcagcuagaau

SEQ ID NO: 149748 - RNA, 18 nt, Artificial Sequence
  Description of Artificial Sequence: Synthetic oligonucleotide
gggugucacaaugcagcu

SEQ ID NO: 149749 - RNA, 18 nt, Artificial Sequence
  Description of Artificial Sequence: Synthetic oligonucleotide
ucuuugcugaaggcuggg

SEQ ID NO: 149750 - RNA, 18 nt, Artificial Sequence
  Description of Artificial Sequence: Synthetic oligonucleotide
ugcucuuugcugaaggcu

SEQ ID NO: 149751 - RNA, 18 nt, Artificial Sequence
  Description of Artificial Sequence: Synthetic oligonucleotide
augcaugcucuuugcuga

SEQ ID NO: 149752 - RNA, 18 nt, Artificial Sequence
  Description of Artificial Sequence: Synthetic oligonucleotide
uaaacaugcaugcucuuu

SEQ ID NO: 149753 - RNA, 18 nt, Artificial Sequence
  Description of Artificial Sequence: Synthetic oligonucleotide
ugugauaaacaugcaugc

SEQ ID NO: 149754 - RNA, 18 nt, Artificial Sequence
  Description of Artificial Sequence: Synthetic oligonucleotide
cuuacugugauaaacaug

SEQ ID NO: 149755 - RNA, 18 nt, Artificial Sequence
  Description of Artificial Sequence: Synthetic oligonucleotide
uguggcuuacugugauaa

SEQ ID NO: 149756 - RNA, 18 nt, Artificial Sequence
  Description of Artificial Sequence: Synthetic oligonucleotide
aaagguguggcuuacugu

SEQ ID NO: 149757 - RNA, 18 nt, Artificial Sequence
  Description of Artificial Sequence: Synthetic oligonucleotide
acuuaaaagguguggcuu

SEQ ID NO: 149758 - RNA, 18 nt, Artificial Sequence
  Description of Artificial Sequence: Synthetic oligonucleotide
cuaaaacuuaaaaggugu

SEQ ID NO: 149759 - RNA, 18 nt, Artificial Sequence
  Description of Artificial Sequence: Synthetic oligonucleotide
aaaugcuaaaacuuaaaa

SEQ ID NO: 149760 - RNA, 18 nt, Artificial Sequence
  Description of Artificial Sequence: Synthetic oligonucleotide
agaaaaaaugcuaaaacu

SEQ ID NO: 149761 - RNA, 18 nt, Artificial Sequence
  Description of Artificial Sequence: Synthetic oligonucleotide
gccaaagaaaaaaugcua

SEQ ID NO: 149762 - RNA, 18 nt, Artificial Sequence
  Description of Artificial Sequence: Synthetic oligonucleotide
uauuagccaaagaaaaaa

SEQ ID NO: 149763 - RNA, 18 nt, Artificial Sequence
  Description of Artificial Sequence: Synthetic oligonucleotide
caaauuauuagccaaaga

SEQ ID NO: 149764 - RNA, 18 nt, Artificial Sequence
  Description of Artificial Sequence: Synthetic oligonucleotide
caagacaaauuauuagcc

SEQ ID NO: 149765 - RNA, 18 nt, Artificial Sequence
  Description of Artificial Sequence: Synthetic oligonucleotide
uuaaacaagacaaauuau

SEQ ID NO: 149766 - RNA, 18 nt, Artificial Sequence
  Description of Artificial Sequence: Synthetic oligonucleotide
uguauuuaaacaagacaa

SEQ ID NO: 149767 - RNA, 18 nt, Artificial Sequence
  Description of Artificial Sequence: Synthetic oligonucleotide
agaaguguauuuaaacaa

SEQ ID NO: 149768 - RNA, 18 nt, Artificial Sequence
  Description of Artificial Sequence: Synthetic oligonucleotide
aucaaagaaguguauuua

SEQ ID NO: 149769 - RNA, 18 nt, Artificial Sequence
  Description of Artificial Sequence: Synthetic oligonucleotide
uguauaucaaagaagugu

SEQ ID NO: 149770 - RNA, 18 nt, Artificial Sequence
  Description of Artificial Sequence: Synthetic oligonucleotide
cuaauuguauaucaaaga

SEQ ID NO: 149771 - RNA, 18 nt, Artificial Sequence
  Description of Artificial Sequence: Synthetic oligonucleotide
auacccuaauuguauauc

SEQ ID NO: 149772 - RNA, 18 nt, Artificial Sequence
  Description of Artificial Sequence: Synthetic oligonucleotide
aagguauacccuaauugu

SEQ ID NO: 149773 - RNA, 18 nt, Artificial Sequence
  Description of Artificial Sequence: Synthetic oligonucleotide
aaaaaaagguauacccua

SEQ ID NO: 149774 - RNA, 18 nt, Artificial Sequence
  Description of Artificial Sequence: Synthetic oligonucleotide
aaaaaaaaaaaagguaua

SEQ ID NO: 149775 - RNA, 18 nt, Artificial Sequence
  Description of Artificial Sequence: Synthetic oligonucleotide
aaaaaaaaaaaaaaaaag

SEQ ID NO: 149776 - RNA, 18 nt, Artificial Sequence
  Description of Artificial Sequence: Synthetic oligonucleotide
aaaaaaaaaaaaaaaaaa

SEQ ID NO: 149777 - RNA, 18 nt, Artificial Sequence
  Description of Artificial Sequence: Synthetic oligonucleotide
aaaaaaaaaaaaaaaaaa

SEQ ID NO: 149778 - RNA, 18 nt, Artificial Sequence
  Description of Artificial Sequence: Synthetic oligonucleotide
aaaaaaaaaaaaaaaaaa

SEQ ID NO: 149779 - RNA, 18 nt, Artificial Sequence
  Description of Artificial Sequence: Synthetic oligonucleotide
aaaaaaaaaaaaaaaaaa

SEQ ID NO: 149780 - RNA, 18 nt, Artificial Sequence
  Description of Artificial Sequence: Synthetic oligonucleotide
aaaaaaaaaaaaaaaaaa

SEQ ID NO: 149781 - RNA, 18 nt, Artificial Sequence
  Description of Artificial Sequence: Synthetic oligonucleotide
gguaaaaaaaaaaaaaaa

SEQ ID NO: 149782 - RNA, 18 nt, Artificial Sequence
  Description of Artificial Sequence: Synthetic oligonucleotide
gucuugguaaaaaaaaaa

SEQ ID NO: 149783 - RNA, 18 nt, Artificial Sequence
  Description of Artificial Sequence: Synthetic oligonucleotide
uuuuggucuugguaaaaa

SEQ ID NO: 149784 - RNA, 18 nt, Artificial Sequence
  Description of Artificial Sequence: Synthetic oligonucleotide
ggcuguuuuggucuuggu

SEQ ID NO: 149785 - RNA, 18 nt, Artificial Sequence
  Description of Artificial Sequence: Synthetic oligonucleotide
gaaauggcuguuuugguc

SEQ ID NO: 149786 - RNA, 18 nt, Artificial Sequence
  Description of Artificial Sequence: Synthetic oligonucleotide
aaguugaaauggcuguuu

SEQ ID NO: 149787 - RNA, 18 nt, Artificial Sequence
  Description of Artificial Sequence: Synthetic oligonucleotide
cagaaaaguugaaauggc

SEQ ID NO: 149788 - RNA, 18 nt, Artificial Sequence
  Description of Artificial Sequence: Synthetic oligonucleotide
ucuugcagaaaaguugaa

SEQ ID NO: 149789 - RNA, 18 nt, Artificial Sequence
  Description of Artificial Sequence: Synthetic oligonucleotide
accauucuugcagaaaag

SEQ ID NO: 149790 - RNA, 18 nt, Artificial Sequence
  Description of Artificial Sequence: Synthetic oligonucleotide
uaagcaccauucuugcag

SEQ ID NO: 149791 - RNA, 18 nt, Artificial Sequence
  Description of Artificial Sequence: Synthetic oligonucleotide
agccauaagcaccauucu

SEQ ID NO: 149792 - RNA, 18 nt, Artificial Sequence
  Description of Artificial Sequence: Synthetic oligonucleotide
guagaagccauaagcacc

SEQ ID NO: 149793 - RNA, 18 nt, Artificial Sequence
  Description of Artificial Sequence: Synthetic oligonucleotide
guaacguagaagccauaa

SEQ ID NO: 149794 - RNA, 18 nt, Artificial Sequence
  Description of Artificial Sequence: Synthetic oligonucleotide
uuccgguaacguagaagc

SEQ ID NO: 149795 - RNA, 18 nt, Artificial Sequence
  Description of Artificial Sequence: Synthetic oligonucleotide
uugcuuuccgguaacgua

SEQ ID NO: 149796 - RNA, 18 nt, Artificial Sequence
  Description of Artificial Sequence: Synthetic oligonucleotide
gaaguuugcuuuccggua

SEQ ID NO: 149797 - RNA, 18 nt, Artificial Sequence
  Description of Artificial Sequence: Synthetic oligonucleotide
uguuugaaguuugcuuuc

SEQ ID NO: 149798 - RNA, 18 nt, Artificial Sequence
  Description of Artificial Sequence: Synthetic oligonucleotide
ugugguguuugaaguuug

SEQ ID NO: 149799 - RNA, 18 nt, Artificial Sequence
  Description of Artificial Sequence: Synthetic oligonucleotide
uauggugugguguuugaa

SEQ ID NO: 149800 - RNA, 18 nt, Artificial Sequence
  Description of Artificial Sequence: Synthetic oligonucleotide
uguuguaugguguggugu

SEQ ID NO: 149801 - RNA, 18 nt, Artificial Sequence
  Description of Artificial Sequence: Synthetic oligonucleotide
uaagcuguuguauggugu

SEQ ID NO: 149802 - RNA, 18 nt, Artificial Sequence
  Description of Artificial Sequence: Synthetic oligonucleotide
cuuuauaagcuguuguau

SEQ ID NO: 149803 - RNA, 18 nt, Artificial Sequence
  Description of Artificial Sequence: Synthetic oligonucleotide
auauucuuuauaagcugu

SEQ ID NO: 149804 - RNA, 18 nt, Artificial Sequence
  Description of Artificial Sequence: Synthetic oligonucleotide
ccuaaauauucuuuauaa

SEQ ID NO: 149805 - RNA, 18 nt, Artificial Sequence
  Description of Artificial Sequence: Synthetic oligonucleotide
cugggccuaaauauucuu

SEQ ID NO: 149806 - RNA, 18 nt, Artificial Sequence
  Description of Artificial Sequence: Synthetic oligonucleotide
aacaccugggccuaaaua

SEQ ID NO: 149807 - RNA, 18 nt, Artificial Sequence
  Description of Artificial Sequence: Synthetic oligonucleotide
guaucaacaccugggccu

SEQ ID NO: 149808 - RNA, 18 nt, Artificial Sequence
  Description of Artificial Sequence: Synthetic oligonucleotide
aaaaaguaucaacaccug

SEQ ID NO: 149809 - RNA, 18 nt, Artificial Sequence
  Description of Artificial Sequence: Synthetic oligonucleotide
agaagaaaaaguaucaac

SEQ ID NO: 149810 - RNA, 18 nt, Artificial Sequence
  Description of Artificial Sequence: Synthetic oligonucleotide
uuugcagaagaaaaagua

SEQ ID NO: 149811 - RNA, 18 nt, Artificial Sequence
  Description of Artificial Sequence: Synthetic oligonucleotide
acaauuuugcagaagaaa

SEQ ID NO: 149812 - RNA, 18 nt, Artificial Sequence
  Description of Artificial Sequence: Synthetic oligonucleotide
cuggaacaauuuugcaga

SEQ ID NO: 149813 - RNA, 18 nt, Artificial Sequence
  Description of Artificial Sequence: Synthetic oligonucleotide
agcuucuggaacaauuuu

SEQ ID NO: 149814 - RNA, 18 nt, Artificial Sequence
  Description of Artificial Sequence: Synthetic oligonucleotide
uguuagcaaauaccacca

SEQ ID NO: 149815 - RNA, 18 nt, Artificial Sequence
  Description of Artificial Sequence: Synthetic oligonucleotide
uaugauguuagcaaauac

SEQ ID NO: 149816 - RNA, 18 nt, Artificial Sequence
  Description of Artificial Sequence: Synthetic oligonucleotide
uuggauaugauguuagca

SEQ ID NO: 149817 - RNA, 18 nt, Artificial Sequence
  Description of Artificial Sequence: Synthetic oligonucleotide
cugaguuggauaugaugu

SEQ ID NO: 149818 - RNA, 18 nt, Artificial Sequence
  Description of Artificial Sequence: Synthetic oligonucleotide
cuucccugaguuggauau

SEQ ID NO: 149819 - RNA, 18 nt, Artificial Sequence
  Description of Artificial Sequence: Synthetic oligonucleotide
guccgcuucccugaguug

SEQ ID NO: 149820 - RNA, 18 nt, Artificial Sequence
  Description of Artificial Sequence: Synthetic oligonucleotide
acucaguccgcuucccug

SEQ ID NO: 149821 - RNA, 18 nt, Artificial Sequence
  Description of Artificial Sequence: Synthetic oligonucleotide
ccagcacucaguccgcuu

SEQ ID NO: 149822 - RNA, 18 nt, Artificial Sequence
  Description of Artificial Sequence: Synthetic oligonucleotide
ggaucccagcacucaguc

SEQ ID NO: 149823 - RNA, 18 nt, Artificial Sequence
  Description of Artificial Sequence: Synthetic oligonucleotide
gccuuggaucccagcacu

SEQ ID NO: 149824 - RNA, 18 nt, Artificial Sequence
  Description of Artificial Sequence: Synthetic oligonucleotide
agaaugccuuggauccca

SEQ ID NO: 149825 - RNA, 18 nt, Artificial Sequence
  Description of Artificial Sequence: Synthetic oligonucleotide
ccuguagaaugccuugga

SEQ ID NO: 149826 - RNA, 18 nt, Artificial Sequence
  Description of Artificial Sequence: Synthetic oligonucleotide
ugaacccuguagaaugcc

SEQ ID NO: 149827 - RNA, 18 nt, Artificial Sequence
  Description of Artificial Sequence: Synthetic oligonucleotide
agcagugaacccuguaga

SEQ ID NO: 149828 - RNA, 18 nt, Artificial Sequence
  Description of Artificial Sequence: Synthetic oligonucleotide
aaaccagcagugaacccu

SEQ ID NO: 149829 - RNA, 18 nt, Artificial Sequence
  Description of Artificial Sequence: Synthetic oligonucleotide
aguguaaaccagcaguga

SEQ ID NO: 149830 - RNA, 18 nt, Artificial Sequence
  Description of Artificial Sequence: Synthetic oligonucleotide
ggugaaguguaaaccagc

SEQ ID NO: 149831 - RNA, 18 nt, Artificial Sequence
  Description of Artificial Sequence: Synthetic oligonucleotide
acacaggugaaguguaaa

SEQ ID NO: 149832 - RNA, 18 nt, Artificial Sequence
  Description of Artificial Sequence: Synthetic oligonucleotide
ugcugacacaggugaagu

SEQ ID NO: 149833 - RNA, 18 nt, Artificial Sequence
  Description of Artificial Sequence: Synthetic oligonucleotide
gauggugcugacacaggu

SEQ ID NO: 149834 - RNA, 18 nt, Artificial Sequence
  Description of Artificial Sequence: Synthetic oligonucleotide
cugaagauggugcugaca

SEQ ID NO: 149835 - RNA, 18 nt, Artificial Sequence
  Description of Artificial Sequence: Synthetic oligonucleotide
agcaccugaagauggugc

SEQ ID NO: 149836 - RNA, 18 nt, Artificial Sequence
  Description of Artificial Sequence: Synthetic oligonucleotide
uucuaagcaccugaagau

SEQ ID NO: 149837 - RNA, 18 nt, Artificial Sequence
  Description of Artificial Sequence: Synthetic oligonucleotide
ggccauucuaagcaccug

SEQ ID NO: 149838 - RNA, 18 nt, Artificial Sequence
  Description of Artificial Sequence: Synthetic oligonucleotide
ucccaggccauucuaagc

SEQ ID NO: 149839 - RNA, 18 nt, Artificial Sequence
  Description of Artificial Sequence: Synthetic oligonucleotide
caggcucccaggccauuc

SEQ ID NO: 149840 - RNA, 18 nt, Artificial Sequence
  Description of Artificial Sequence: Synthetic oligonucleotide
cagaacaggcucccaggc

SEQ ID NO: 149841 - RNA, 18 nt, Artificial Sequence
  Description of Artificial Sequence: Synthetic oligonucleotide
caagacagaacaggcucc

SEQ ID NO: 149842 - RNA, 18 nt, Artificial Sequence
  Description of Artificial Sequence: Synthetic oligonucleotide
agaugcaagacagaacag

SEQ ID NO: 149843 - RNA, 18 nt, Artificial Sequence
  Description of Artificial Sequence: Synthetic oligonucleotide
auggaagaugcaagacag

SEQ ID NO: 149844 - RNA, 18 nt, Artificial Sequence
  Description of Artificial Sequence: Synthetic oligonucleotide
augucauggaagaugcaa

SEQ ID NO: 149845 - RNA, 18 nt, Artificial Sequence
  Description of Artificial Sequence: Synthetic oligonucleotide
cuuucaugucauggaaga

SEQ ID NO: 149846 - RNA, 18 nt, Artificial Sequence
  Description of Artificial Sequence: Synthetic oligonucleotide
ccucccuuucaugucaug

SEQ ID NO: 149847 - RNA, 18 nt, Artificial Sequence
  Description of Artificial Sequence: Synthetic oligonucleotide
gccagccucccuuucaug

SEQ ID NO: 149848 - RNA, 18 nt, Artificial Sequence
  Description of Artificial Sequence: Synthetic oligonucleotide
caagugccagccucccuu

SEQ ID NO: 149849 - RNA, 18 nt, Artificial Sequence
  Description of Artificial Sequence: Synthetic oligonucleotide
acugacaagugccagccu

SEQ ID NO: 149850 - RNA, 18 nt, Artificial Sequence
  Description of Artificial Sequence: Synthetic oligonucleotide
accugacugacaagugcc

SEQ ID NO: 149851 - RNA, 18 nt, Artificial Sequence
  Description of Artificial Sequence: Synthetic oligonucleotide
ccucuaccugacugacaa

SEQ ID NO: 149852 - RNA, 18 nt, Artificial Sequence
  Description of Artificial Sequence: Synthetic oligonucleotide
uguaaccucuaccugacu

SEQ ID NO: 149853 - RNA, 18 nt, Artificial Sequence
  Description of Artificial Sequence: Synthetic oligonucleotide
cgguuuguaaccucuacc

SEQ ID NO: 149854 - RNA, 18 nt, Artificial Sequence
  Description of Artificial Sequence: Synthetic oligonucleotide
ugaaacgguuuguaaccu

SEQ ID NO: 149855 - RNA, 18 nt, Artificial Sequence
  Description of Artificial Sequence: Synthetic oligonucleotide
gggccugaaacgguuugu

SEQ ID NO: 149856 - RNA, 18 nt, Artificial Sequence
  Description of Artificial Sequence: Synthetic oligonucleotide
aggcagggccugaaacgg

SEQ ID NO: 149857 - RNA, 18 nt, Artificial Sequence
  Description of Artificial Sequence: Synthetic oligonucleotide
gugguaggcagggccuga

SEQ ID NO: 149858 - RNA, 18 nt, Artificial Sequence
  Description of Artificial Sequence: Synthetic oligonucleotide
ugaaugugguaggcaggg

SEQ ID NO: 149859 - RNA, 18 nt, Artificial Sequence
  Description of Artificial Sequence: Synthetic oligonucleotide
aacagugaaugugguagg

SEQ ID NO: 149860 - RNA, 18 nt, Artificial Sequence
  Description of Artificial Sequence: Synthetic oligonucleotide
auucaaacagugaaugug

SEQ ID NO: 149861 - RNA, 18 nt, Artificial Sequence
  Description of Artificial Sequence: Synthetic oligonucleotide
uaaagauucaaacaguga

SEQ ID NO: 149862 - RNA, 18 nt, Artificial Sequence
  Description of Artificial Sequence: Synthetic oligonucleotide
ggaauuaaagauucaaac

SEQ ID NO: 149863 - RNA, 18 nt, Artificial Sequence
  Description of Artificial Sequence: Synthetic oligonucleotide
ucuugggaauuaaagauu

SEQ ID NO: 149864 - RNA, 18 nt, Artificial Sequence
  Description of Artificial Sequence: Synthetic oligonucleotide
cuuauucuugggaauuaa

SEQ ID NO: 149865 - RNA, 18 nt, Artificial Sequence
  Description of Artificial Sequence: Synthetic oligonucleotide
guaaacuuauucuuggga

SEQ ID NO: 149866 - RNA, 18 nt, Artificial Sequence
  Description of Artificial Sequence: Synthetic oligonucleotide
gaaauguaaacuuauucu

SEQ ID NO: 149867 - RNA, 18 nt, Artificial Sequence
  Description of Artificial Sequence: Synthetic oligonucleotide
auugugaaauguaaacuu

SEQ ID NO: 149868 - RNA, 18 nt, Artificial Sequence
  Description of Artificial Sequence: Synthetic oligonucleotide
cauucauugugaaaugua

SEQ ID NO: 149869 - RNA, 18 nt, Artificial Sequence
  Description of Artificial Sequence: Synthetic oligonucleotide
uaggucauucauugugaa

SEQ ID NO: 149870 - RNA, 18 nt, Artificial Sequence
  Description of Artificial Sequence: Synthetic oligonucleotide
uguuguaggucauucauu

SEQ ID NO: 149871 - RNA, 18 nt, Artificial Sequence
  Description of Artificial Sequence: Synthetic oligonucleotide
uuagcuguuguaggucau

SEQ ID NO: 149872 - RNA, 18 nt, Artificial Sequence
  Description of Artificial Sequence: Synthetic oligonucleotide
aaaauuuagcuguuguag

SEQ ID NO: 149873 - RNA, 18 nt, Artificial Sequence
  Description of Artificial Sequence: Synthetic oligonucleotide
cccagaaaauuuagcugu

SEQ ID NO: 149874 - RNA, 18 nt, Artificial Sequence
  Description of Artificial Sequence: Synthetic oligonucleotide
ccagccccagaaaauuua

SEQ ID NO: 149875 - RNA, 18 nt, Artificial Sequence
  Description of Artificial Sequence: Synthetic oligonucleotide
uacucccagccccagaaa

SEQ ID NO: 149876 - RNA, 18 nt, Artificial Sequence
  Description of Artificial Sequence: Synthetic oligonucleotide
aguauuacucccagcccc

SEQ ID NO: 149877 - RNA, 18 nt, Artificial Sequence
  Description of Artificial Sequence: Synthetic oligonucleotide
uugucaguauuacuccca

SEQ ID NO: 149878 - RNA, 18 nt, Artificial Sequence
  Description of Artificial Sequence: Synthetic oligonucleotide
auggauugucaguauuac

SEQ ID NO: 149879 - RNA, 18 nt, Artificial Sequence
  Description of Artificial Sequence: Synthetic oligonucleotide
aguaaauggauugucagu

SEQ ID NO: 149880 - RNA, 18 nt, Artificial Sequence
  Description of Artificial Sequence: Synthetic oligonucleotide
gcuacaguaaauggauug

SEQ ID NO: 149881 - RNA, 18 nt, Artificial Sequence
  Description of Artificial Sequence: Synthetic oligonucleotide
gcagagcuacaguaaaug

SEQ ID NO: 149882 - RNA, 18 nt, Artificial Sequence
  Description of Artificial Sequence: Synthetic oligonucleotide
auuaagcagagcuacagu

SEQ ID NO: 149883 - RNA, 18 nt, Artificial Sequence
  Description of Artificial Sequence: Synthetic oligonucleotide
aguacauuaagcagagcu

SEQ ID NO: 149884 - RNA, 18 nt, Artificial Sequence
  Description of Artificial Sequence: Synthetic oligonucleotide
uaaguaguacauuaagca

SEQ ID NO: 149885 - RNA, 18 nt, Artificial Sequence
  Description of Artificial Sequence: Synthetic oligonucleotide
uuuccuaaguaguacauu

SEQ ID NO: 149886 - RNA, 18 nt, Artificial Sequence
  Description of Artificial Sequence: Synthetic oligonucleotide
gacauuuuccuaaguagu

SEQ ID NO: 149887 - RNA, 18 nt, Artificial Sequence
  Description of Artificial Sequence: Synthetic oligonucleotide
gcagggacauuuuccuaa

SEQ ID NO: 149888 - RNA, 18 nt, Artificial Sequence
  Description of Artificial Sequence: Synthetic oligonucleotide
auuaagcagggacauuuu

SEQ ID NO: 149889 - RNA, 18 nt, Artificial Sequence
  Description of Artificial Sequence: Synthetic oligonucleotide
acauuauuaagcagggac

SEQ ID NO: 149890 - RNA, 18 nt, Artificial Sequence
  Description of Artificial Sequence: Synthetic oligonucleotide
ggcuuacauuauuaagca

SEQ ID NO: 149891 - RNA, 18 nt, Artificial Sequence
  Description of Artificial Sequence: Synthetic oligonucleotide
agcuuggcuuacauuauu

SEQ ID NO: 149892 - RNA, 18 nt, Artificial Sequence
  Description of Artificial Sequence: Synthetic oligonucleotide
cauuuagcuuggcuuaca

SEQ ID NO: 149893 - RNA, 18 nt, Artificial Sequence
  Description of Artificial Sequence: Synthetic oligonucleotide
accaucauuuagcuuggc

SEQ ID NO: 149894 - RNA, 18 nt, Artificial Sequence
  Description of Artificial Sequence: Synthetic oligonucleotide
cuuuaaccaucauuuagc

SEQ ID NO: 149895 - RNA, 18 nt, Artificial Sequence
  Description of Artificial Sequence: Synthetic oligonucleotide
gauaacuuuaaccaucau

SEQ ID NO: 149896 - RNA, 18 nt, Artificial Sequence
  Description of Artificial Sequence: Synthetic oligonucleotide
ggccugauaacuuuaacc

SEQ ID NO: 149897 - RNA, 18 nt, Artificial Sequence
  Description of Artificial Sequence: Synthetic oligonucleotide
ugggaggccugauaacuu

SEQ ID NO: 149898 - RNA, 18 nt, Artificial Sequence
  Description of Artificial Sequence: Synthetic oligonucleotide
uuucaugggaggccugau

SEQ ID NO: 149899 - RNA, 18 nt, Artificial Sequence
  Description of Artificial Sequence: Synthetic oligonucleotide
cgcaauuucaugggaggc

SEQ ID NO: 149900 - RNA, 18 nt, Artificial Sequence
  Description of Artificial Sequence: Synthetic oligonucleotide
aagaacgcaauuucaugg

SEQ ID NO: 149901 - RNA, 18 nt, Artificial Sequence
  Description of Artificial Sequence: Synthetic oligonucleotide
gcaggaagaacgcaauuu

SEQ ID NO: 149902 - RNA, 18 nt, Artificial Sequence
  Description of Artificial Sequence: Synthetic oligonucleotide
ucaaugcaggaagaacgc

SEQ ID NO: 149903 - RNA, 18 nt, Artificial Sequence
  Description of Artificial Sequence: Synthetic oligonucleotide
uuauuucaaugcaggaag

SEQ ID NO: 149904 - RNA, 18 nt, Artificial Sequence
  Description of Artificial Sequence: Synthetic oligonucleotide
uguuuuuauuucaaugca

SEQ ID NO: 149905 - RNA, 18 nt, Artificial Sequence
  Description of Artificial Sequence: Synthetic oligonucleotide
aauaauguuuuuauuuca

SEQ ID NO: 149906 - RNA, 18 nt, Artificial Sequence
  Description of Artificial Sequence: Synthetic oligonucleotide
uucccaauaauguuuuua

SEQ ID NO: 149907 - RNA, 18 nt, Artificial Sequence
  Description of Artificial Sequence: Synthetic oligonucleotide
cuaguuucccaauaaugu

SEQ ID NO: 149908 - RNA, 18 nt, Artificial Sequence
  Description of Artificial Sequence: Synthetic oligonucleotide
guucucuaguuucccaau

SEQ ID NO: 149909 - RNA, 18 nt, Artificial Sequence
  Description of Artificial Sequence: Synthetic oligonucleotide
gagguguucucuaguuuc

SEQ ID NO: 149910 - RNA, 18 nt, Artificial Sequence
  Description of Artificial Sequence: Synthetic oligonucleotide
aaauagagguguucucua

SEQ ID NO: 149911 - RNA, 18 nt, Artificial Sequence
  Description of Artificial Sequence: Synthetic oligonucleotide
uuuaaaaauagagguguu

SEQ ID NO: 149912 - RNA, 18 nt, Artificial Sequence
  Description of Artificial Sequence: Synthetic oligonucleotide
guccuuuuaaaaauagag

SEQ ID NO: 149913 - RNA, 18 nt, Artificial Sequence
  Description of Artificial Sequence: Synthetic oligonucleotide
uuaaaguccuuuuaaaaa

SEQ ID NO: 149914 - RNA, 18 nt, Artificial Sequence
  Description of Artificial Sequence: Synthetic oligonucleotide
cuucguuaaaguccuuuu

SEQ ID NO: 149915 - RNA, 18 nt, Artificial Sequence
  Description of Artificial Sequence: Synthetic oligonucleotide
uuugacuucguuaaaguc

SEQ ID NO: 149916 - RNA, 18 nt, Artificial Sequence
  Description of Artificial Sequence: Synthetic oligonucleotide
aguuguuugacuucguua

SEQ ID NO: 149917 - RNA, 18 nt, Artificial Sequence
  Description of Artificial Sequence: Synthetic oligonucleotide
uuauaaguuguuugacuu

SEQ ID NO: 149918 - RNA, 18 nt, Artificial Sequence
  Description of Artificial Sequence: Synthetic oligonucleotide
uagucuuauaaguuguuu

SEQ ID NO: 149919 - RNA, 18 nt, Artificial Sequence
  Description of Artificial Sequence: Synthetic oligonucleotide
aucacuagucuuauaagu

SEQ ID NO: 149920 - RNA, 18 nt, Artificial Sequence
  Description of Artificial Sequence: Synthetic oligonucleotide
agugaaucacuagucuua

SEQ ID NO: 149921 - RNA, 18 nt, Artificial Sequence
  Description of Artificial Sequence: Synthetic oligonucleotide
gccccagugaaucacuag

SEQ ID NO: 149922 - RNA, 18 nt, Artificial Sequence
  Description of Artificial Sequence: Synthetic oligonucleotide
auaaugccccagugaauc

SEQ ID NO: 149923 - RNA, 18 nt, Artificial Sequence
  Description of Artificial Sequence: Synthetic oligonucleotide
acaaaauaaugccccagu

SEQ ID NO: 149924 - RNA, 18 nt, Artificial Sequence
  Description of Artificial Sequence: Synthetic oligonucleotide
cucuaacaaaauaaugcc

SEQ ID NO: 149925 - RNA, 18 nt, Artificial Sequence
  Description of Artificial Sequence: Synthetic oligonucleotide
agguccucuaacaaaaua

SEQ ID NO: 149926 - RNA, 18 nt, Artificial Sequence
  Description of Artificial Sequence: Synthetic oligonucleotide
uuuuaagguccucuaaca

SEQ ID NO: 149927 - RNA, 18 nt, Artificial Sequence
  Description of Artificial Sequence: Synthetic oligonucleotide
aacaauuuuaagguccuc

SEQ ID NO: 149928 - RNA, 18 nt, Artificial Sequence
  Description of Artificial Sequence: Synthetic oligonucleotide
aaauaaacaauuuuaagg

SEQ ID NO: 149929 - RNA, 18 nt, Artificial Sequence
  Description of Artificial Sequence: Synthetic oligonucleotide
uuaaaaaauaaacaauuu

SEQ ID NO: 149930 - RNA, 18 nt, Artificial Sequence
  Description of Artificial Sequence: Synthetic oligonucleotide
cacauuuaaaaaauaaac

SEQ ID NO: 149931 - RNA, 18 nt, Artificial Sequence
  Description of Artificial Sequence: Synthetic oligonucleotide
ggaaucacauuuaaaaaa

SEQ ID NO: 149932 - RNA, 18 nt, Artificial Sequence
  Description of Artificial Sequence: Synthetic oligonucleotide
auaaaggaaucacauuua

SEQ ID NO: 149933 - RNA, 18 nt, Artificial Sequence
  Description of Artificial Sequence: Synthetic oligonucleotide
augccauaaaggaaucac

SEQ ID NO: 149934 - RNA, 18 nt, Artificial Sequence
  Description of Artificial Sequence: Synthetic oligonucleotide
cccuaaugccauaaagga

SEQ ID NO: 149935 - RNA, 18 nt, Artificial Sequence
  Description of Artificial Sequence: Synthetic oligonucleotide
cuuuacccuaaugccaua

SEQ ID NO: 149936 - RNA, 18 nt, Artificial Sequence
  Description of Artificial Sequence: Synthetic oligonucleotide
uucaucuuuacccuaaug

SEQ ID NO: 149937 - RNA, 18 nt, Artificial Sequence
  Description of Artificial Sequence: Synthetic oligonucleotide
auugcuucaucuuuaccc

SEQ ID NO: 149938 - RNA, 18 nt, Artificial Sequence
  Description of Artificial Sequence: Synthetic oligonucleotide
aaauuauugcuucaucuu

SEQ ID NO: 149939 - RNA, 18 nt, Artificial Sequence
  Description of Artificial Sequence: Synthetic oligonucleotide
uuuaaaaauuauugcuuc

SEQ ID NO: 149940 - RNA, 18 nt, Artificial Sequence
  Description of Artificial Sequence: Synthetic oligonucleotide
cacaauuuaaaaauuauu

SEQ ID NO: 149941 - RNA, 18 nt, Artificial Sequence
  Description of Artificial Sequence: Synthetic oligonucleotide
acauacacaauuuaaaaa

SEQ ID NO: 149942 - RNA, 18 nt, Artificial Sequence
  Description of Artificial Sequence: Synthetic oligonucleotide
uaugcacauacacaauuu

SEQ ID NO: 149943 - RNA, 18 nt, Artificial Sequence
  Description of Artificial Sequence: Synthetic oligonucleotide
cuucauaugcacauacac

SEQ ID NO: 149944 - RNA, 18 nt, Artificial Sequence
  Description of Artificial Sequence: Synthetic oligonucleotide
cugugcuucauaugcaca

SEQ ID NO: 149945 - RNA, 18 nt, Artificial Sequence
  Description of Artificial Sequence: Synthetic oligonucleotide
caugucugugcuucauau

SEQ ID NO: 149946 - RNA, 18 nt, Artificial Sequence
  Description of Artificial Sequence: Synthetic oligonucleotide
acaugcaugucugugcuu

SEQ ID NO: 149947 - RNA, 18 nt, Artificial Sequence
  Description of Artificial Sequence: Synthetic oligonucleotide
cacacacaugcaugucug

SEQ ID NO: 149948 - RNA, 18 nt, Artificial Sequence
  Description of Artificial Sequence: Synthetic oligonucleotide
acacacacacacaugcau

SEQ ID NO: 149949 - RNA, 18 nt, Artificial Sequence
  Description of Artificial Sequence: Synthetic oligonucleotide
cacagacacacacacaca

SEQ ID NO: 149950 - RNA, 18 nt, Artificial Sequence
  Description of Artificial Sequence: Synthetic oligonucleotide
acacacacagacacacac

SEQ ID NO: 149951 - RNA, 18 nt, Artificial Sequence
  Description of Artificial Sequence: Synthetic oligonucleotide
gacacacacacacagaca

SEQ ID NO: 149952 - RNA, 18 nt, Artificial Sequence
  Description of Artificial Sequence: Synthetic oligonucleotide
acacggacacacacacac

SEQ ID NO: 149953 - RNA, 18 nt, Artificial Sequence
  Description of Artificial Sequence: Synthetic oligonucleotide
cacauacacggacacaca

SEQ ID NO: 149954 - RNA, 18 nt, Artificial Sequence
  Description of Artificial Sequence: Synthetic oligonucleotide
acacacacauacacggac

SEQ ID NO: 149955 - RNA, 18 nt, Artificial Sequence
  Description of Artificial Sequence: Synthetic oligonucleotide
aacccacacacacauaca

SEQ ID NO: 149956 - RNA, 18 nt, Artificial Sequence
  Description of Artificial Sequence: Synthetic oligonucleotide
auuagaacccacacacac

SEQ ID NO: 149957 - RNA, 18 nt, Artificial Sequence
  Description of Artificial Sequence: Synthetic oligonucleotide
uuaccauuagaacccaca

SEQ ID NO: 149958 - RNA, 18 nt, Artificial Sequence
  Description of Artificial Sequence: Synthetic oligonucleotide
gcaaauuaccauuagaac

SEQ ID NO: 149959 - RNA, 18 nt, Artificial Sequence
  Description of Artificial Sequence: Synthetic oligonucleotide
cugaggcaaauuaccauu

SEQ ID NO: 149960 - RNA, 18 nt, Artificial Sequence
  Description of Artificial Sequence: Synthetic oligonucleotide
aaugacugaggcaaauua

SEQ ID NO: 149961 - RNA, 18 nt, Artificial Sequence
  Description of Artificial Sequence: Synthetic oligonucleotide
aaaaaaaugacugaggca

SEQ ID NO: 149962 - RNA, 18 nt, Artificial Sequence
  Description of Artificial Sequence: Synthetic oligonucleotide
auauuaaaaaaaugacug

SEQ ID NO: 149963 - RNA, 18 nt, Artificial Sequence
  Description of Artificial Sequence: Synthetic oligonucleotide
ugcaaauauuaaaaaaau

SEQ ID NO: 149964 - RNA, 18 nt, Artificial Sequence
  Description of Artificial Sequence: Synthetic oligonucleotide
aguacugcaaauauuaaa

SEQ ID NO: 149965 - RNA, 18 nt, Artificial Sequence
  Description of Artificial Sequence: Synthetic oligonucleotide
aaucaaguacugcaaaua

SEQ ID NO: 149966 - RNA, 18 nt, Artificial Sequence
  Description of Artificial Sequence: Synthetic oligonucleotide
uccuaaaucaaguacugc

SEQ ID NO: 149967 - RNA, 18 nt, Artificial Sequence
  Description of Artificial Sequence: Synthetic oligonucleotide
acagauccuaaaucaagu

SEQ ID NO: 149968 - RNA, 18 nt, Artificial Sequence
  Description of Artificial Sequence: Synthetic oligonucleotide
gcaccacagauccuaaau

SEQ ID NO: 149969 - RNA, 18 nt, Artificial Sequence
  Description of Artificial Sequence: Synthetic oligonucleotide
gcccugcaccacagaucc

SEQ ID NO: 149970 - RNA, 18 nt, Artificial Sequence
  Description of Artificial Sequence: Synthetic oligonucleotide
acauugcccugcaccaca

SEQ ID NO: 149971 - RNA, 18 nt, Artificial Sequence
  Description of Artificial Sequence: Synthetic oligonucleotide
uugaaacauugcccugca

SEQ ID NO: 149972 - RNA, 18 nt, Artificial Sequence
  Description of Artificial Sequence: Synthetic oligonucleotide
aaacuuugaaacauugcc

SEQ ID NO: 149973 - RNA, 18 nt, Artificial Sequence
  Description of Artificial Sequence: Synthetic oligonucleotide
ugacuaaacuuugaaaca

SEQ ID NO: 149974 - RNA, 18 nt, Artificial Sequence
  Description of Artificial Sequence: Synthetic oligonucleotide
agcugugacuaaacuuug

SEQ ID NO: 149975 - RNA, 18 nt, Artificial Sequence
  Description of Artificial Sequence: Synthetic oligonucleotide
uuuuaagcugugacuaaa

SEQ ID NO: 149976 - RNA, 18 nt, Artificial Sequence
  Description of Artificial Sequence: Synthetic oligonucleotide
aauguuuuuaagcuguga

SEQ ID NO: 149977 - RNA, 18 nt, Artificial Sequence
  Description of Artificial Sequence: Synthetic oligonucleotide
cacugaauguuuuuaagc

SEQ ID NO: 149978 - RNA, 18 nt, Artificial Sequence
  Description of Artificial Sequence: Synthetic oligonucleotide
agucacacugaauguuuu

SEQ ID NO: 149979 - RNA, 18 nt, Artificial Sequence
  Description of Artificial Sequence: Synthetic oligonucleotide
auuaaagucacacugaau

SEQ ID NO: 149980 - RNA, 18 nt, Artificial Sequence
  Description of Artificial Sequence: Synthetic oligonucleotide
auaauauuaaagucacac

SEQ ID NO: 149981 - RNA, 18 nt, Artificial Sequence
  Description of Artificial Sequence: Synthetic oligonucleotide
auuuuauaauauuaaagu

SEQ ID NO: 149982 - RNA, 18 nt, Artificial Sequence
  Description of Artificial Sequence: Synthetic oligonucleotide
aaaucauuuuauaauauu

SEQ ID NO: 149983 - RNA, 18 nt, Artificial Sequence
  Description of Artificial Sequence: Synthetic oligonucleotide
augggaaaucauuuuaua

SEQ ID NO: 149984 - RNA, 18 nt, Artificial Sequence
  Description of Artificial Sequence: Synthetic oligonucleotide
auggcaugggaaaucauu

SEQ ID NO: 149985 - RNA, 18 nt, Artificial Sequence
  Description of Artificial Sequence: Synthetic oligonucleotide
aaauuauggcaugggaaa

SEQ ID NO: 149986 - RNA, 18 nt, Artificial Sequence
  Description of Artificial Sequence: Synthetic oligonucleotide
cagaaaaauuauggcaug

SEQ ID NO: 149987 - RNA, 18 nt, Artificial Sequence
  Description of Artificial Sequence: Synthetic oligonucleotide
auagacagaaaaauuaug

SEQ ID NO: 149988 - RNA, 18 nt, Artificial Sequence
  Description of Artificial Sequence: Synthetic oligonucleotide
auuuaauagacagaaaaa

SEQ ID NO: 149989 - RNA, 18 nt, Artificial Sequence
  Description of Artificial Sequence: Synthetic oligonucleotide
gucccauuuaauagacag

SEQ ID NO: 149990 - RNA, 18 nt, Artificial Sequence
  Description of Artificial Sequence: Synthetic oligonucleotide
cacuugucccauuuaaua

SEQ ID NO: 149991 - RNA, 18 nt, Artificial Sequence
  Description of Artificial Sequence: Synthetic oligonucleotide
cuuuacacuugucccauu

SEQ ID NO: 149992 - RNA, 18 nt, Artificial Sequence
  Description of Artificial Sequence: Synthetic oligonucleotide
gcaugcuuuacacuuguc

SEQ ID NO: 149993 - RNA, 18 nt, Artificial Sequence
  Description of Artificial Sequence: Synthetic oligonucleotide
cuuuugcaugcuuuacac

SEQ ID NO: 149994 - RNA, 18 nt, Artificial Sequence
  Description of Artificial Sequence: Synthetic oligonucleotide
ucuaacuuuugcaugcuu

SEQ ID NO: 149995 - RNA, 18 nt, Artificial Sequence
  Description of Artificial Sequence: Synthetic oligonucleotide
agaucucuaacuuuugca

SEQ ID NO: 149996 - RNA, 18 nt, Artificial Sequence
  Description of Artificial Sequence: Synthetic oligonucleotide
auaacagaucucuaacuu

SEQ ID NO: 149997 - RNA, 18 nt, Artificial Sequence
  Description of Artificial Sequence: Synthetic oligonucleotide
guuauauaacagaucucu

SEQ ID NO: 149998 - RNA, 18 nt, Artificial Sequence
  Description of Artificial Sequence: Synthetic oligonucleotide
caaauguuauauaacaga

SEQ ID NO: 149999 - RNA, 18 nt, Artificial Sequence
  Description of Artificial Sequence: Synthetic oligonucleotide
caaaacaaauguuauaua

SEQ ID NO: 150000 - RNA, 18 nt, Artificial Sequence
  Description of Artificial Sequence: Synthetic oligonucleotide
aaucacaaaacaaauguu

SEQ ID NO: 150001 - RNA, 18 nt, Artificial Sequence
  Description of Artificial Sequence: Synthetic oligonucleotide
guucaaaucacaaaacaa

SEQ ID NO: 150002 - RNA, 18 nt, Artificial Sequence
  Description of Artificial Sequence: Synthetic oligonucleotide
uaggaguucaaaucacaa

SEQ ID NO: 150003 - RNA, 18 nt, Artificial Sequence
  Description of Artificial Sequence: Synthetic oligonucleotide
uuuccuaggaguucaaau

SEQ ID NO: 150004 - RNA, 18 nt, Artificial Sequence
  Description of Artificial Sequence: Synthetic oligonucleotide
auauuuuuccuaggaguu

SEQ ID NO: 150005 - RNA, 18 nt, Artificial Sequence
  Description of Artificial Sequence: Synthetic oligonucleotide
aaaucauauuuuuccuag

SEQ ID NO: 150006 - RNA, 18 nt, Artificial Sequence
  Description of Artificial Sequence: Synthetic oligonucleotide
uuaugaaaucauauuuuu

SEQ ID NO: 150007 - RNA, 18 nt, Artificial Sequence
  Description of Artificial Sequence: Synthetic oligonucleotide
uacauuuaugaaaucaua

SEQ ID NO: 150008 - RNA, 18 nt, Artificial Sequence
  Description of Artificial Sequence: Synthetic oligonucleotide
cauuuuacauuuaugaaa

SEQ ID NO: 150009 - RNA, 18 nt, Artificial Sequence
  Description of Artificial Sequence: Synthetic oligonucleotide
cugugcauuuuacauuua

SEQ ID NO: 150010 - RNA, 18 nt, Artificial Sequence
  Description of Artificial Sequence: Synthetic oligonucleotide
cauuucugugcauuuuac

SEQ ID NO: 150011 - RNA, 18 nt, Artificial Sequence
  Description of Artificial Sequence: Synthetic oligonucleotide
gcaugcauuucugugcau

SEQ ID NO: 150012 - RNA, 18 nt, Artificial Sequence
  Description of Artificial Sequence: Synthetic oligonucleotide
guauugcaugcauuucug

SEQ ID NO: 150013 - RNA, 18 nt, Artificial Sequence
  Description of Artificial Sequence: Synthetic oligonucleotide
uauaaguauugcaugcau

SEQ ID NO: 150014 - RNA, 18 nt, Artificial Sequence
  Description of Artificial Sequence: Synthetic oligonucleotide
agucuuauaaguauugca

SEQ ID NO: 150015 - RNA, 18 nt, Artificial Sequence
  Description of Artificial Sequence: Synthetic oligonucleotide
uuuuaagucuuauaagua

SEQ ID NO: 150016 - RNA, 18 nt, Artificial Sequence
  Description of Artificial Sequence: Synthetic oligonucleotide
acaauuuuuaagucuuau

SEQ ID NO: 150017 - RNA, 18 nt, Artificial Sequence
  Description of Artificial Sequence: Synthetic oligonucleotide
uaaacacaauuuuuaagu

SEQ ID NO: 150018 - RNA, 18 nt, Artificial Sequence
  Description of Artificial Sequence: Synthetic oligonucleotide
aucuguaaacacaauuuu

SEQ ID NO: 150019 - RNA, 18 nt, Artificial Sequence
  Description of Artificial Sequence: Synthetic oligonucleotide
aaaccaucuguaaacaca

SEQ ID NO: 150020 - RNA, 18 nt, Artificial Sequence
  Description of Artificial Sequence: Synthetic oligonucleotide
caaauaaaccaucuguaa

SEQ ID NO: 150021 - RNA, 18 nt, Artificial Sequence
  Description of Artificial Sequence: Synthetic oligonucleotide
augcacaaauaaaccauc

SEQ ID NO: 150022 - RNA, 18 nt, Artificial Sequence
  Description of Artificial Sequence: Synthetic oligonucleotide
aaaauaugcacaaauaaa

SEQ ID NO: 150023 - RNA, 18 nt, Artificial Sequence
  Description of Artificial Sequence: Synthetic oligonucleotide
uaguaaaaauaugcacaa

SEQ ID NO: 150024 - RNA, 18 nt, Artificial Sequence
  Description of Artificial Sequence: Synthetic oligonucleotide
agcaguaguaaaaauaug

SEQ ID NO: 150025 - RNA, 18 nt, Artificial Sequence
  Description of Artificial Sequence: Synthetic oligonucleotide
ggaaaagcaguaguaaaa

SEQ ID NO: 150026 - RNA, 18 nt, Artificial Sequence
  Description of Artificial Sequence: Synthetic oligonucleotide
auuuaggaaaagcaguag

SEQ ID NO: 150027 - RNA, 18 nt, Artificial Sequence
  Description of Artificial Sequence: Synthetic oligonucleotide
uaugcauuuaggaaaagc

SEQ ID NO: 150028 - RNA, 18 nt, Artificial Sequence
  Description of Artificial Sequence: Synthetic oligonucleotide
uacaguaugcauuuagga

SEQ ID NO: 150029 - RNA, 18 nt, Artificial Sequence
  Description of Artificial Sequence: Synthetic oligonucleotide
uuauauacaguaugcauu

SEQ ID NO: 150030 - RNA, 18 nt, Artificial Sequence
  Description of Artificial Sequence: Synthetic oligonucleotide
cagaauuauauacaguau

SEQ ID NO: 150031 - RNA, 18 nt, Artificial Sequence
  Description of Artificial Sequence: Synthetic oligonucleotide
auacacagaauuauauac

SEQ ID NO: 150032 - RNA, 18 nt, Artificial Sequence
  Description of Artificial Sequence: Synthetic oligonucleotide
aucaaauacacagaauua

SEQ ID NO: 150033 - RNA, 18 nt, Artificial Sequence
  Description of Artificial Sequence: Synthetic oligonucleotide
uauuuaucaaauacacag

SEQ ID NO: 150034 - RNA, 18 nt, Artificial Sequence
  Description of Artificial Sequence: Synthetic oligonucleotide
agaaauauuuaucaaaua

SEQ ID NO: 150035 - RNA, 18 nt, Artificial Sequence
  Description of Artificial Sequence: Synthetic oligonucleotide
uaggaagaaauauuuauc

SEQ ID NO: 150036 - RNA, 18 nt, Artificial Sequence
  Description of Artificial Sequence: Synthetic oligonucleotide
uaauguaggaagaaauau

SEQ ID NO: 150037 - RNA, 18 nt, Artificial Sequence
  Description of Artificial Sequence: Synthetic oligonucleotide
aaauauaauguaggaaga

SEQ ID NO: 150038 - RNA, 18 nt, Artificial Sequence
  Description of Artificial Sequence: Synthetic oligonucleotide
ucuaaaaauauaauguag

SEQ ID NO: 150039 - RNA, 18 nt, Artificial Sequence
  Description of Artificial Sequence: Synthetic oligonucleotide
aauauucuaaaaauauaa

SEQ ID NO: 150040 - RNA, 18 nt, Artificial Sequence
  Description of Artificial Sequence: Synthetic oligonucleotide
ucugaaauauucuaaaaa

SEQ ID NO: 150041 - RNA, 18 nt, Artificial Sequence
  Description of Artificial Sequence: Synthetic oligonucleotide
auauuucugaaauauucu

SEQ ID NO: 150042 - RNA, 18 nt, Artificial Sequence
  Description of Artificial Sequence: Synthetic oligonucleotide
aauguauauuucugaaau

SEQ ID NO: 150043 - RNA, 18 nt, Artificial Sequence
  Description of Artificial Sequence: Synthetic oligonucleotide
acauaaauguauauuucu

SEQ ID NO: 150044 - RNA, 18 nt, Artificial Sequence
  Description of Artificial Sequence: Synthetic oligonucleotide
uaaagacauaaauguaua

SEQ ID NO: 150045 - RNA, 18 nt, Artificial Sequence
  Description of Artificial Sequence: Synthetic oligonucleotide
caauauaaagacauaaau

SEQ ID NO: 150046 - RNA, 18 nt, Artificial Sequence
  Description of Artificial Sequence: Synthetic oligonucleotide
uauuacaauauaaagaca

SEQ ID NO: 150047 - RNA, 18 nt, Artificial Sequence
  Description of Artificial Sequence: Synthetic oligonucleotide
auauuuauuacaauauaa

SEQ ID NO: 150048 - RNA, 18 nt, Artificial Sequence
  Description of Artificial Sequence: Synthetic oligonucleotide
uguacauauuuauuacaa

SEQ ID NO: 150049 - RNA, 18 nt, Artificial Sequence
  Description of Artificial Sequence: Synthetic oligonucleotide
agauauguacauauuuau

SEQ ID NO: 150050 - RNA, 18 nt, Artificial Sequence
  Description of Artificial Sequence: Synthetic oligonucleotide
uaccuagauauguacaua

SEQ ID NO: 150051 - RNA, 18 nt, Artificial Sequence
  Description of Artificial Sequence: Synthetic oligonucleotide
gcauauaccuagauaugu

SEQ ID NO: 150052 - RNA, 18 nt, Artificial Sequence
  Description of Artificial Sequence: Synthetic oligonucleotide
agaaagcauauaccuaga

SEQ ID NO: 150053 - RNA, 18 nt, Artificial Sequence
  Description of Artificial Sequence: Synthetic oligonucleotide
cagagagaaagcauauac

SEQ ID NO: 150054 - RNA, 18 nt, Artificial Sequence
  Description of Artificial Sequence: Synthetic oligonucleotide
cacagcagagagaaagca

SEQ ID NO: 150055 - RNA, 18 nt, Artificial Sequence
  Description of Artificial Sequence: Synthetic oligonucleotide
aauuucacagcagagaga

SEQ ID NO: 150056 - RNA, 18 nt, Artificial Sequence
  Description of Artificial Sequence: Synthetic oligonucleotide
aaaauaauuucacagcag

SEQ ID NO: 150057 - RNA, 18 nt, Artificial Sequence
  Description of Artificial Sequence: Synthetic oligonucleotide
uucuaaaaauaauuucac

SEQ ID NO: 150058 - RNA, 18 nt, Artificial Sequence
  Description of Artificial Sequence: Synthetic oligonucleotide
uauaauucuaaaaauaau

SEQ ID NO: 150059 - RNA, 18 nt, Artificial Sequence
  Description of Artificial Sequence: Synthetic oligonucleotide
gaauuuauaauucuaaaa

SEQ ID NO: 150060 - RNA, 18 nt, Artificial Sequence
  Description of Artificial Sequence: Synthetic oligonucleotide
gacgugaauuuauaauuc

SEQ ID NO: 150061 - RNA, 18 nt, Artificial Sequence
  Description of Artificial Sequence: Synthetic oligonucleotide
gacaagacgugaauuuau

SEQ ID NO: 150062 - RNA, 18 nt, Artificial Sequence
  Description of Artificial Sequence: Synthetic oligonucleotide
aaucugacaagacgugaa

SEQ ID NO: 150063 - RNA, 18 nt, Artificial Sequence
  Description of Artificial Sequence: Synthetic oligonucleotide
gaugaaaucugacaagac

SEQ ID NO: 150064 - RNA, 18 nt, Artificial Sequence
  Description of Artificial Sequence: Synthetic oligonucleotide
auacagaugaaaucugac

SEQ ID NO: 150065 - RNA, 18 nt, Artificial Sequence
  Description of Artificial Sequence: Synthetic oligonucleotide
aagguauacagaugaaau

SEQ ID NO: 150066 - RNA, 18 nt, Artificial Sequence
  Description of Artificial Sequence: Synthetic oligonucleotide
auuugaagguauacagau

SEQ ID NO: 150067 - RNA, 18 nt, Artificial Sequence
  Description of Artificial Sequence: Synthetic oligonucleotide
agagaauuugaagguaua

SEQ ID NO: 150068 - RNA, 18 nt, Artificial Sequence
  Description of Artificial Sequence: Synthetic oligonucleotide
cuuucagagaauuugaag

SEQ ID NO: 150069 - RNA, 18 nt, Artificial Sequence
  Description of Artificial Sequence: Synthetic oligonucleotide
uuuuacuuucagagaauu

SEQ ID NO: 150070 - RNA, 18 nt, Artificial Sequence
  Description of Artificial Sequence: Synthetic oligonucleotide
uuuauuuuuacuuucaga

SEQ ID NO: 150071 - RNA, 18 nt, Artificial Sequence
  Description of Artificial Sequence: Synthetic oligonucleotide
aaacuuuuauuuuuacuu

SEQ ID NO: 150072 - RNA, 18 nt, Artificial Sequence
  Description of Artificial Sequence: Synthetic oligonucleotide
uuuaaaaacuuuuauuuu

SEQ ID NO: 150073 - RNA, 18 nt, Artificial Sequence
  Description of Artificial Sequence: Synthetic oligonucleotide
aaugguacacucggcgua

SEQ ID NO: 150074 - RNA, 18 nt, Artificial Sequence
  Description of Artificial Sequence: Synthetic oligonucleotide
uuguaaaugguacacucg

SEQ ID NO: 150075 - RNA, 18 nt, Artificial Sequence
  Description of Artificial Sequence: Synthetic oligonucleotide
ccgaguuguaaaugguac

SEQ ID NO: 150076 - RNA, 18 nt, Artificial Sequence
  Description of Artificial Sequence: Synthetic oligonucleotide
agaguccgaguuguaaau

SEQ ID NO: 150077 - RNA, 18 nt, Artificial Sequence
  Description of Artificial Sequence: Synthetic oligonucleotide
ugucaagaguccgaguug

SEQ ID NO: 150078 - RNA, 18 nt, Artificial Sequence
  Description of Artificial Sequence: Synthetic oligonucleotide
ugccuugucaagaguccg

SEQ ID NO: 150079 - RNA, 18 nt, Artificial Sequence
  Description of Artificial Sequence: Synthetic oligonucleotide
acuguugccuugucaaga

SEQ ID NO: 150080 - RNA, 18 nt, Artificial Sequence
  Description of Artificial Sequence: Synthetic oligonucleotide
ccagaacuguugccuugu

SEQ ID NO: 150081 - RNA, 18 nt, Artificial Sequence
  Description of Artificial Sequence: Synthetic oligonucleotide
uucacccagaacuguugc

SEQ ID NO: 150082 - RNA, 18 nt, Artificial Sequence
  Description of Artificial Sequence: Synthetic oligonucleotide
gcauauucacccagaacu

SEQ ID NO: 150083 - RNA, 18 nt, Artificial Sequence
  Description of Artificial Sequence: Synthetic oligonucleotide
guaaagcauauucaccca

SEQ ID NO: 150084 - RNA, 18 nt, Artificial Sequence
  Description of Artificial Sequence: Synthetic oligonucleotide
uuuggguaaagcauauuc

SEQ ID NO: 150085 - RNA, 18 nt, Artificial Sequence
  Description of Artificial Sequence: Synthetic oligonucleotide
uagaauauacaaauucua

SEQ ID NO: 150086 - RNA, 18 nt, Artificial Sequence
  Description of Artificial Sequence: Synthetic oligonucleotide
agguauagaauauacaaa

SEQ ID NO: 150087 - RNA, 18 nt, Artificial Sequence
  Description of Artificial Sequence: Synthetic oligonucleotide
uuguaagguauagaauau

SEQ ID NO: 150088 - RNA, 18 nt, Artificial Sequence
  Description of Artificial Sequence: Synthetic oligonucleotide
agguuuuguaagguauag

SEQ ID NO: 150089 - RNA, 18 nt, Artificial Sequence
  Description of Artificial Sequence: Synthetic oligonucleotide
uuccaagguuuuguaagg

SEQ ID NO: 150090 - RNA, 18 nt, Artificial Sequence
  Description of Artificial Sequence: Synthetic oligonucleotide
guaucuuccaagguuuug

SEQ ID NO: 150091 - RNA, 18 nt, Artificial Sequence
  Description of Artificial Sequence: Synthetic oligonucleotide
aaaguguaucuuccaagg

SEQ ID NO: 150092 - RNA, 18 nt, Artificial Sequence
  Description of Artificial Sequence: Synthetic oligonucleotide
uuugcaaaguguaucuuc

SEQ ID NO: 150093 - RNA, 18 nt, Artificial Sequence
  Description of Artificial Sequence: Synthetic oligonucleotide
gaauauuugcaaagugua

SEQ ID NO: 150094 - RNA, 18 nt, Artificial Sequence
  Description of Artificial Sequence: Synthetic oligonucleotide
cuggugaauauuugcaaa

SEQ ID NO: 150095 - RNA, 18 nt, Artificial Sequence
  Description of Artificial Sequence: Synthetic oligonucleotide
gagaucuggugaauauuu

SEQ ID NO: 150096 - RNA, 18 nt, Artificial Sequence
  Description of Artificial Sequence: Synthetic oligonucleotide
cuagggagaucuggugaa

SEQ ID NO: 150097 - RNA, 18 nt, Artificial Sequence
  Description of Artificial Sequence: Synthetic oligonucleotide
aaagucuagggagaucug

SEQ ID NO: 150098 - RNA, 18 nt, Artificial Sequence
  Description of Artificial Sequence: Synthetic oligonucleotide
aguacaaagucuagggag

SEQ ID NO: 150099 - RNA, 18 nt, Artificial Sequence
  Description of Artificial Sequence: Synthetic oligonucleotide
uuuccaguacaaagucua

SEQ ID NO: 150100 - RNA, 18 nt, Artificial Sequence
  Description of Artificial Sequence: Synthetic oligonucleotide
aauauuuuccaguacaaa

SEQ ID NO: 150101 - RNA, 18 nt, Artificial Sequence
  Description of Artificial Sequence: Synthetic oligonucleotide
aaaugaauauuuuccagu

SEQ ID NO: 150102 - RNA, 18 nt, Artificial Sequence
  Description of Artificial Sequence: Synthetic oligonucleotide
ucccaaaaugaauauuuu

SEQ ID NO: 150103 - RNA, 18 nt, Artificial Sequence
  Description of Artificial Sequence: Synthetic oligonucleotide
ugcauucccaaaaugaau

SEQ ID NO: 150104 - RNA, 18 nt, Artificial Sequence
  Description of Artificial Sequence: Synthetic oligonucleotide
aucucugcauucccaaaa

SEQ ID NO: 150105 - RNA, 18 nt, Artificial Sequence
  Description of Artificial Sequence: Synthetic oligonucleotide
cuaccaucucugcauucc

SEQ ID NO: 150106 - RNA, 18 nt, Artificial Sequence
  Description of Artificial Sequence: Synthetic oligonucleotide
auucucuaccaucucugc

SEQ ID NO: 150107 - RNA, 18 nt, Artificial Sequence
  Description of Artificial Sequence: Synthetic oligonucleotide
caacuauucucuaccauc

SEQ ID NO: 150108 - RNA, 18 nt, Artificial Sequence
  Description of Artificial Sequence: Synthetic oligonucleotide
caugucaacuauucucua

SEQ ID NO: 150109 - RNA, 18 nt, Artificial Sequence
  Description of Artificial Sequence: Synthetic oligonucleotide
ugcaacaugucaacuauu

SEQ ID NO: 150110 - RNA, 18 nt, Artificial Sequence
  Description of Artificial Sequence: Synthetic oligonucleotide
uacuaugcaacaugucaa

SEQ ID NO: 150111 - RNA, 18 nt, Artificial Sequence
  Description of Artificial Sequence: Synthetic oligonucleotide
uucuauacuaugcaacau

SEQ ID NO: 150112 - RNA, 18 nt, Artificial Sequence
  Description of Artificial Sequence: Synthetic oligonucleotide
ucuaauucuauacuaugc

SEQ ID NO: 150113 - RNA, 18 nt, Artificial Sequence
  Description of Artificial Sequence: Synthetic oligonucleotide
ugaauucuaauucuauac

SEQ ID NO: 150114 - RNA, 18 nt, Artificial Sequence
  Description of Artificial Sequence: Synthetic oligonucleotide
agccgugaauucuaauuc

SEQ ID NO: 150115 - RNA, 18 nt, Artificial Sequence
  Description of Artificial Sequence: Synthetic oligonucleotide
uccauagccgugaauucu

SEQ ID NO: 150116 - RNA, 18 nt, Artificial Sequence
  Description of Artificial Sequence: Synthetic oligonucleotide
cugucuccauagccguga

SEQ ID NO: 150117 - RNA, 18 nt, Artificial Sequence
  Description of Artificial Sequence: Synthetic oligonucleotide
ggucucugucuccauagc

SEQ ID NO: 150118 - RNA, 18 nt, Artificial Sequence
  Description of Artificial Sequence: Synthetic oligonucleotide
augcaggucucugucucc

SEQ ID NO: 150119 - RNA, 18 nt, Artificial Sequence
  Description of Artificial Sequence: Synthetic oligonucleotide
acugaaugcaggucucug

SEQ ID NO: 150120 - RNA, 18 nt, Artificial Sequence
  Description of Artificial Sequence: Synthetic oligonucleotide
augaaacugaaugcaggu

SEQ ID NO: 150121 - RNA, 18 nt, Artificial Sequence
  Description of Artificial Sequence: Synthetic oligonucleotide
aaaagaugaaacugaaug

SEQ ID NO: 150122 - RNA, 18 nt, Artificial Sequence
  Description of Artificial Sequence: Synthetic oligonucleotide
cagauaaaagaugaaacu

SEQ ID NO: 150123 - RNA, 18 nt, Artificial Sequence
  Description of Artificial Sequence: Synthetic oligonucleotide
caacacagauaaaagaug

SEQ ID NO: 150124 - RNA, 18 nt, Artificial Sequence
  Description of Artificial Sequence: Synthetic oligonucleotide
caagacaacacagauaaa

SEQ ID NO: 150125 - RNA, 18 nt, Artificial Sequence
  Description of Artificial Sequence: Synthetic oligonucleotide
ucacucaagacaacacag

SEQ ID NO: 150126 - RNA, 18 nt, Artificial Sequence
  Description of Artificial Sequence: Synthetic oligonucleotide
guaacucacucaagacaa

SEQ ID NO: 150127 - RNA, 18 nt, Artificial Sequence
  Description of Artificial Sequence: Synthetic oligonucleotide
auuauguaacucacucaa

SEQ ID NO: 150128 - RNA, 18 nt, Artificial Sequence
  Description of Artificial Sequence: Synthetic oligonucleotide
cagagauuauguaacuca

SEQ ID NO: 150129 - RNA, 18 nt, Artificial Sequence
  Description of Artificial Sequence: Synthetic oligonucleotide
gcucacagagauuaugua

SEQ ID NO: 150130 - RNA, 18 nt, Artificial Sequence
  Description of Artificial Sequence: Synthetic oligonucleotide
uugaggcucacagagauu

SEQ ID NO: 150131 - RNA, 18 nt, Artificial Sequence
  Description of Artificial Sequence: Synthetic oligonucleotide
cgaaguugaggcucacag

SEQ ID NO: 150132 - RNA, 18 nt, Artificial Sequence
  Description of Artificial Sequence: Synthetic oligonucleotide
acagacgaaguugaggcu

SEQ ID NO: 150133 - RNA, 18 nt, Artificial Sequence
  Description of Artificial Sequence: Synthetic oligonucleotide
cuuuuacagacgaaguug

SEQ ID NO: 150134 - RNA, 18 nt, Artificial Sequence
  Description of Artificial Sequence: Synthetic oligonucleotide
aaccccuuuuacagacga

SEQ ID NO: 150135 - RNA, 18 nt, Artificial Sequence
  Description of Artificial Sequence: Synthetic oligonucleotide
uauuaaaccccuuuuaca

SEQ ID NO: 150136 - RNA, 18 nt, Artificial Sequence
  Description of Artificial Sequence: Synthetic oligonucleotide
ucuguuauuaaaccccuu

SEQ ID NO: 150137 - RNA, 18 nt, Artificial Sequence
  Description of Artificial Sequence: Synthetic oligonucleotide
cagauucuguuauuaaac

SEQ ID NO: 150138 - RNA, 18 nt, Artificial Sequence
  Description of Artificial Sequence: Synthetic oligonucleotide
cgcagcagauucuguuau

SEQ ID NO: 150139 - RNA, 18 nt, Artificial Sequence
  Description of Artificial Sequence: Synthetic oligonucleotide
cccugcgcagcagauucu

SEQ ID NO: 150140 - RNA, 18 nt, Artificial Sequence
  Description of Artificial Sequence: Synthetic oligonucleotide
aaccacccugcgcagcag

SEQ ID NO: 150141 - RNA, 18 nt, Artificial Sequence
  Description of Artificial Sequence: Synthetic oligonucleotide
cucacaaccacccugcgc

SEQ ID NO: 150142 - RNA, 18 nt, Artificial Sequence
  Description of Artificial Sequence: Synthetic oligonucleotide
ccauacucacaaccaccc

SEQ ID NO: 150143 - RNA, 18 nt, Artificial Sequence
  Description of Artificial Sequence: Synthetic oligonucleotide
gugcaccauacucacaac

SEQ ID NO: 150144 - RNA, 18 nt, Artificial Sequence
  Description of Artificial Sequence: Synthetic oligonucleotide
gaauugugcaccauacuc

SEQ ID NO: 150145 - RNA, 18 nt, Artificial Sequence
  Description of Artificial Sequence: Synthetic oligonucleotide
cuuuagaauugugcacca

SEQ ID NO: 150146 - RNA, 18 nt, Artificial Sequence
  Description of Artificial Sequence: Synthetic oligonucleotide
aagggcuuuagaauugug

SEQ ID NO: 150147 - RNA, 18 nt, Artificial Sequence
  Description of Artificial Sequence: Synthetic oligonucleotide
agguaaagggcuuuagaa

SEQ ID NO: 150148 - RNA, 18 nt, Artificial Sequence
  Description of Artificial Sequence: Synthetic oligonucleotide
uaaauagguaaagggcuu

SEQ ID NO: 150149 - RNA, 18 nt, Artificial Sequence
  Description of Artificial Sequence: Synthetic oligonucleotide
gguaauaaauagguaaag

SEQ ID NO: 150150 - RNA, 18 nt, Artificial Sequence
  Description of Artificial Sequence: Synthetic oligonucleotide
ugccagguaauaaauagg

SEQ ID NO: 150151 - RNA, 18 nt, Artificial Sequence
  Description of Artificial Sequence: Synthetic oligonucleotide
aaaugugccagguaauaa

SEQ ID NO: 150152 - RNA, 18 nt, Artificial Sequence
  Description of Artificial Sequence: Synthetic oligonucleotide
gcuuaaaaugugccaggu

SEQ ID NO: 150153 - RNA, 18 nt, Artificial Sequence
  Description of Artificial Sequence: Synthetic oligonucleotide
ugagugcuuaaaaugugc

SEQ ID NO: 150154 - RNA, 18 nt, Artificial Sequence
  Description of Artificial Sequence: Synthetic oligonucleotide
ugcgcugagugcuuaaaa

SEQ ID NO: 150155 - RNA, 18 nt, Artificial Sequence
  Description of Artificial Sequence: Synthetic oligonucleotide
caacaugcgcugagugcu

SEQ ID NO: 150156 - RNA, 18 nt, Artificial Sequence
  Description of Artificial Sequence: Synthetic oligonucleotide
guugccaacaugcgcuga

SEQ ID NO: 150157 - RNA, 18 nt, Artificial Sequence
  Description of Artificial Sequence: Synthetic oligonucleotide
ugaugguugccaacaugc

SEQ ID NO: 150158 - RNA, 18 nt, Artificial Sequence
  Description of Artificial Sequence: Synthetic oligonucleotide
aauaaugaugguugccaa

SEQ ID NO: 150159 - RNA, 18 nt, Artificial Sequence
  Description of Artificial Sequence: Synthetic oligonucleotide
uuuauaauaaugaugguu

SEQ ID NO: 150160 - RNA, 18 nt, Artificial Sequence
  Description of Artificial Sequence: Synthetic oligonucleotide
acaaauuuauaauaauga

SEQ ID NO: 150161 - RNA, 18 nt, Artificial Sequence
  Description of Artificial Sequence: Synthetic oligonucleotide
aauccacaaauuuauaau

SEQ ID NO: 150162 - RNA, 18 nt, Artificial Sequence
  Description of Artificial Sequence: Synthetic oligonucleotide
agccaaauccacaaauuu

SEQ ID NO: 150163 - RNA, 18 nt, Artificial Sequence
  Description of Artificial Sequence: Synthetic oligonucleotide
ucaaaagccaaauccaca

SEQ ID NO: 150164 - RNA, 18 nt, Artificial Sequence
  Description of Artificial Sequence: Synthetic oligonucleotide
acaaaucaaaagccaaau

SEQ ID NO: 150165 - RNA, 18 nt, Artificial Sequence
  Description of Artificial Sequence: Synthetic oligonucleotide
accuuacaaaucaaaagc

SEQ ID NO: 150166 - RNA, 18 nt, Artificial Sequence
  Description of Artificial Sequence: Synthetic oligonucleotide
uugucaccuuacaaauca

SEQ ID NO: 150167 - RNA, 18 nt, Artificial Sequence
  Description of Artificial Sequence: Synthetic oligonucleotide
uaaugaugguugccaaca

SEQ ID NO: 150168 - RNA, 18 nt, Artificial Sequence
  Description of Artificial Sequence: Synthetic oligonucleotide
uauaauaaugaugguugc

SEQ ID NO: 150169 - RNA, 18 nt, Artificial Sequence
  Description of Artificial Sequence: Synthetic oligonucleotide
aaauuuauaauaaugaug

SEQ ID NO: 150170 - RNA, 18 nt, Artificial Sequence
  Description of Artificial Sequence: Synthetic oligonucleotide
uccacaaauuuauaauaa

SEQ ID NO: 150171 - RNA, 18 nt, Artificial Sequence
  Description of Artificial Sequence: Synthetic oligonucleotide
ccaaauccacaaauuuau

SEQ ID NO: 150172 - RNA, 18 nt, Artificial Sequence
  Description of Artificial Sequence: Synthetic oligonucleotide
aaaagccaaauccacaaa

SEQ ID NO: 150173 - RNA, 18 nt, Artificial Sequence
  Description of Artificial Sequence: Synthetic oligonucleotide
aaaucaaaagccaaaucc

SEQ ID NO: 150174 - RNA, 18 nt, Artificial Sequence
  Description of Artificial Sequence: Synthetic oligonucleotide
cuuacaaaucaaaagcca

SEQ ID NO: 150175 - RNA, 18 nt, Artificial Sequence
  Description of Artificial Sequence: Synthetic oligonucleotide
gucaccuuacaaaucaaa

SEQ ID NO: 150176 - RNA, 18 nt, Artificial Sequence
  Description of Artificial Sequence: Synthetic oligonucleotide
aaguugucaccuuacaaa

SEQ ID NO: 150177 - RNA, 18 nt, Artificial Sequence
  Description of Artificial Sequence: Synthetic oligonucleotide
gacacaaguugucaccuu

SEQ ID NO: 150178 - RNA, 18 nt, Artificial Sequence
  Description of Artificial Sequence: Synthetic oligonucleotide
aaauugacacaaguuguc

SEQ ID NO: 150179 - RNA, 18 nt, Artificial Sequence
  Description of Artificial Sequence: Synthetic oligonucleotide
uggcaaaauugacacaag

SEQ ID NO: 150180 - RNA, 18 nt, Artificial Sequence
  Description of Artificial Sequence: Synthetic oligonucleotide
uugaauggcaaaauugac

SEQ ID NO: 150181 - RNA, 18 nt, Artificial Sequence
  Description of Artificial Sequence: Synthetic oligonucleotide
gaccuuugaauggcaaaa

SEQ ID NO: 150182 - RNA, 18 nt, Artificial Sequence
  Description of Artificial Sequence: Synthetic oligonucleotide
gaagagaccuuugaaugg

SEQ ID NO: 150183 - RNA, 18 nt, Artificial Sequence
  Description of Artificial Sequence: Synthetic oligonucleotide
aaccagaagagaccuuug

SEQ ID NO: 150184 - RNA, 18 nt, Artificial Sequence
  Description of Artificial Sequence: Synthetic oligonucleotide
aaaauaaccagaagagac

SEQ ID NO: 150185 - RNA, 18 nt, Artificial Sequence
  Description of Artificial Sequence: Synthetic oligonucleotide
uauuuaaaauaaccagaa

SEQ ID NO: 150186 - RNA, 18 nt, Artificial Sequence
  Description of Artificial Sequence: Synthetic oligonucleotide
cauaguauuuaaaauaac

SEQ ID NO: 150187 - RNA, 18 nt, Artificial Sequence
  Description of Artificial Sequence: Synthetic oligonucleotide
agacacauaguauuuaaa

SEQ ID NO: 150188 - RNA, 18 nt, Artificial Sequence
  Description of Artificial Sequence: Synthetic oligonucleotide
ugcagagacacauaguau

SEQ ID NO: 150189 - RNA, 18 nt, Artificial Sequence
  Description of Artificial Sequence: Synthetic oligonucleotide
acacaugcagagacacau

SEQ ID NO: 150190 - RNA, 18 nt, Artificial Sequence
  Description of Artificial Sequence: Synthetic oligonucleotide
ucuaaacacaugcagaga

SEQ ID NO: 150191 - RNA, 18 nt, Artificial Sequence
  Description of Artificial Sequence: Synthetic oligonucleotide
cacugucuaaacacaugc

SEQ ID NO: 150192 - RNA, 18 nt, Artificial Sequence
  Description of Artificial Sequence: Synthetic oligonucleotide
augagcacugucuaaaca

SEQ ID NO: 150193 - RNA, 18 nt, Artificial Sequence
  Description of Artificial Sequence: Synthetic oligonucleotide
uuagcaugagcacugucu

SEQ ID NO: 150194 - RNA, 18 nt, Artificial Sequence
  Description of Artificial Sequence: Synthetic oligonucleotide
gguauuuagcaugagcac

SEQ ID NO: 150195 - RNA, 18 nt, Artificial Sequence
  Description of Artificial Sequence: Synthetic oligonucleotide
accuggguauuuagcaug

SEQ ID NO: 150196 - RNA, 18 nt, Artificial Sequence
  Description of Artificial Sequence: Synthetic oligonucleotide
ccaacaccuggguauuua

SEQ ID NO: 150197 - RNA, 18 nt, Artificial Sequence
  Description of Artificial Sequence: Synthetic oligonucleotide
ggaucccaacaccugggu

SEQ ID NO: 150198 - RNA, 18 nt, Artificial Sequence
  Description of Artificial Sequence: Synthetic oligonucleotide
ucacuggaucccaacacc

SEQ ID NO: 150199 - RNA, 18 nt, Artificial Sequence
  Description of Artificial Sequence: Synthetic oligonucleotide
ugucuucacuggauccca

SEQ ID NO: 150200 - RNA, 18 nt, Artificial Sequence
  Description of Artificial Sequence: Synthetic oligonucleotide
aaaauugucuucacugga

SEQ ID NO: 150201 - RNA, 18 nt, Artificial Sequence
  Description of Artificial Sequence: Synthetic oligonucleotide
ucuucaaaauugucuuca

SEQ ID NO: 150202 - RNA, 18 nt, Artificial Sequence
  Description of Artificial Sequence: Synthetic oligonucleotide
uugaaucuucaaaauugu

SEQ ID NO: 150203 - RNA, 18 nt, Artificial Sequence
  Description of Artificial Sequence: Synthetic oligonucleotide
cugacuugaaucuucaaa

SEQ ID NO: 150204 - RNA, 18 nt, Artificial Sequence
  Description of Artificial Sequence: Synthetic oligonucleotide
cuaaacugacuugaaucu

SEQ ID NO: 150205 - RNA, 18 nt, Artificial Sequence
  Description of Artificial Sequence: Synthetic oligonucleotide
caggucuaaacugacuug

SEQ ID NO: 150206 - RNA, 18 nt, Artificial Sequence
  Description of Artificial Sequence: Synthetic oligonucleotide
acguucaggucuaaacug

SEQ ID NO: 150207 - RNA, 18 nt, Artificial Sequence
  Description of Artificial Sequence: Synthetic oligonucleotide
agccaacguucaggucua

SEQ ID NO: 150208 - RNA, 18 nt, Artificial Sequence
  Description of Artificial Sequence: Synthetic oligonucleotide
ccugaagccaacguucag

SEQ ID NO: 150209 - RNA, 18 nt, Artificial Sequence
  Description of Artificial Sequence: Synthetic oligonucleotide
cuucuccugaagccaacg

SEQ ID NO: 150210 - RNA, 18 nt, Artificial Sequence
  Description of Artificial Sequence: Synthetic oligonucleotide
uuuuccuucuccugaagc

SEQ ID NO: 150211 - RNA, 18 nt, Artificial Sequence
  Description of Artificial Sequence: Synthetic oligonucleotide
uaauuuuuuccuucuccu

SEQ ID NO: 150212 - RNA, 18 nt, Artificial Sequence
  Description of Artificial Sequence: Synthetic oligonucleotide
aggauuaauuuuuuccuu

SEQ ID NO: 150213 - RNA, 18 nt, Artificial Sequence
  Description of Artificial Sequence: Synthetic oligonucleotide
gcaaaaggauuaauuuuu

SEQ ID NO: 150214 - RNA, 18 nt, Artificial Sequence
  Description of Artificial Sequence: Synthetic oligonucleotide
gaugcgcaaaaggauuaa

SEQ ID NO: 150215 - RNA, 18 nt, Artificial Sequence
  Description of Artificial Sequence: Synthetic oligonucleotide
uggaagaugcgcaaaagg

SEQ ID NO: 150216 - RNA, 18 nt, Artificial Sequence
  Description of Artificial Sequence: Synthetic oligonucleotide
ccaaauggaagaugcgca

SEQ ID NO: 150217 - RNA, 18 nt, Artificial Sequence
  Description of Artificial Sequence: Synthetic oligonucleotide
caacgccaaauggaagau

SEQ ID NO: 150218 - RNA, 18 nt, Artificial Sequence
  Description of Artificial Sequence: Synthetic oligonucleotide
uuuuccaacgccaaaugg

SEQ ID NO: 150219 - RNA, 18 nt, Artificial Sequence
  Description of Artificial Sequence: Synthetic oligonucleotide
auucuuuuuccaacgcca

SEQ ID NO: 150220 - RNA, 18 nt, Artificial Sequence
  Description of Artificial Sequence: Synthetic oligonucleotide
ugcacauucuuuuuccaa

SEQ ID NO: 150221 - RNA, 18 nt, Artificial Sequence
  Description of Artificial Sequence: Synthetic oligonucleotide
accaaugcacauucuuuu

SEQ ID NO: 150222 - RNA, 18 nt, Artificial Sequence
  Description of Artificial Sequence: Synthetic oligonucleotide
cggcgaccaaugcacauu

SEQ ID NO: 150223 - RNA, 18 nt, Artificial Sequence
  Description of Artificial Sequence: Synthetic oligonucleotide
cuaaucggcgaccaaugc

SEQ ID NO: 150224 - RNA, 18 nt, Artificial Sequence
  Description of Artificial Sequence: Synthetic oligonucleotide
cucugcuaaucggcgacc

SEQ ID NO: 150225 - RNA, 18 nt, Artificial Sequence
  Description of Artificial Sequence: Synthetic oligonucleotide
ugaagcucugcuaaucgg

SEQ ID NO: 150226 - RNA, 18 nt, Artificial Sequence
  Description of Artificial Sequence: Synthetic oligonucleotide
gcaguugaagcucugcua

SEQ ID NO: 150227 - RNA, 18 nt, Artificial Sequence
  Description of Artificial Sequence: Synthetic oligonucleotide
caaaugcaguugaagcuc

SEQ ID NO: 150228 - RNA, 18 nt, Artificial Sequence
  Description of Artificial Sequence: Synthetic oligonucleotide
agagccaaaugcaguuga

SEQ ID NO: 150229 - RNA, 18 nt, Artificial Sequence
  Description of Artificial Sequence: Synthetic oligonucleotide
aacaaagagccaaaugca

SEQ ID NO: 150230 - RNA, 18 nt, Artificial Sequence
  Description of Artificial Sequence: Synthetic oligonucleotide
uacccaacaaagagccaa

SEQ ID NO: 150231 - RNA, 18 nt, Artificial Sequence
  Description of Artificial Sequence: Synthetic oligonucleotide
gguuuuacccaacaaaga

SEQ ID NO: 150232 - RNA, 18 nt, Artificial Sequence
  Description of Artificial Sequence: Synthetic oligonucleotide
guaaagguuuuacccaac

SEQ ID NO: 150233 - RNA, 18 nt, Artificial Sequence
  Description of Artificial Sequence: Synthetic oligonucleotide
aaccgguaaagguuuuac

SEQ ID NO: 150234 - RNA, 18 nt, Artificial Sequence
  Description of Artificial Sequence: Synthetic oligonucleotide
gcagaaaccgguaaaggu

SEQ ID NO: 150235 - RNA, 18 nt, Artificial Sequence
  Description of Artificial Sequence: Synthetic oligonucleotide
uaauugcagaaaccggua

SEQ ID NO: 150236 - RNA, 18 nt, Artificial Sequence
  Description of Artificial Sequence: Synthetic oligonucleotide
gaacauaauugcagaaac

SEQ ID NO: 150237 - RNA, 18 nt, Artificial Sequence
  Description of Artificial Sequence: Synthetic oligonucleotide
gcacagaacauaauugca

SEQ ID NO: 150238 - RNA, 18 nt, Artificial Sequence
  Description of Artificial Sequence: Synthetic oligonucleotide
aaacagcacagaacauaa

SEQ ID NO: 150239 - RNA, 18 nt, Artificial Sequence
  Description of Artificial Sequence: Synthetic oligonucleotide
uugugaaacagcacagaa

SEQ ID NO: 150240 - RNA, 18 nt, Artificial Sequence
  Description of Artificial Sequence: Synthetic oligonucleotide
cugccuugugaaacagca

SEQ ID NO: 150241 - RNA, 18 nt, Artificial Sequence
  Description of Artificial Sequence: Synthetic oligonucleotide
uucuucugccuugugaaa

SEQ ID NO: 150242 - RNA, 18 nt, Artificial Sequence
  Description of Artificial Sequence: Synthetic oligonucleotide
cucucuucuucugccuug

SEQ ID NO: 150243 - RNA, 18 nt, Artificial Sequence
  Description of Artificial Sequence: Synthetic oligonucleotide
uaccccucucuucuucug

SEQ ID NO: 150244 - RNA, 18 nt, Artificial Sequence
  Description of Artificial Sequence: Synthetic oligonucleotide
agaauuaccccucucuuc

SEQ ID NO: 150245 - RNA, 18 nt, Artificial Sequence
  Description of Artificial Sequence: Synthetic oligonucleotide
aaaacagaauuaccccuc

SEQ ID NO: 150246 - RNA, 18 nt, Artificial Sequence
  Description of Artificial Sequence: Synthetic oligonucleotide
acacaaaaacagaauuac

SEQ ID NO: 150247 - RNA, 18 nt, Artificial Sequence
  Description of Artificial Sequence: Synthetic oligonucleotide
ugucguauuugcggacaa

SEQ ID NO: 150248 - RNA, 18 nt, Artificial Sequence
  Description of Artificial Sequence: Synthetic oligonucleotide
cuggaugucguauuugcg

SEQ ID NO: 150249 - RNA, 18 nt, Artificial Sequence
  Description of Artificial Sequence: Synthetic oligonucleotide
guggccuggaugucguau

SEQ ID NO: 150250 - RNA, 18 nt, Artificial Sequence
  Description of Artificial Sequence: Synthetic oligonucleotide
ugucuguggccuggaugu

SEQ ID NO: 150251 - RNA, 18 nt, Artificial Sequence
  Description of Artificial Sequence: Synthetic oligonucleotide
cucauugucuguggccug

SEQ ID NO: 150252 - RNA, 18 nt, Artificial Sequence
  Description of Artificial Sequence: Synthetic oligonucleotide
acaggcucauugucugug

SEQ ID NO: 150253 - RNA, 18 nt, Artificial Sequence
  Description of Artificial Sequence: Synthetic oligonucleotide
ucucaacaggcucauugu

SEQ ID NO: 150254 - RNA, 18 nt, Artificial Sequence
  Description of Artificial Sequence: Synthetic oligonucleotide
uagcaucucaacaggcuc

SEQ ID NO: 150255 - RNA, 18 nt, Artificial Sequence
  Description of Artificial Sequence: Synthetic oligonucleotide
gaguguagcaucucaaca

SEQ ID NO: 150256 - RNA, 18 nt, Artificial Sequence
  Description of Artificial Sequence: Synthetic oligonucleotide
ugccugaguguagcaucu

SEQ ID NO: 150257 - RNA, 18 nt, Artificial Sequence
  Description of Artificial Sequence: Synthetic oligonucleotide
cagggugccugaguguag

SEQ ID NO: 150258 - RNA, 18 nt, Artificial Sequence
  Description of Artificial Sequence: Synthetic oligonucleotide
ggcaccagggugccugag

SEQ ID NO: 150259 - RNA, 18 nt, Artificial Sequence
  Description of Artificial Sequence: Synthetic oligonucleotide
ggcugggcaccagggugc

SEQ ID NO: 150260 - RNA, 18 nt, Artificial Sequence
  Description of Artificial Sequence: Synthetic oligonucleotide
uucccggcugggcaccag

SEQ ID NO: 150261 - RNA, 18 nt, Artificial Sequence
  Description of Artificial Sequence: Synthetic oligonucleotide
gggaguucccggcugggc

SEQ ID NO: 150262 - RNA, 18 nt, Artificial Sequence
  Description of Artificial Sequence: Synthetic oligonucleotide
aucgcuggcaaaacgcga

SEQ ID NO: 150263 - RNA, 18 nt, Artificial Sequence
  Description of Artificial Sequence: Synthetic oligonucleotide
guauuaucgcuggcaaaa

SEQ ID NO: 150264 - RNA, 18 nt, Artificial Sequence
  Description of Artificial Sequence: Synthetic oligonucleotide
gaggcguauuaucgcugg

SEQ ID NO: 150265 - RNA, 18 nt, Artificial Sequence
  Description of Artificial Sequence: Synthetic oligonucleotide
ugucguauuugcggacaa

SEQ ID NO: 150266 - RNA, 18 nt, Artificial Sequence
  Description of Artificial Sequence: Synthetic oligonucleotide
cuggaugucguauuugcg

SEQ ID NO: 150267 - RNA, 18 nt, Artificial Sequence
  Description of Artificial Sequence: Synthetic oligonucleotide
guggccuggaugucguau

SEQ ID NO: 150268 - RNA, 18 nt, Artificial Sequence
  Description of Artificial Sequence: Synthetic oligonucleotide
ugucuguggccuggaugu

SEQ ID NO: 150269 - RNA, 18 nt, Artificial Sequence
  Description of Artificial Sequence: Synthetic oligonucleotide
cucauugucuguggccug

SEQ ID NO: 150270 - RNA, 18 nt, Artificial Sequence
  Description of Artificial Sequence: Synthetic oligonucleotide
acaggcucauugucugug

SEQ ID NO: 150271 - RNA, 18 nt, Artificial Sequence
  Description of Artificial Sequence: Synthetic oligonucleotide
ucucaacaggcucauugu

SEQ ID NO: 150272 - RNA, 18 nt, Artificial Sequence
  Description of Artificial Sequence: Synthetic oligonucleotide
uagcaucucaacaggcuc

SEQ ID NO: 150273 - RNA, 18 nt, Artificial Sequence
  Description of Artificial Sequence: Synthetic oligonucleotide
gaguguagcaucucaaca

SEQ ID NO: 150274 - RNA, 18 nt, Artificial Sequence
  Description of Artificial Sequence: Synthetic oligonucleotide
ugccugaguguagcaucu

SEQ ID NO: 150275 - RNA, 18 nt, Artificial Sequence
  Description of Artificial Sequence: Synthetic oligonucleotide
cagggugccugaguguag

SEQ ID NO: 150276 - RNA, 18 nt, Artificial Sequence
  Description of Artificial Sequence: Synthetic oligonucleotide
ggcaccagggugccugag

SEQ ID NO: 150277 - RNA, 18 nt, Artificial Sequence
  Description of Artificial Sequence: Synthetic oligonucleotide
ggcugggcaccagggugc

SEQ ID NO: 150278 - RNA, 18 nt, Artificial Sequence
  Description of Artificial Sequence: Synthetic oligonucleotide
uucccggcugggcaccag

SEQ ID NO: 150279 - RNA, 18 nt, Artificial Sequence
  Description of Artificial Sequence: Synthetic oligonucleotide
gggaguucccggcugggc

SEQ ID NO: 150280 - RNA, 18 nt, Artificial Sequence
  Description of Artificial Sequence: Synthetic oligonucleotide
cuggcaaaacgcgauggg

SEQ ID NO: 150281 - RNA, 18 nt, Artificial Sequence
  Description of Artificial Sequence: Synthetic oligonucleotide
ucgcuggcaaaacgcgau

SEQ ID NO: 150282 - RNA, 18 nt, Artificial Sequence
  Description of Artificial Sequence: Synthetic oligonucleotide
uauuaucgcuggcaaaac

SEQ ID NO: 150283 - RNA, 18 nt, Artificial Sequence
  Description of Artificial Sequence: Synthetic oligonucleotide
aggcguauuaucgcuggc

SEQ ID NO: 150284 - RNA, 18 nt, Artificial Sequence
  Description of Artificial Sequence: Synthetic oligonucleotide
uaaugaaccgccuagaug

SEQ ID NO: 150285 - RNA, 18 nt, Artificial Sequence
  Description of Artificial Sequence: Synthetic oligonucleotide
gaggauaaugaaccgccu

SEQ ID NO: 150286 - RNA, 18 nt, Artificial Sequence
  Description of Artificial Sequence: Synthetic oligonucleotide
uugcagaggauaaugaac

SEQ ID NO: 150287 - RNA, 18 nt, Artificial Sequence
  Description of Artificial Sequence: Synthetic oligonucleotide
cuaccuugcagaggauaa

SEQ ID NO: 150288 - RNA, 18 nt, Artificial Sequence
  Description of Artificial Sequence: Synthetic oligonucleotide
ucucacuaccuugcagag

SEQ ID NO: 150289 - RNA, 18 nt, Artificial Sequence
  Description of Artificial Sequence: Synthetic oligonucleotide
gucauucucacuaccuug

SEQ ID NO: 150290 - RNA, 18 nt, Artificial Sequence
  Description of Artificial Sequence: Synthetic oligonucleotide
cccucgucauucucacua

SEQ ID NO: 150291 - RNA, 18 nt, Artificial Sequence
  Description of Artificial Sequence: Synthetic oligonucleotide
cucaucccucgucauucu

SEQ ID NO: 150292 - RNA, 18 nt, Artificial Sequence
  Description of Artificial Sequence: Synthetic oligonucleotide
cauagcucaucccucguc

SEQ ID NO: 150293 - RNA, 18 nt, Artificial Sequence
  Description of Artificial Sequence: Synthetic oligonucleotide
cccagcauagcucauccc

SEQ ID NO: 150294 - RNA, 18 nt, Artificial Sequence
  Description of Artificial Sequence: Synthetic oligonucleotide
gacuucccagcauagcuc

SEQ ID NO: 150295 - RNA, 18 nt, Artificial Sequence
  Description of Artificial Sequence: Synthetic oligonucleotide
uggcugacuucccagcau

SEQ ID NO: 150296 - RNA, 18 nt, Artificial Sequence
  Description of Artificial Sequence: Synthetic oligonucleotide
cagucuggcugacuuccc

SEQ ID NO: 150297 - RNA, 18 nt, Artificial Sequence
  Description of Artificial Sequence: Synthetic oligonucleotide
aaccccagucuggcugac

SEQ ID NO: 150298 - RNA, 18 nt, Artificial Sequence
  Description of Artificial Sequence: Synthetic oligonucleotide
auucaaaccccagucugg

SEQ ID NO: 150299 - RNA, 18 nt, Artificial Sequence
  Description of Artificial Sequence: Synthetic oligonucleotide
cugggauucaaaccccag

SEQ ID NO: 150300 - RNA, 18 nt, Artificial Sequence
  Description of Artificial Sequence: Synthetic oligonucleotide
gugagcugggauucaaac

SEQ ID NO: 150301 - RNA, 18 nt, Artificial Sequence
  Description of Artificial Sequence: Synthetic oligonucleotide
uagaggugagcugggauu

SEQ ID NO: 150302 - RNA, 18 nt, Artificial Sequence
  Description of Artificial Sequence: Synthetic oligonucleotide
caaguuagaggugagcug

SEQ ID NO: 150303 - RNA, 18 nt, Artificial Sequence
  Description of Artificial Sequence: Synthetic oligonucleotide
cccagcaaguuagaggug

SEQ ID NO: 150304 - RNA, 18 nt, Artificial Sequence
  Description of Artificial Sequence: Synthetic oligonucleotide
ggucacccagcaaguuag

SEQ ID NO: 150305 - RNA, 18 nt, Artificial Sequence
  Description of Artificial Sequence: Synthetic oligonucleotide
cucaaggucacccagcaa

SEQ ID NO: 150306 - RNA, 18 nt, Artificial Sequence
  Description of Artificial Sequence: Synthetic oligonucleotide
aacugcucaaggucaccc

SEQ ID NO: 150307 - RNA, 18 nt, Artificial Sequence
  Description of Artificial Sequence: Synthetic oligonucleotide
uagggaacugcucaaggu

SEQ ID NO: 150308 - RNA, 18 nt, Artificial Sequence
  Description of Artificial Sequence: Synthetic oligonucleotide
gaguuuagggaacugcuc

SEQ ID NO: 150309 - RNA, 18 nt, Artificial Sequence
  Description of Artificial Sequence: Synthetic oligonucleotide
guagagaguuuagggaac

SEQ ID NO: 150310 - RNA, 18 nt, Artificial Sequence
  Description of Artificial Sequence: Synthetic oligonucleotide
aggaaguagagaguuuag

SEQ ID NO: 150311 - RNA, 18 nt, Artificial Sequence
  Description of Artificial Sequence: Synthetic oligonucleotide
aaaaaaggaaguagagag

SEQ ID NO: 150312 - RNA, 18 nt, Artificial Sequence
  Description of Artificial Sequence: Synthetic oligonucleotide
aaaaaaaaaaaggaagua

SEQ ID NO: 150313 - RNA, 18 nt, Artificial Sequence
  Description of Artificial Sequence: Synthetic oligonucleotide
aaaugaaaaaaaaaaagg

SEQ ID NO: 150314 - RNA, 18 nt, Artificial Sequence
  Description of Artificial Sequence: Synthetic oligonucleotide
uuuacaaaugaaaaaaaa

SEQ ID NO: 150315 - RNA, 18 nt, Artificial Sequence
  Description of Artificial Sequence: Synthetic oligonucleotide
aucauuuuacaaaugaaa

SEQ ID NO: 150316 - RNA, 18 nt, Artificial Sequence
  Description of Artificial Sequence: Synthetic oligonucleotide
gggucaucauuuuacaaa

SEQ ID NO: 150317 - RNA, 18 nt, Artificial Sequence
  Description of Artificial Sequence: Synthetic oligonucleotide
ucuuugggucaucauuuu

SEQ ID NO: 150318 - RNA, 18 nt, Artificial Sequence
  Description of Artificial Sequence: Synthetic oligonucleotide
cacucucuuugggucauc

SEQ ID NO: 150319 - RNA, 18 nt, Artificial Sequence
  Description of Artificial Sequence: Synthetic oligonucleotide
ugauacacucucuuuggg

SEQ ID NO: 150320 - RNA, 18 nt, Artificial Sequence
  Description of Artificial Sequence: Synthetic oligonucleotide
uuuugugauacacucucu

SEQ ID NO: 150321 - RNA, 18 nt, Artificial Sequence
  Description of Artificial Sequence: Synthetic oligonucleotide
uaaauuuuugugauacac

SEQ ID NO: 150322 - RNA, 18 nt, Artificial Sequence
  Description of Artificial Sequence: Synthetic oligonucleotide
cauauuaaauuuuuguga

SEQ ID NO: 150323 - RNA, 18 nt, Artificial Sequence
  Description of Artificial Sequence: Synthetic oligonucleotide
guauucauauuaaauuuu

SEQ ID NO: 150324 - RNA, 18 nt, Artificial Sequence
  Description of Artificial Sequence: Synthetic oligonucleotide
acuugguauucauauuaa

SEQ ID NO: 150325 - RNA, 18 nt, Artificial Sequence
  Description of Artificial Sequence: Synthetic oligonucleotide
uaacuacuugguauucau

SEQ ID NO: 150326 - RNA, 18 nt, Artificial Sequence
  Description of Artificial Sequence: Synthetic oligonucleotide
aggaauaacuacuuggua

SEQ ID NO: 150327 - RNA, 18 nt, Artificial Sequence
  Description of Artificial Sequence: Synthetic oligonucleotide
ggcucaggaauaacuacu

SEQ ID NO: 150328 - RNA, 18 nt, Artificial Sequence
  Description of Artificial Sequence: Synthetic oligonucleotide
ugccaggcucaggaauaa

SEQ ID NO: 150329 - RNA, 18 nt, Artificial Sequence
  Description of Artificial Sequence: Synthetic oligonucleotide
auugaugccaggcucagg

SEQ ID NO: 150330 - RNA, 18 nt, Artificial Sequence
  Description of Artificial Sequence: Synthetic oligonucleotide
acuuaauugaugccaggc
